United States Patent 7,482,117 (GENETIC POLYMORPHISMS ASSOCIATED WITH MYOCARDIAL INFARCTION, METHODS OF DETECTION AND USES THEREOF) - sequence listing, part 10

SEQ ID NO: 17829 - DNA, 45656 bp, Homo sapiens
  misc_feature (1)...(45656): n = A,T,C or G, or insertion/deletion polymorphism (see Tables 1-2)
gtacagacaaggatacatggcagagagatcagctactttatcccaaatgcttcccagacattaaatcctaacggacactaagccctccttaggctgtataggagtggggtccctatcagaatttccggcaacaaaagtccctctccttgggtttgtttttacttgctgacctgcgtggctaggtgctagaaaatcccttatctgagccaagtgtgtccagctatgttccaggaactgctcctagtgaggtatatgtactaattcatgtaactatctcaaaaattaaataaggtaagtattattgttatccccatttttcagaagagcgaaaaaacaaaaaaatgaagtgattttcccacaaagttctatcactagggagctgcaaaacaagattcaaaccttggggcatacttaagagcactgaacaggtttgagccaaagagccattagagggccagagccgggtcctgaaccaacaatagacggagatgtgctagacacactggaggtgctggggtataagggaccattgctagaggagcaagcccttatgaaggcagcagagtggactatatgtaggagcatatacggtataggattatatatataggcttttatacaggaagaaggtggtatatactgtaaaggaatagatatataaactatataaattcctatacaggatatggttaggctttcaaataaaatcattatgcaacttggaagaaagtatgacttctgctggaagagatgatctagagagcttccagcttgaggtaaatgatttttttaaaagaaatggcatgtccatattctgtactcatatcaggagatactaaagatcattttaaaaaaggaggactggctgggtacaatggctcacacctgttatcccagcactttgggagaccaaggtggacagattgcttgagtcccaggagttcaaggccagcctgggcaacatggtgaaccccatctctacaaaaaatacaaaaatcagctgggtgtagtggtgcatgcatgttgttccaactacttgggggcctgaggtggaagaattgcttaagtcaaggaggtcaagcccacagtgagctgagatcgcgccactgtaaataaaaaaatataaaaaggactgtttgaaactcctattatttttaagtacagaacttgaagcttcacagatattacagaacaagaaacattaaaattctcaattagataaaaataatgaaatttatcaggaagttcaagttctgtgtgataaccttggtgtacccaagtaaacaacttctgacattctggttatgctaaaccaagtggaatcaaaggtgaaagacaggcaggacgcagtggctcatgcctataatcccagcactttgtgaggcagagatgggaggatctcttgagcccaggagttggagaccaatttgggtgacatagcaagatcccatcttatttcaaatttttaaaaattgttaatttttttattaaaattaaagaaaaccactctgctgaaaattaatttaaatttgaaacaggcagaacaactggaaagagtcaatgatgctctttcctgtgaacatgagtgcctctagcgaatgttatgaaacaattagatgcggcaatacagtccgttgcacggtgtgatacagccaaggtaagaaaagatgacacagcaagaatttaccagcctcagtgttatgctttgtcacccaagacagcgattataatggtgcatctacttgctgctcatgataatctatccaagatcattaggacaagcagtggagccagccagatgatggcatgtgccattaataaggtgctgatgggaagggtgcctgacaggggaggctggccaaatgaaattgaaccaccaccctctgaaatgcccccttggcaaaagagacaagaaggcagtggcggaaggggtggttggggtggtggttgtggaggtagaggtggtagtagaagaggctgtgggggtggaggtggaagagttggctggggtagaggaggatgggaaagtggtgggggagagggaggaggtgggatggaggtggtaaaggaggtttctaaggcagaggagatgatggtgggaggggagattatggtggaaaagattatgtagatccatatggaggaggtggtgatggtggtggatataggagatactgaagactacaaaaattaaaaaccaaaaccaacaaacctcaagcgcaaaggaatagtctgccctcttatgtcacaagcactaactaaccacctctgccctttctcatcccttaatcattcagacaagatttccttgtttacttcctcctataaaaaccctaagtctatttcattttctttgaaaagattcctctgcattaatggatgttgtccttactacaatagcatgaaaaaaaaaaaaagtctccttaatgcagcttagcaattttccaggcttgatatcagtgactccatcttgggctattgactccatgctgagctgctgctaaactttgaggcccacgaagaaactgtgaaaaatatttccttcacaaacaactgttataaataaagttttggtgttgcaaaagaaatagcactcgaatataaattttctttttaattctcagcaaggcaatgtacttcttttttttttttttttgagacagagtcttgctctgtcgcccaggctggagtgcgtgtcgcaatctcggctcactgcaagctccgcctcccgggttcatgccattctcctgcctcagcctccggagtagctgggactacaggcacctgccaccacgcccagctaattttttgtattttttagtgttagccatgatggtcttgatctcctgacctcatgatccgcctgcctcggcctcccaaagtactgggattacaggcgtgagccactgcgcccggcggcaatgtacttctatagacgggtgcgccctcacagatggagcaatggtgagctcacacctgggcaagggaggggaaggggttcttattcctgatgcacgtggcctctgctgctgtgtcgttcccctgttggctagggttagaccgcacaggctaaactaattctgattggctaatttaaagagagtgatggggtgagcggtttggcaggaaaaatggttaaggcggggcaggaaatcggaatgagtcagggtggagcaggtgattgaaatgagtcagggtggagcaggtgatggaaaaaggttgctttacgaggaagttaagtttaaaagtaaaaggcaaagattgaccatactgacatattgattctttgaagagaaatttagaattcatatctaacacaaccgtttttgcaacaacacacaacccaagaaagctggtctcaatattattattattattattattttccgagacaggctcttactctgtcacccaggccggagttcagtggctcaatcttggctcactgcaacctctgcctcccaagctcaagtgatccccccatctcagcctcccaagtagctgggactacaggcgcatgccaccactcctggctaattttttttgttttttgtatattttttgtagagattgggttcaccatgttggcaaggctgctctctcaaactcctggcctcaagtgatcctccccaaagtgctgggattacaagcataagccaccacgcctgatccccaatctttttttgtttgttttgtttcatgagacagactctttctgtggcccacgctggagtgcagtggcgtgatctcggctcactgcaacctctgcttcctgggtttaagcaattctcccgcctcagcctcccgagtagctgagaattacaggtgcccacaaccacgcctggctaatttttatatttttagtagaaacagggtttcaccatgttggtcacgttggtctcaaactcctgatttcaagtgattcacccacctcagcctcccaaactgtcaggcctctgagcccaagctaagccatcatatcccctgtgacctgcacgtatacatccagatggcctgaagcaactgaagatccacaaaagaagcgaaaatagccttaactgatgacattccaccattgtgatttgtttctgccccatcctaacagatcaatgtattttgtaatctcccccacccttaagaaggttctttgtaattctccccacccttaagaaggttctttgtaatctcccccacccttaagaaggttctttgtaattctccccacccttgagaatgtactttgtgagatccaccccctgcccgcaaaacattgttccgcggagcctctcccaaaacctataagaattaaagataatcccaccaccctttgctgactctcttttcggactcagcccgcctgcacccaggtgaaataaacagtcttgttgctcacgcaaagcttgtttggtggtctcttcacacggatgcgcgtgacacaaagtgctggggttacaggcctgagccaccacacctggccacccccaatctttaagaatattctggccgggcgcggtggctcatgcctgtaatcccagcactttgggaggctaaggcgggcggatcaagaggtcaggagatcgagaccatcctggctaacatggtgaaaccccgtctctactaaaatacaaaaaattagccgggcatggtggcgggcgcctgtagtcccagctacttgggaggctgaggcagcagaatggcgtgaacctgggaggcggagcttgcagtgagccgagatcgtgccactgcactccagcctgggcgacagagcgtgactccgtcccccccccaaaaaagaaagaatattctgtatgtagtttttttgttttgtttctgacagacgcaaacgcactcttctagtaatgactaaagacttcttcgtttaattcaccaatgaactaatctgacaatttatgtaacaaataaattcctataaacataagctcccttgcccctctccagtggcacaatctctgatttgccatcctggttgcaaccttcattactaagtaaacgcttacgtaaaccttaataatgagattcgggcaatatgattaaatattggtttatttgagtgcaaagtttgaggatggcgacccggtaggacacagactccaaaagatgggggtcagtgcttcgaaagggagaagtttgagggtcgtttacacaggcagggtctgggaagcttaacaggatgtcaacattttccatagaaggttaacgcatagcaatttgattggttcaaggcagtgtttctttttgggaagggtctatttaacattccacattaaggatgtaatagtcaagcggtcatttatcttattcaatgcgtattttatctcagatgccatctggtctgagctgggaacaagaaaataagggagttaatctataacaaaaggtcggcaattaagaggtcgtgcttcgtgatctggtctccaaagtcaactttcctcagggactttcagaatccccaaatagactatccactttctttcacacttatttgcctctaacttgttgatttcttttttttttttctgttttttaagggttaacaatctcttgggtgcactctgacttccatgcgctttatagaaaaaattggtcctgaggccagcagcaacagtcggtctcaggaacttgttagaaatgcacatttttcagccccaccccaaacctactgaatcagcagttttgctggtggttctcaatctctctttaacgtgccctctgggtgctgcggatgcacgctgaaggtagaagatcgctgcaggagatttccgcgtcgggcagatgaaagcgctctgcaagcccgggtgttatctgcgggccgggtccgcggcttctctggtggcactaggaccgcggcggcgcggccctcgcagccaccgcctcgggcgtgaggcggagcgtagctgttcctggatcctgggcctggctcctcgacccgcccctggaggcggaccccacttgacttaaactctggggcccgggaggccgccggttttctccccgcttgccggggtggtcctcttccctttgtcggtaagtgtgagacgagcaccccgaggtccctccgccttccggggtccgggcggggcgggggccgggagccgggagccagaggcactcgcggtccgggcctgcgcgcggcgcagagcgcttttgttctgcggcaaagacgcagtcgcgggcggccccggaacccgggcctcgggccccgccggctcgcgcgtcccgccgtccgcccaccggagctgggccgggccgccgcgcttgcttctgcccgccgcrccggggccggccctgggcctccgcggatgccgagccttgcaccggagggcgggcctcgctggctgttttccctcattgcctggctctgcgcggtagaggtcgcgagtggcgaaggctaggacgcattttgtcgaactgcgaggcgcggctggtgaggcgggtgggtatgagagctgcttatgtttttaaggctttcctgtcgctggagtgaaaaagaaaaatctttttttttttttgctatttcccgagggttctcctcctccccggccctcttaagccgaagcctcctggaacagaattgctgtactggcatctatctccaagtggtccgcgaacgcttctgcgccggcgatggtttctgttcctcagcaatagttccttgaggcatttttaaatgcacaaacgcatacccatcttaggtgttctcgagggacacggattccctaagcaaacgtccttagggtcctgagttcagcagcaaactttcggggaatcatttccgtgaaaacaatttatttgtagtacatcgagtgcatactgtcttaacataaggatgtgtatgagcttgaggcgcattttcatttagtggcgggcgggtgcatttcagtaggcgggccgcagagcttgtttggggattgcatttttctgctaaatgtgttagctttaatcatgtttcagtcactgttaatgtgcatgcatgttaaggttttaggttttttcccctgtgcagtcggatttttttctgtttaatattaatccaataaagacaagtgcagagataaagtattattgttttgcagtgatactacaatagcggacctagaggagcgcacataaattctaacttaagtgaatggtattttcaggccagacctagtttctatttctgttacttaggacacttaataagaattcagtaaacttagcatgctttcagtgcagccataaaagaaaacagttttgcacagcagtgtcatatctagtaaacacattagcatgtgctcttttattataaaatgtttcttgctgtccctaggaccaaagaagtaaacactgtgtggagagggactgacgtgtttggagggaaatgggaatgtacacgataattaaagagtaaagttgtgctcaacggtaagtgtatcacctctaagaaacccgccctgatttaaccaggcggttattcacactcaactatggagtaattcacctattaccgaataaaattactagctcagtgaatcaacatcggttttaaattaaactgtgggtcacaatggaattgacagcaaagcttgagaagaaatgttgttggcatagtactgaaaaatcagttgttaatcttagcaaaataaggaaagaggtctttggtaagggaattgtggtggaagttacctgggcagaggtctgcttctgtctgtgctgtgtttatttgattgtttttattatattttattactgttggtggcacataggggaatgtggcrcagagcaccactctggraggatgcttcccgtgcagccaaagtgatcatgtccagggctttcatctgtaaccacaaagtgtgttaggaagtctcacctaatgattaagaccatggtccctgtaaccacactgctttggttcagatcttggctgtagcactcagccaaccctggaaaataaacctctgcctgttctctcatctataaaatggggacaagcactaatgtcataggattgttatggtagagttacatgagtttcatgcatatcacagttaaacagctcctgatgcatggtaagtgcccaataaatgttagctattgtcatgttagaggaaatagattttgtggcctgggacatgtaatgctgccttagcagaaattcagctggttcatttaagctctaaatttatgagctttttattgattaaacccatcactgtagatcctcttagattctcttttttgtaggtcttgttttgttaggaagtacctgtcactactggtccacatctggatttacctgcaggcttgtttggaataaaaaatgcctccaaattcctaggcaggacaaacttgccccaaagctttgttgttctacattatctctgtgattgtacaggaatctctcttccctcctagattatcagtgtcttggatataattggagctcaaatgcttagggaattgatttaatgttgcttaaaacgtatttgtaggccaggtgtggtggctcacgcctataatgccagcactttaagaggctggggcaggcagatcacttgaggccaggagttcgagaccagccctggcctcaagttggccaacatggcaaaaccccatctytactaataataacaaaaattagtcgggcgtggtggcacatgcctgtaatcctagctactcaagtggctgaacccaggaggtggaggttgcagtgacctgaagtcaccccatcgtactgcagcctgggtaacagagcaagattctgtctttttwaaaaaaaaaaaaaaaaaagcatttgtgaaggtgaatttcaagaatctaatcaggcctccctccctcccccattagaggcacactctattatgtaaaacagacagggagtgtattcattttgagataagtccaggataacagttgactaaccctggctatagatacgcaagttaaacattcactttggaagaagattgtgaagaaagaatcttggaccttgaggaattctaaatgctttgttgggtggcaactatgcaatacttacactattcctaataccttaagtgtacttgtaagtgaagagcaaagttggaggctgttgaggtaaataatctcaagtgagattggaactatacrttttatgctcctggttttcatgatcgcaaagatttaatgacagtaacttaagattctcttgatgtatcaaattacaaggtttcatttgtaaataaggtgattaaaatgacaaagtgtattaaaagaaattgtattgtccagtgaagttttaagaaacagaaaccataaggtgattattatttttcaagccccaaaggagaattcattagatgacatacttttaaagttcatggatcagggtcgggtgcggtggctcatgcctgtaatcccagcactttgggaggccaaggtgggcagatcacctgaggtcaggagttggagaccagcctggccaacatggtgaagctccatctctactaaaagtacaaaaaattagccaggcgtggtggcacatgcctgaaatcccggctatccgggaggcagaggttgcagtgagctgagatcgcgccactgtaccctagctcgggtgacagagtgagactctgtcttagaaaataaagtccatgggctggtcgcagtggctcacgcctgtaatcccagcactttgggaggccaaggcaggtggatcatgaggtcmggaaatcgagaccaccctggctaacaggtgaaaccccaaaattagccaggtgtggtggcatgcgcctgtagtcccagctaactcaggaggctgagataggagaattgcttgaacccaggaggggaggttgcagtgagctgagatcacaccactgcactccagcctggacgacagagcgagactgtctcaaaaaaaaaaaaaaaagttcayggagcgcaacctttgggttttgatggatccaggatctaaatccaaaagagagttttaaagatttgggacactgtatctttgagctctgctgtcctctgctttggttttcaggcagaccatccctccactgggcagccctgacatctccagatgcaagcagcttcaagttgttcagagcatgccttttgtaactatagttagagataaaattcataagccatttattcactcatttacacccagtgtacagtttcagtggtttttagtatattcagagttgtgcacccatcaccacgtcaatttaagaatattttattacccccaaaatatctccatactcaatagtggtaactccccattttctccaacgcacctttccctaggtaaccattaatctacttctgtaggtttgcatattctgaacacttcatataattgaagtcataatatttttcatccagcatgttttcaaggctcatttatgttaacacatgtatgttacttcattcgtttttattaccagatattccgttgtatggatatgccacttttgcttattcttccatcagttaacagacgtttgacacgttttcactctttgactactgtgaatagtgcagctatgatcattcatagtgtttatgtagacgtgtatttttatttcttttgggtaaatacctaggagtggaattccttggttatgataactgtttaacattttgaggaactgccaggctattatccaaagtagatttaccactttattttttatttaacttttgttttatgtttgggggtacgtgtgtaggtttgggggtacgtgtataggtaaagttgygtcatgggggtttgtggaacagattatttaatcacccaggtattaagcctagtacccaattagttgtttttttttcaaatcctctccctcctcccacgctttgcctgcctataggccccagtgtgttgagcccctctacatgtccatgtgttctcatcatttagctcccacttatgtgtgaaagcatgcaatatttggtttcctgtgttagtttgctaaggataatgtcctctagctccaagctcctgcawaggacatgatctcattctttttttatggctgcatagtattccctagtgtatgtgtactgttttctttatgcggtttaccgttgatgggcatttaggttgattctgggtctttgctattgtgaatagacatgcacaattttatacagcaatgtttgagagatggttggtctacatccatagacacttaacttttatagccatagaagtgagcctgaagtggtagctcattgtggttgtgatttgcatttacctgatgattagtcatgttaagcatctttttatgtgcatgttgatttctttggagaagtatctattcaaaacttttggccttaaatttgtgttgtctttggattgtcaggttgtaagtttttaagatatcctggattctgatccttccttactagggaccataaatgtgagggtttactcctgggttctaggttctrttccattgatcaatgcctgtcctgtgtcagtactatatggtcttgtttattgtagttttgtcgttttgtttttttgttttttgtttttaagactgaatctcactgtgttgcccagaatggagtgcggtggtgtgatcttggctcactgtaacctccgcttccgattcttctgcctcagcctccaaagtagctaggattacagacacttgccaccacaccgcggtaatttttgtatttttggtagaggcgaggtttcaccatgttggccaggctggtctcgaacttctgacctcaagtgatcagcgtgcctctgcctcccaaagtgctggaattacaggcgtgagccactgctccctgccggctactcccttttcaacccctcctttttctgtgtcaaagttgctgagtggcagtcagaaaatgaaagtacctctgattggtcccctcccacaaccaatcaggctagtggctggccactacttcatttacataacgtgaatccatggtaaacctctagagagtatttaaactgcagaaaattatgtaacttgactgtcttgagccactgctgcccccgctcccaccctgtggagtgtgctgtcctttaaaataagtctctgctttggctgccttgcttgtgtggtttgttcagttctttgttcaagacgccaagaacctggacarctaccctcaactgcatggtttagaggaactcttctgttccactgaaggcattttgtctatctccagtggcagaaaattgactcactcataataggagcgatgaagaagcgatacttctggccaacatggtgaaaagccatctctactaaaaatacaaaaattagctgggcgtggtggcgtgtgcctgaaatcccagctgctggggaggctgaggcaggagaatcgcttaaactcaggaggtggaggttgcagtgagccaagatcacgccactgcactctagcctggtgacagagcgagacttcgtctcaaaaaaaaaaaaaaaaaaagaagtgatacttcgaatacagtttttacctcaacacagtgttgtcttaatatggtttgtacccgcctgccacacactgatgtgtcatgtatacttgggggtgcttgtcagcgcttttcagatatttaagatcaccagacctctagtacacggtgtgtccaatcttttggcttccctaggccactttggaagaagaattgtcttgggccacacataaaatacactaacactaacaatagctaatgagctttaaaaaaaattgcaaaaaawaaatcycataatgttttaatcatgcttatgaattagtgttgggcctcattcaaagccgtcttgggctgcatgctgcccatgggccgcggattggacaagcttgatttagtagatgtttccttgagttgggtatccagagggctccgaaatgaattacttggcagaattctcgtagggtaactggcttccgcttcatgtgttctctgttgtctttaattcccattttagggaataatacaaatagaaaacatggtctaaaatttgtctctggcttctctgctctgaaggcacaacagactagtgtcagtattctagcctgaatgatgatagtctgttgcattggtctgaacttcctgctggccagtcaagatgtgtgattgccagcacttcatgctgtacctgtgttaacgagtcagaaaaagtagagcaatttatttctcccttttttagggagaaagccctgtggctctcactggtgaagcttggtagttgggatatatttagcttacttggctctgcatggggaacgtttggtatgtcctccacaataggtgtgatcatcctgctgggaatcacgattgcaggcactttttaatccagtgttgcctaagacaaagtacaatggattaggatatctgattggatggcctgtggttctgaatagagtttgtagctggatacatgaaagatgggaaggcagagttgtaggtgaacagcttcaccgtggtgccctgatgacttgctcttctcatagaccatggaggcaaagcttaggcttaatcacaggctgacccatattctggcaggacaaccctgcaggtcctccaagaacaaagtgagagaaaagcagccctgtgagaaacagtcacaaagcagtttctcatctgcctccttggtttcaattgtgcataggactttaccaccttggggggtatacttgctggctataaaatggccacagtttggtgttctcatctggcttggtgtcatcccgtggggctggggatactgatcttgattttgctgttggacttagtaatatatgaatccatttggccttttgctgactgcagttacagaagcatagagaactgttctgccccttctaaccactgtgctgcaagagggaggattgckagtctttgttaatttgttgtgatacttaaatgagataaaagtatatgaagcattccacatagttctttacatacagattttcaaatgttagttgtttatagtagtacagatgtacctcagcttacgatggagttacatttcgatwacctgtattaagtagaaaatgtaagtcaaaaatggggttttatagacatgatgggatgggaaaacacaacatccaaaaaacttagctaacacagtacaccattgattggttttttgttttttttaatgtgccgtgggaggggcagccctgcacgcccgcccacccccaccccccacaacaccagcctgcctccgcaggggggatttttgttttttttgtgtgtgtgtgtgtttttcattgattgttaatgctcatgatcacgtggctgactgggtgctmtggcttgctgccaccacccagcgtggaagaatatcatactgcctatcacaggcccgggaaaagatcaaaattcaaagtacaatttctgctgaatgcctgtatcacttttgcatcattgtaaagtcaaaattattaagtcataccattgtattgtggtccaggaccatctgggcttagaaaaatggattctagaaagcctatttaaggactgataggctaattttttctgtgactaaggtgacagaaagccagagctagtacaggttgaataaattgtgttacatttggaattcctgaaaagtggctttttacactgaattgttagtattggtggtttgttaactttctacaggtatctctaatttttcgaatgcttatgttgcaagtcaggttttcaatgaaaaatagactttactcagtttaaccatatcagtggatactcttcaaataaactttcctttgtggaacataagaagtggaactttaaaagccataagggaagttttcaatttaaaataccagagcgaatttatatattttaggtataagaatagtattttaatgtatattatttatttcttaagtcctacgtcttttaggtactkaaatgcttacagatgaaatcatgctatgtctgtggttggcatagatagaaaaggaaacagaagtggtcaggactttttcccatctataagtttacattaggacttctcttttttttttttttttgagayggagtctcactctttcgcccaagctggactgcagtggcgctatcccggctcactgcaagctccgcctcttgggttcatgccattctcctgcctcagcctcccgagtagctgggattacaggcgcccaccaccatgcccggctaattttttgtatttttagtagagacggggtttcaccgtgttagccaggatggtctcgatctcctgacctcgtgatccgcccgcctckgcctcccaaagtgctgggattacaggcgtgagccaccgcgcccggcctaggacttctctttaatggggtgttcagataatgtttgtttattcagcaaatactgaaacctgctagacattatctacatgcatgtgtcttttgggttggcctgaaagacttttatgcctgtcgtattggctgttaatagtacttwgattcactctgatgatgttccacttacctttaataaattgtcaacccacttttctttcccttttttgagacagatcttgctgtgtcatccaggctggagtacagtggcactaccatagtccactgcactctcgacttcccatgctcaagtgatccttccatctcagcctcccaagtagctgggaatataggcgtgtaccaccacgcctagctagtgtttctatttttatttttatttttttgtagagactgggtcttactgtgttgcccatgctggttttgaactgctggactctgcctcagcctctcagcatgctgagattataggtgtgagccaccacacctggccagtggtaacccctgtgtataaaacaattcttaggctgagatggcttgagcctcaggagttcaagaccagcctaggcaacatggagaaacctcatctctacaaaacattaaaaaaattagccacacggtggcattcacctgtagtcccagctgcttgggaagctgtggtgagagaattgcttgagcccaggaggtggagttggcagtgagctgagatcgtgccactacactctagcctggatgacatagtgagaccctgtctcaaaaaaaataaaccaaaattcttgctgtggctcagtttatacttccatattctatttcttgctgttttatctgacctacagcagacctggccaccatgccatattcacaatattaggttcattttctggtttgtttggttttcttttgtttttgagacggagtcttgctctgtcgcacagtctggagtgcagtggcatgattcccgctcaccactgcctcaaccccctgggttcatccaatgcctcagccccccaagtagctgagaatacaggtgtgtgctaccacaatgctgcccaggttagtctcgaacttctgagctcaagtgatctgcctgccttggcctcccaaagttctgggattacaggtgtgagccactgtgcccagcctaggtctattttcttatrcttctttctattcatgtgtatgtgtgcttgtgcatgtgtgtttaacatggatagtaatatggttatttcctataggtataattttagattattttttgctttataattttctgtagtaagcccaatttacaaataaaggaagctgctgggttgacaacttttcagttatttgcattgtgtggatatagaatattttttaaatttcacagatattgttaatcttagtgagatctttaatatgaaagtccacatccataattatctttatgctttcttgcagctgtttacttctaattatttcctgattcacaaattaatttttgcaattcacaacttcaagaatacttggactattggattcaatccatagtaatctgcaaaagaagagaagcagaattatacctagaagtctactaatggacagttagtcacccacctacatgttgaggtactctggacctttttctttcacctcactggaagggaatgtgggtgggaatttaagacatctacttccttgttgattttccacctatttgttctattcattgttgaaagtagggaattgaagtcttccactcttattggtgaattgtggtttttgcttcttgtattttgatgctcttttaggtattaataacctacagatcacatttgacagttttaagtaaacaagcttccagattaacttgctttggggaggtattgtgatacaagatggtgacatcctgtccttgagtaaagaatcttacacattcctcaaatgggtatactgattaatgcataacctaacactcaaaagggtgctgctttatttgtaaatcaggttttattgatgcaagttttcttgcacttagacattttagcctatatgttgcaatcagtagccaatgattataacctcagtattgtatcctccaacgaaaaaagacaatttgagtattaggagtccccctcccttctcctataatttcatataaaagccttccaacttgtagcggactccagaacactttgaactctgttggtatgtcttcccagattgatcctcacatttggcctccagtaaacctttatcagattatttctacctcaagaaccttcgttttagacaacagtgcatatatgtttgtaattgttaccttgatgggttgatccttttatcattataaaatgcatctctttatcagcattttttgtcttagtctgttttgtctgatactagtataggcattcctgctttctttttttgagacggagtttcactcttgttgcccaggctggagtgcagtggcacaatctcagctcactgcagcctccgcctcccggattcaagtgattctcctgcctcatcctcccaggtagcagggattacaggcatgtaccactatacctggctaattttttgtatttggtggagacggggtttcaccaggttggtcaggctggtatcgaattcctgatctcaggtaatccacccacctyggcctcccaaagttctgggattataggtgtgagccactgtgcctggcctgcattccagctttcttgtagctatttgtgtgataytttttcatcattttactttcagtctgtgtttttggatctaaggtatatctcttggaaacaataacatatagttggatagtttttaaaatccagactgacattctctgtcttttggattgtgatattatgaaatatatctctggtctttatccctgttttcaggcatacactcctaaaattcgagcagtctccaaagtgataaatgtcttttttgtatgctaatgagttgacttatggctgacatcccctagtttcagaatggagggctggtcacctgaaagaccaaggcccgattaaagggttgggacttttcagccctacccctaattcctggtaccaattgtctatcttagtccattttctgttacttatagcagaataactgaaacaggggcctttatgaagaaaaggaattcatttcttacacctttgaaggtgcacctggttgagagggagggggtgaggttaagttgatcaccaatagccaatggtttaattaatcagatctgtgcaatgaagcctccataaaaccggaaaggatagagtttagaaggcttttcaggttgctgagcaggtggaggttcctagagggtggcgtacccagggagggcatggaaatgctgtgccccttctcatgtgaccttgccttctacatctcttgaactgaatccttggtaatatactttataataaactgataaggtgtttccctgagttctgtgagctgctctaacacgacaaaccaaaggagcgggacatgggaatcccagtttacagctggtcggtcggaagcacaggtaaaataacctgggacttggtgttggcatcagaagtggggggcagtctcggctgggcacagtggctcacgcctgtaatcccagcactttgggaggccgaggtgggtggatcacgaggtcaggagatcgagaccatcctggctaacatggtgaaaccctgtctctactaaaaatacaaaaaattagccaggcgtggtggtgggcaccggtagttccagctactcaggaggctgaggcaggagaatggcgtgaacctgggaggcggagctcgcagtgagccaagatggtgccactgcactccagcctgggtgacagagtgagactccgtctcaaaaaaaaaaaaaaaaaaagtgggggcagtcttgcaggactgagccctaaactgatgagatctgacactatcttcatatagatagtcttggaattaaaatgaattagaggacacccacctggtgtgtacactgcagaactgattgcttgttatgtggggtgagacacccacacatctggtgtcagaagtgtgagaaagtttattcctacattctcagaattgtttatataaaaatgttattttttatataattacatttacctctaatgttttactttttgtttttatgtctcgtctttttattcctttcttattccttagtggggttkattttgcataaatgagtattttctaatgtagcattttaatttctctttgttttttctgtttttaatttctttaacgatattttcactgtattttttgtaacttcatggaagcacaaattctttttaaaagtattttttatattaaastatcagtgatggaggctggcagagatcttggggcgagaatttattytctcagagaaatggtagtgatggaccatggaaacttgtctatggtaatctgtgttagaatatattcttgaaagttctaagaatacattatatccacaagtagattatgccatcctagagactgcagctgacccttgaacaatgtgagtttgacccatgtggatccacatacacatggatttgacttttttttttttaagagatgaggtcactctctgttgcccaggctggagtgcagtgtacagtcatagcacattacagcctcaaacatctgggctcaaacagtcctcccatctctgcctcctgagtatctgggactgcatccacacactaccttgtctggctacacttggagtttcttctgcatctgccactctactgccaccctaagtcgtaatccctatgttgttcaagggtcgattgtattttcctttcacagtctatttgtgtagctagtaggcaatcttccaaaaacttcaatttaggtcgttccggagtgcttttcgagttttcagttttcttctatgccagtgaaggagagggatggaggaaaaaaaaaacccaaattaacataaagatagtttcccttcctacccatatgctctgtattaattgctagggctgtgtttgagataggaaaaccaaaacttcttcacacaactgaccacttcatctctggtcaccagaatgtatttggatttcttcccatccgcaaactgttttccagctgacaacaactgggtgtcctacaattcaattacatgttggcatcatctacctggagaaagcttcagatcccacaggttgaggactcagtcccacaagactgcccctgacttcgccagacctgtacttttgaccaacctgttacaaagaggggattgtcaagactccctccgtggatttgattaatttgctagagctcacagaactcagggaaatagtttacttattataaagcctattagatgaagagccaggtggaagagatgcatgggggaatgcatatgtgagcgcttccatgccctctccaggtgctgccccaccctacggtcacctctatgttaccagacactcctgttactcaggagattacaaaggtctcaggagctctgtgtcaggaaccgggttcaaagaccacgtattagtgcaaaagattgtataccccaatctacaagagttttaggtgccccgtgtctggaatcatgggcagagaccaagtatgtatttcttatcgtgggctactatgacagtaatgccacagactgggtggagaaatttatttctcccagttccggcggctagaagtccagggtcaatatgtttgatttctgttctcttgaagcttctctctcagtggcttgcaggtgactgtcttcttgctgtgtcctaacgtggtccttcctctgtgggccgacatcgctggtgtccctcttcctatgggggatactagtcggattagagccccactctaatgacctcacttaaccaattatctccttaaaggccctatctccaaatacactgagggtcagggctttcacttatgaattttggggagggtacaattcagttcatgagactctctcctccaagttgacgtaaaagccaggggacagtgagggggacgggcagttatgaagcatcattaattctccttagaagtgctgcttttcttctgtcagtgaacactgtgacccattctgcttccaaccttgtggactagtcaaagtagtgagaggaacagagtcctaacgcctgagagttgtaaaatgagtgtcagcatgtggtggctgccttttttttttttttttaacrgatagactttattttctagaagagttttaggtttaaagaaaattgaggtcaggcatggtggttcacgcctgtaatcccagcactttgggaggccaaggcaggcagatcatgaggtcaggagtttgagaccatcttggccaacatggtgaaaccccatctctagcaaaaatataaaaaatgagtcaggcatggtggcgcgcgcctgtagtcccagctactcgggaggctgaggcaggagaatcgcttgaacccgggaggtggaggttgcagatcgtgccactgcactccagcctgggcgacagagcgagactccatctgaaaaaaaaagaaaaagaaaactgagcttatagtacagagcattcccatrtaagagctttataggaacctcccatctccaaaactctaaggttccactattagcaacttggattagtcatactgatatgttattattaaagtccatcactaacattagagtttactctgtatccaatgggtcttatgggttttgataaatgcttaatagtatgcatctactattataagagagctttaaaaaataactttatgaaatcaaaacatacctaagaaagggtacaaatggtaagtgtataatgcagtggattatgtagggaacacacwtgtgtgtaagtatcaccctggtcaaaagcagtcttcatgctacttaactaccaattgctattccatcacactttgtaaaaagtaccactacagtccctagatggttggttttgtctgtgtttcaatctttatataaatggaatcatggattattctttaatctctggcctttttcactcagtcttgtgtttgttagattcatgttgcatatagccttttatttttgttactatagtgtttcattaatatgaatacatttctattttgtttgtttccagtttttgcttactgcacctaatgctgctggcagtgttataattatgcatttctgtttggtacatacctaggaatgaaacttctaggtctcagggcttgcatttattaacccttggtagatgatgccatacgtctttccaaagtgttggttactttaaggatcatgatatactcctatcaccattgtaggagagttccatttgttccattttcttgccaacatgtggtattgagagttgaaaaaattctagccattgtgtatagtattaccaccttatggttttcatttacatttctgatattcataatggatttagcacttaccaaaaattttgccatttaaatatagttgaccattgaataacataggaattaggataactgactcttgtgcagtaaaaaaaatccacatttaacttttgactccgccaaaacttgatcaacaatagcatgctgttcagtggaagccttaacagtaacatwaaacagttgataaacacatattttgtatgttacatgtattatatgctgtattcttagaataagcttgagaaaaggaaattttattaagaaaatcataagggattgggtgyggcggatcacaaggtcaggagttcgagaccagcctggccaacatggtgaaacccygtctctactaaaaatacaaaattagcctggcatggtggtgggaccctgtaatccctgctgctcgggaggctgagacaggagaatcacttgaacccaggaggcagaggttgcagtgagccgagatcgcaccactgcactccagtctgggtgacagagcgagactccatctcaaaaaaaaaccaaaatcataagagaatatatttactattcattaagtggaaatggatcatcataaaggtgtttatcctcatcacatttatcttaactaggcggaggaggagggaagagaaggggttggtcttgctgtctccagggtagcatagacaaaagaaaatccacgtataagtggacccacgcacttcaaagccacgttcaaggatcaactgtagtgtctcatacagtgtttaattaagcttcatgcttattttttattgagttgtctacatttttctttttacgtaattccctatataggctggatatgatctctttgctatgtattgcgaatataatcttctagagagtgactttactttttcacttccttaatggtgttttttgataaacagtggtgattaattttgatgcagtccgttttatggaccttttttcttattgttcattgtgccctgttataggaaccttcccctatcccgagggcataaagatattctcatgtttttttgagatggagtttcgcttttgttgcccaggcttgagtgcggtggtgcgacctcggctcactgcaacctccgcctccctggttcaagggattgtcctacctcagcctcacgagtagctgggattacaggtgtgtgccaccacatccggctaatttttgcatttttagtagagacgggggcttcaccatccatgttggtcaggttggtctcaaacttctgacctcaggtgatctgcccgcctcggcctcccaaagtgctgggatttacaggcgtgggccaccatgcctggcctgtttctggaaactttaaaacgataatctacctgggattgatttgtttgtatatgtctcttgstgtgtaattggataaggcttattttcattcgtggcatatagataaccaattgacctagcttcatgtattgaaaagaacttttttcctaactttgtcataaaacaartgtctatatataaaagtgtgtgtatgtcttcgctattcatgcttgttttgcatttccatggaaagtttataatcaagcttgttaccccaaaaaatcaaaaaatccactgggattgtattgactcttaattactttttctttctttctttyttyttttttttttttttgagacaagagctcattctgctgcccaggctggagtgcaaatggtgcaatctcagctcactgcaacctccacctcccaggctcaagtaatcctcccacctcagccttccaagtagctgggacaacaggtgtgcacacctggctaattttttttttgtatttttgrtagagacaggatttcaccatgttgttcaggctggtcttgaacttctgacctcaagcagtcgcccagctcagcctcccaaagtgctgggattacaggcaagagccactgcgcttgacctaaattttgagattattggcatctttaatgctgtcttcaaatatttgaacatggcatatctttacactcagctgtttgttagagatgtgacacatccttcattttctaagtatttttttaatggtattttaaaagattactgctgataatattcttgcattttgaccttatttttgggcattgtaataaacagtaaaacaaaaagatctctacatagttttggattttctgtataacatctgatactcagttttgtgttttcctctctgcttatactcctaatatttttttctttataccagctaggatctccagtaaaatgattaatggagggatagtggcatcttccatgttactatttaattgttttagctaccatttatcaaaagaagtttccatctttataattttttaaatatgtaggtatttggggtttttttttgttttttgttttttgttttgagacgggctctcgctctgtcgccaggctggagtgtagtggcgcaatctcagctcattgcaacctccacctcctgggttcaagtgattctcctgcctcagcctcctgagtagctgggactacaggtgcccgccaccacacccagctaatttttttttttttttttttttgtatatttagtagaggccggggtttcaccgtgttggccaggatggtctccatctcctgacctcgtgatacccctgcctcagcctcccaaagtgctgcgattacaggattacaggtgtgaggcactgtgcccggcagtatttgattttgtcagaaattcttatcttagatttttgaaatgatctcatgatttttttttttttttttgaaacggagtctagctctgtcacccaggctggagtgcagtggcgccatctgggctcactgcaagctccgcctaccgggttctcaccattctcctgcctcagccttctgagtagctgggactacaggcacctgccaccacacctggctaattttttgtatttttagtagagacggggtttcactgtgttagccaggatggtctcgatctcctgacctcatgatccgcccaccttggcctcccaaaatgctgggattacaggcgtgagccactgcacctggccccacagtacttctgacaccagatgtgtgggaattttttcccaactgaccaattctctccacataccaactgggtggcttgtgatttgattcagttctgacactgtctacctgatgttaccatcagaacccacaagttaaagggctcagtcctacaagactgcccccacttgaagctagtcacaagtccaggtttgtacttctgaccaactggctataaagcaaacaaggtatgctttctctgaggtcactaccttcccagcacttcagtgtgttctgttcaccagcccagaagctcggctcatcacatctcaatgttcaagagttttgttttttaaaaaaaacagccttactctgtcacccaggctggagtggagtggtgccaccatggctcactgcagcctcaacccccaggctcagatgatcctccctacactgccttctgttttctgagtaggtggctgggactacgggcatgcaccaccatgacggggtaatttttttttttttttaattttcagtagagacagggtttcactatgtttcccaggctggtcttgaactcctgggctcaagagatcttcctgcctcagcctcacagactgctgggattacaggcatgagccaccacacccagccaagactttttatagagtccaatctccagctccccccaccactttatggaggtcagtggttagaactaaaagttccaaccgtctaatacttggttttcctggtgaccaccagctgtatcctgatggtatctaggggcccccactttaagtcaccttagtagcatagactcaggtatgtgcatacagagttcattatgaataacaaaagatatttatgaattagtgtttgcttatgccagaaattttcttttccttttttttttttttttttttgaaacagagtcttcactctgtcacccagactagagtgcagtggtgtgatcttggcttactgtatcctccacctcccaggttcaagtgattcttgtgcatcagcctcctgagtagctgggattacaggtgtgcaccaccacaccccgctaatttttgtatttttagtaaagatggggtttggcatgttagccaggctggtctcaaactcttggcctcaggtgatccacctgcctctgcctcccaaagtgctaggattacaggcatgagccaccgcacccggccttatgccagaaatttactgagttcattaaggtaaccttgaatagccctggggagtttagactttgcgaatgaacaatgagaatgtttttaaccatatgtttgaacttccctttttttttaaattctcatttttattgtcatgttagcttttttaaaaaatgcagttagcatggattacttagaagaaagtctgttaaaaataagtaaaaacagaaggtgattggcatttaaatgtaacaaaaagctagctgtcattgtgtggaatgaatttctgttaaacacgttagaaatttcattgacacttgccttatttattgttgtatcctctattgctcctcttcttcccaaattaaagatgaggctgctctgaagattcagtaattaggatggacagtcagctactaattttcttagatattctatctaggcaaaacagcattttaataaaatatctttatttcttacagattcctgacattcagacaactgacttgtaactgacttataactgacttgtaatacactgctactatatcaaaccgacaatgaattggaatgaaaaaccaaagagtgctacattaccaccactgtatcctaaaagccagccaccttttttgcaccagtctttaataaaccaaattaccacaacatctcagagttctttcagctatcctggaagtaaccaagaagcatgcatgtatcccggtaattcaaatccartttcacagccactgctgaatatccaaaattatcctcaacaaatttctgtttctgataygcataatgggacagttgtggcctcacacacttcagtagaaagaataacatatgcaaatgttaatggacccaaacaactaactcamaatttgcagatgtcttcargagttacccaaaaygtatggttgaactcaccaatgaggaatcctgtgcattctcatataggggcaactgtatctcatcaaactgattttggagctaacgtacccaatatgccggcactacagagtcaactgataacatcagatacctattctatgcaaatgcagatgatcccttctaattctacacgacttcctgtagcttaccaaggaaatcagggacttaaccagtctttttcagagcaacaggttgattggacacaacagtgtrtatctaagggactgacttacccagattacagaccacctccaaagctataccgttactcaccacaaagctttttaccagattctaccattcaaaaacaaaactttataccacatacatcattgcaagttaaaaatagtcagcttcyaaattctgtattaactttaccatcaaggcagacctcagctgtaccatcacagcagtatgccacgcaaactgacaaaagaccwcctcctcctccttacaactgtagatatggaagccagcctttgcaaagtactcagcatattactaaacacttgtctatggaagttcctcagagtcragaaatgctgtcatctgaaataaggaccagctttcaacagcagtggcaaaaccctaatgaaaatgtcagcacaattggaaatttcactaacttgaaagtaaataccaacarcaaacagccttttaacrgwcccattagatcttctgtggatggtgttcagactcttgctcaaactaatgaagagaaaataatggattcttgcaatccaacttcaaatcaagtactggacacaagtgttgcaaaagaaaagctagtaagggatattaaaacattagtagagataaaacagaagttttcagaacttgcaaggaaaattaaaatcaataaagatcttttgatggcagcaggttgtattaaaatgactaatactwcttatagtgaaccagctcagaattctaaattgtctctaaaacaaactgccaaaatccagtctggaccccagataactccagtaatgccagagaatgcagagagacaaacaccaacagtagtggaatctgcagaaacaaataagactcaatgtatgttgaattctgacattcaggaagtcaattgcagaaggtttaaccaagttgattctgttttaccaaatcctgtctattctgaaaagcggccaatgccagacycatctcatgatgtgaaagttctcacttcaaagacatcagctgttgagatgacccaggcagtattgaatactcagctttcatcagaaaatgttaccaaagttgagcaaaattcaccagcagtttgtgaaacaatttctgttcccaagtccwtgtccactgaggaatataaatcaaaaattcaaaatgaaaataygctacttctygctttgctttcacaggcacgtaagactcagaagacagtattaaaagatgctaatcaaactattcaggattctaaaccagacagttgtgaaatgaatccaaatacccaaatgactggtaaccaactgaatttgaagaacatggaaactccaagtacttctaatgtaagtggcagggttttggacarcwmcttttgcagtggacaagaatcctcaacaaaaggaatgcctgctaaaagtgacagtagctgttccatggaagtgctagcaacctgtctttccctgtggaaaaagcarccttcagatactgcaaaagaaaaggagtgtgataaactcagaacaaacacaacagcagttggaatttcaaagcctgctaacatccrcgttaagagtccttgttcagttgtgggaaattcaaattctcagaataaaataagtaatccctcacagcagacagctttgtcgatggtaatgcacaattatgagtcttcaggtataaatataacaaagggaacagaacttcagatagctgtagtgtcaccgttagttctgtcagaggtcaaaacattgtctgtcaaaggaataacacctgcagtgttacctgaaacartgtatcccgttattaaagaaggcagtgtttgtagtttacaaaatcaattggcagaaaatgcaaaggcarctgctgctttgaaagttgatgttagtggaccagtagcaagtacagcaacatcaaccaagatttttccactaactcagaaggaaaagcagaatgagtcaactaatggtaattcagaagtcacacctaatgtcaatcaaggaaagcataacaaattagagtcagctatccattctcctatgaacgatcagcaaatctcacaggagtcaaggaatagtactgttgtgagtagtgatacrttacagattgacaatatttgttctctggttgaaggtgatacctcttacaattcccaaatagcaaagatattcagctctcttcccttgaaaatggttgagccacagaaaccttctctacccaatcagcaagggattggcwgcagagaaccagaaaaacaattagataataccactgaaaataaagactttggttytcaaaaagataaacctgtacagtgcacagatgtttcacataaaatatgtgatcagtcaaagtcagagccacccttagagtcatcttttaacaatcttgaaacaaacagagttattctagagaaaagtagtttggagcatgccactgaaaaaagcacagctaacgatamgtgctcgtcagctgctattcaggaggatatttaccctcaggaaatagatgcatccagcaactatactccccaagatcctgcaagaaatgaaatccacagtgataaggcacctgtcttatacctacatgaccagctgtcagaacttctaaaagagtttccttatggcattgaggctgtgaatacacgtgaaggttctgtgggccagcaaactacataccagacctcagaagatcaaactgctgataaaaccagttctgactccaaagacccagcagatcaaatacaaattacaatattaagctcagagcaaatgaaagaaatatttcctgaacaggatgatcaaccctatgtagtagacaagttggcagaacctcagaaagaagagcccatcacagaagtagttagccagtgtgacctgcaggcacctgcagctggacaaagtcgtgattctgtgatactggactctgagaaagatgatatccactgctgtgcattgggctggctctccatggtttacgaaggagtaccycagtgtcagtgtaattccatcaagaactcatcttcagaggaagagaaacaaaaagagcagtgttstcctttggataccaacagttgtaaacaaggagagagaacttctgatagagatrtcactgttgttcaatttaagagccttgtaaataatccaaagactcctccagatgggaaaagtcattttcctgaactacaagacgacagtagaaaagatacacccaaaacaaaacataaaagcttaccaaggacagaacaagaattagttgctggtcagttttcatctaaatgtgataaactaaatcccttgcaaaatcacaaaagaaaaaaattgaggtttcacgaggtaacctttcactccagtaataaaatgacagcatcttatgaacaagcttctcaggaaacscgacagaagaaacatgtaacacagaactcacgtccactaaaaacaaaarcagcttttttgccaaataaagatgtgtataagaagcatagttctttgggacagtcattatcaccagaaaagataaaattgaaactcaaatcagttagcttcaaacaaaaacgaaagttagaccaagggaacgtattagatatggaagtaaagaaaaagaaacatgataaacaagaacagaaaggaagtgtgggagctacattcaaattaggtgactctttgtcaaacccaaacgaaagagccattgttaaagaaaagatggtatcaaatactaagtctgtagacacgaaagcgagttcatctaaatttagtagaattctaactcctaaggagtatttacaaaggcagaagcataaagaagctctgagtaataaagcatcgaagaaaatctgtgtgaaaaacgtgccatgtgattctgaacataygagaccaagtaaacttgccgtgcaggttgaaagttgtgggaaatcaaatgagaaacacagcagcggcgtgcagacctctaaagartcattaaatggcttgacaagccatggtaaaaacctcaaaatccaccattctcaggagtctaaaacatacaacattctaaggaatgttaaagaaaaagttggtgggaagcagcctgataaaatatggattgataagactaaattagacaaattaaccaatataagcaacgaagctcaattcagccaaatgcctccccaagtaaaggatcaaaagaaattatatctgaatagagttgggtttaaatgcactgaacgtgaaagcatttctctcaccaaattagaaagttcacccaggaagcttcataaagataagagrcaggaaaataaacatmagacctttttaccggtgaaaggtaacacagaaaaatcaaacatgctggagtttaaattatgtccagatatcttactaaagaatacaaactctgtggaagaacggaaggatgtaaagcctcatcctaggaaggagcaagcccctctgcaaggtccagtatgattttcttggtggtgtctacaayattgtaaagagtcgtaggtcaatatttgggctagcacctctcatgctgtctgggctgctgggaaagactttaatgtgttatgccactacctagtatttgttttgcctggtaaaccartgtttcattgggcaatatttgttttgtgttcattgccaccttattgtaaattgtagaaaattggtcgtcatgacgagctatatgtaaaacttgccagatagaaatatttcagttagtaccaagaaggctgtactgtgaaaaacattccacattccttgtgggaatgtcagaaaagtgtcaagtagctagtaatgtaagagtcttggttttgttaattctcctttggacttgtaatttgaaagccctgtgaacttgaaattttgttctgaatgttagaggataagtaatgatgaatactgaagtctttttgttcatatggaaatgggtcaactaattgtcctctttgaaacagttgatggctgtgttatcactatagttaaaatggtaacatctagcctactcataagatagaagaaccttgaaagcagtattgtccagtgttataatttaaaatctttaaagccaagctggcagctatgaatattaggtagcttaatggtagacttctcaatgtagtgcaggaaggaaggagaaaattgataactagttgttcatggtactaagggaacatttagacatagtggatattatatgtaaagcattgtgctgagaaagattggaaaactaaaggatttgaatggaaattgaagtctttgctctgcttttctgactatatttgttggggttcataaaacaatagcataaacaggatatgttttcctggaaaagaagatagggatatattcattttgtaaaaaattggtgatttcaataggttctttcatttggatccttggaacttgaggtggggatataatgggaacattggaagtgggtgggggcaatgtagttttctatctcatgtgtcctttaatatctggagatgtattaacctcttcagttcatgtgaggggaacataattacrtagtaaagataaactcattttttaattgaggtaagcatttcaaatagaaatcatttttccagtcctttttttagagttgtgttacatgtggttatatctagggcctttcaaaatctattttcagcttacrtgattttcctttgttatagtactaaaggagatgattagcaatatctagagttctgaaaatgaatatttaaatagtttcaggaataaaaagtacaaaagaagactggttaaaatttgttgctacaaagaaaaggacacagaaagacagccaagagagaggtaaagtcatctttttaaatcttcattcacttatctccctatctggtatatggaaattggattatggttatgatatgattgtaaagtatgattttatccatgttcttttttttttttcagtcattcagtgtttgtgtttgagtggtaggaggacatttttgtgttgtcgtgctgtggaatgaaaggctgagctttattttattttaataggaaaataagtcttatcacaatgagttagctaagaggtttgcatattttacctgtataggaccagacagcaaatactttaggttttctgggtcataaggtgtctgtcctgactactcagctctgactctgtttcagggaaatggctgcagataatatgtagatgagtatcagctgtgttctgattaactatttatttatttatttatttatttattttgagacagagtctcactctgtcacccaggctggagtgcagtggcgtcatcttggctcactgcaacctctgcctcccaggttcaagcgattttctccctcagcttcccaagtagctgggactgcaggtgcataccaccacgcccagctaatttttgtatttttagtagaggcagggtttcaccgtgttggccaggccggtcccaaactcctgacatcrggtaatccacctgcctcggcctcccaaagtgctgggattacagacatgagacaccgtgcctggcctctaattaaactttatctaccaaaataggcagcaggctggacttagtttgccagaccctggattcaattatttacatgttaatttgattaatcttcaatacaatttaggcaaggatatttccattttatagatgagaggttacatcatttgacttaagtttcattgctagtgactgaatagggacttgaatctggtcccctcttttcaaagtccattaagtgtggttgaggtatagtcagccctccgtatctgcgtgttccgtatctgtggattcaagcaactgtggatccaaaatatttgggaaaaaaattaatacaaccataaaaatagaaacttaaaagacaatatagtataacaactgtttacatagcatttacattgtattaggtattaaaagtaatctagaaattatttaaggtatgtgtggggggtatgctttaggttatataaaatatactatgccattttacataaggaacttaagcatccccagattttggtatctatttgggtggatgctgcagaggtgtcctggaatcagtccctcttcaatacccagggatgactgtattttaataatgagaccggtcctagctgtgttatttgctgggaagggatttgggctgaggaccaactagaaaaagtagagctttgagtatttgatttttttttgagacggcatcttgctctgtctcccaggctggagtacagtggcacgatctcggccttgctgcaacctctgcattccaggttcaagcaattcttctgcctcagcctcctgagtagctgggactacaagcacactaccacgcctggcttatttttgtatttttagtagagactggatttctctcactrtgttggccaggctggtctcaaactcctgaactcaggtgatccacctgcctcggcctcccaaaatgctgggattacaagcatgagccaccgtgtccacccgaatatatgatttaattagtggagtgaaagtaccttgttgttagggtttggctttgaaaactaaaagctagagctcaagagtttttgtcttagttttggttcattaaatgggcaaagagggggctgggcacggtggctcacacctgtaatctcagcactttgggaggccgaggcaggcggatcatgaggtcaggagattgagaccatcctggctaacacggtgaaaccctgtctctactgaaaatataaaaaataagccgagtgtggtggcgggcacctgtagtcccagctacttgggaggctgaggcaagagaatggcatgaacccaggaggcggagcttgccatgagccaatatgtcgccactgcactccagcctgggtgacagagagagagtcttgtctcaaaaaaaaaaaaaaaaaaaataggcaaagaggggttcagagcctcaaaaatggagagcagcagaaactcaccaagagaaacaataagaagcacattttataaaaggaattgacaacggttgtgaagagagcttcaaacaaatacttagaagcaggcgtgtaaaaattgagtagaggccgggcgaggtggctcacgcctgtaataccagcactttgggaggccgaggcaggcagatcgcctgaggtcagaggttcgagaccagcctggccaacattatgaaaccccatgcctactaaaaatataaaaattagtcaggtgtagtggcacatgcctgtaataccagctattcagtaggctgagacgggagaatcacttgaacctgtgaggcggaggttccagtgagctgagatcggaccactgcactccagcttgggcgacagagcaaaactctgtctcaaaaaaaaagtcagttagcattgaaacatgcatatgggaaaaacttgcatcaatgaagaaatatactcttaatcagaacaggacaaataacctaaagaggagggaatgaagagcagtgagaggcctgacagtgggaaaacaatgcctctcgggttggaaggcagaaagccaaaaatgcgaaagatacaaatgggtacgaagattggagtaagaaraaagctccttggaaacaggagagacatgattatctcaaagagaaagcgagaggcatgtttggaatctgaagctgaaaacactcaaaagacagatacacagattgaccagaggcttcagagataggcatgagttgaatgacatgtgcagacagcacagcaggatgagcamtgcacggtgaatgtgaggctgaaatactcagaatcatgatgaaagaaaaacacaaaccaggtacactaaggcaaagctgggtgagacagtccaggagacaagtcatayagctttgtcatggcacaacaagacgcaaataggtgagacctaagggaggagaaaaaaatctcaggtgatggctacatgggcatttttatttacttatttttatttatttatttattttattttttagacagtctcgctgtgtcgcccaggctggagtgcagtggtgcgacctaggctcactgcaacctctggttcctgggttcaagcgattctcctgcctcggcctcagcctcctgagtagcgtgaaccacctcacctggctgattgttgtatttttagcagagacagagtttcaccatgttgtccaggctgatcttgaactccaacctcagtgatccacccacctcagcctgccaaagtgctgggattacaggygtgagccactgcgcccggccacatgggcattttttaaatgcctattaggggcgagtgaagctggttctggagaagggatctctgggaaatagtgaattatataccttagacaaagaggctggagaacagtgaaccaacyatgaagtgagagaaaaatgccatgaactcccaatctgctataaagaaacatacatctggcctggtgtggggcccatgtgtgtcatcccagcacttgggaggtcaaggccggaggatggcttgagcccaggagtttgagaccagcttcggcaacatcaggagatcccatctctacaaataactttttaaaaaattagctgggcatagtggtgcgcacctgtggtcccagctgcttggcagactgaggaaggaggatcacctgagcccaggagttgaggctgcaataagccctgatgcagcactgcactccagcctgggcaacagagccaagaccctgtctcaaaaaaaaaaaaaacccacaggagaaacagatgtctaaattcagtagcaaaggttgcagcaaacttgaagtcctaagttagggtaaagagatgaagaggaaatgacaagaatttcttggaaagcaacttagagacccatctggggcttcagtgttactaattctgaaagaaagcaarcgaaaaagtggaagactgcagcagatctaaagaactaacaggacagaatactccacccattcaggtagaaaaagacaaaacaagaccccattattcagaagaaaatagctgcagcaggaatgaaatgtacagatagtccctgacttggcagtggtttracttaggatttcttgactatgatggtatgaaagtgatacacattcagtagaaagtgtatttcgcatacccatacagcaattctgtttgtttgtttgtttgtttgttttttgagacagtctcgctctgtcacccaggctggagtgcagtcgtgtgatatcggctcactgcaacctctgcccagctaatttttgtatttttagtcaaaacagggtttcgccatgttggccaggctggtcttgaactggcttcatgtgatctgcctgccttggcctcccagagtgctgggattacaggcgtgaaccaccatacccagcctcaacatattttcaataggtgatgggtcattatgaaaaaaggacactgaagctaatgtaacactgaaatggtctmaagaaacaggaaactatagacatgttttagaatatccaatacatggcaagaccaaaatatgaaacctatccttttcatgtattgtttgggactgactcatatttgtactctttgtattgctaatttacatagctgtttaaaagrtcacattcatactaatgatatgcaatgatacattttattgagccaagagtaaggtagaacagaacagcccagggcaatgaggatggggcaaggaggcaggagtagaaaacagcccccaaaagaarggcaagatgtcacgtgtatataacttacaattctataagtgaagagctatggttctgaaacttttgcttaactccttgccttaattttttatccctccaatatatattttccctctgaattttgattatatattgatcacagctaacattgagaaataaagtaagtaaagtttttatttcccttagataatgttaattcaagactctcgaagagaagcttcagtgcagatggatttgagatgctacaaaacccagtaaaagattcaaaagaaatgtttcaaacctacaaacagatgtacctggagaagagaagcagaagccttggtagcagtcctgtaaaataattacaagatgtggttttgtaattgccactgggaaatttctttccttttctgttcaaaatatttcgctgaaactaatgagaaatgccatgataaagatttctcagagtttggttcycactttcattgtatttcattgaaagtgcttaattaaaatggcttgagaactttgggtagccatgtgtaagaratggatggtattcacmggggaaacaaggtatttgaatttctactttattgaaccagatttaccattattttaaaaggaatgcttatacaaatcaatttgaaattctacccatcttgagggaggaccgttcctcagttaaggacttgtttatttaaatgggactgtaaatatgttttggtttctaagctatattagcaaaatttatttttcaaaaatgcccactgtgatgtsaatgtcaaaatatattcttaagtgttttataactaattgtaaactttttttcagaagtcttattttatacttgtgaaactgaacacaattttgggacaacgtttaaacattacttttcatacttgaaataaacatttattttttaaaaaactaatttgaaaccttcacagctcagtttctttttggtttcctacctttaaaaggacgcattttggaaagtgctttcaaaagctgaaatgcgaggtggcttatgcctgtaatcacagcaccttgggaggctgaggcgggcggatcacaaggtcaggagatggagaccatcctggctaacacggtgaaacgccgtctctacttaaaaaaaaatacaaaaaattaccaggacaaggtgggaggcacctgtagtcccagctactcgggaggctgaggcaggagaatggcgtgaacccgggaggcagagcttgcagtgcgccgagatcgcgccactgcactccagcctgggcgacagagccagactccttctcaaaaaaaaaaaaaaaaaaaagctgaaatgtcacagcagttgtgccagtaggtatttttagattgcgttcacatgagaacacaaaaaaatttactaggttcaggaaatttcaagaaactggaaggcaagatataactttatttctagttttactttatgactacgagaaaagggttggagtttttgttttgagacagggtctcactctgtcgtcaaggctggagtactgcggtgtaggatgaatgttcactgcaatcactgctcctgggtttaaataatcttcccgtctctgcctcatgagtagctgggactacagtgtgctaatacacctggctaatttaaaaaaaaattatttaatttgctaatctttgtattctagtgtgctgccaaagtgagcacataattttgtttttttgtttgtttgtttttgtttcttaatgtttggagaatttttgtggtttttttgtttgttctttgagacgtactcccgccctgttaccctggctggagtgcaattgcgcgatctgggctcactgcaacctccgcctcccgggttcaagcgattctcctgcctcagcctccagagtagctgggattacaggcgcccgccaccacgcccagctaatttttgtatttttagtatagatggggtttcaccgtgttggtcaggctggtctcgaactcctgacctcaggtgatccgcccaccccagcttcccaaagtgctgggattacaagcatgagctactgggtccagcctgtttgtttttttttgagacggaggcttgctctgtcgccaaggctggagtgcagtgacgccatcttggctcattgcaacctccgcctcccgggttcaaggattctcctgccgaatagctggaatcacaggtgcccgccaccacgcccagctaatttttgtatttttagtagagacggggtttcaccatgttggtcgtcaggatggtcttgaactcctgacctcgtgatctgcctgcctcagcctcccaaagtgctgggattacaggcgtgagccatcttgcccaaccctgagcacataatttaaaaatacatacatttttggagacatgagattctaccctgttgtccagactggtcttgaactcctgggctcaagtaatcctttggccttggcctcccaaagtcctgggattacagatgtgagctaccacgcccagagcatgttggttatttttataaaatcttaatgttgtatatatatatataaaattttcatttgaaaactatgtacaaggtagaccaatggattttaatgaaacattgcaatttcttgtgcttttagctttcatattacaaccaacctttaggaaacaactacggtcctctgtcatttaatgacagggatatgttctgagaaatacatctctaggtgatttttttttttttttttaaatggagtctcattcttttgcccaggctggagtgcagtagcacgatctccactcactgcaacttccgcctcctgggctccagcaattttgcttcagcctcccgagtagctgggattacaggcacacaccaccatgccttgctaaagtatttttagtagagacagagtttcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttaaatagtaaaaatctataaatattgtcatgccaaaataaaagattgattcacctcaggtgatctgcctgccttggcctcccaaagtgctgggattacaggtatgagccactgcacctggccaattttggtcttgtgtgactatcctagaatgtactaggtttgtgtaaacctagatggtacaggttgaatatcctaaatctaaaatccagagctgggcacagtggctcatgcccgtaaaccccagcactttgggaggccaaggcgggcagaccacctgaggtcaggagttccaagaccagcctgaccaacatggtgaaaccccatctctactaaaaatacacaattagcatggtgtggtggcagatccctgtaatcccagctacttaggaggttgacgcaagagaattggttgaaccccggaggcggaggttgcagcgagtcgagatcacgccattgcactccagcctgggcaacacaagcaaaactctgtctcaaaaaaagaataaaatccaaaatgttccaaaatctgaaactttgaatgccaatgtgatactcaaaggaaatactcatttgagcattttggattttgcatccttggattaaggatgcttaggtggtgagtataatgcaaatattccaagatccaaaaatatctgaaatattttcagtcccaagtatctctaataaggtgtagtcaacctagatgtcctactgcatacctaatcactatggtgtatcttattgcttataggctacaaatgtggacatcatgttactgtactgaatgctgtaggaaattataacaatagttaagtatttgggtcttcaagcatagaaaagctactgtaaaaatgcagtataaaaaaaaatgatgccgggcacagtggctcacacctgtaaacccagcactttggtaggccaaggcgggtggatcacctgaggtcaggaattcgagaccagcctggccaatatggtgaaacctctgctctcctaaaaatacaaaaattagctgggtgtgttggcgcatgcctgtaatcccagctacttgggaggctgaggcaggagaatcacttgagcctgggaggtggaggttgcagtgagctgacgttgtgccactgcactccaggttgggctacatgaacaaaactccatcttaatgaatgaatgatgtacctgtattgggcacttaatatgaaccatgaatagcgcttgcaggactggaagttgcttgcaagtcagtgaattggtctgagcaagtgaatgtgaaggcctaagacattactgtatactactatcaactttatgaacactgtacacttaggcgaccctaaatttatttttattttttactgcaaaacggggtctctgttacccaggttgaaatgcagtgctgtagtctcagcttgctgaaacctccgcctccctgtttcaagcagtcctcccacatcagcctccagggtagctgggaacacaggcacgatccagcatgtccagctaatttttagtaactaaatttattctttaaaacttaaatagaacttagcttatggtaactatattaactttttaaacttttaacttaattttaattttggttttggttgtttttttgttttttttagacggagttttgctctgcctcccatacaggctggagtgccgtggcacaatcttagctcactgcaacctctgcctcccaggctcaagctattctcctgcctcagcctcccaagtagctgcgattaacaggtatgtgccaccacgcccagctaatttttgtattttaactaaagatagtttcaccatgttggccaagctggtctcgaactcctgacctcaggtgatccacctatctcagcctcccaaagtgctgggattacaggcatgggccactgcatcaggccattaattgtaattttttttattcatttcaagacagggttaagaaactgctaattttgtatttctggtagagacagggttttgccatgtttcccaaaacagtctcaaactcatgggctgaagcaatcctcccgcctgggcctcccataataaagtgctgggattacaggtgttagccactgtgcccagccgccaaatttttagctttttaactcgtaataacatggcttaaaacacaagcacactgtagagctgtacaaactttttttttgagacagagccttgctctgtcacctaggcttgagtgtactggcgtgatcttggctcactgcaacctccacctcctgggttcaagtgattctcctgtctcagcctcctgagtagctggtattacaggcatctgccaccacgcccaggtaatttttgtatttttagtagagatggggtttcaccgtgttggccaggctggtctcgaactcctgatctcaggtggtctgcccgcctcggcctcctagtgctgggattacaggtgtgagccaccacacccagccttttcaaaattttctttatactttttgtataagctcttttttattaaatttttttttaactttttttcaaattgaaaactaaaagatgggcacagtggctcaccaaggtcaggagatgactggacacagtgcctcatgcctgtaatcccagcactttggtgggccaaggtgagcagtattgcttgagtccaagagttcaagaccagtacaacatgctgaaacccggtctctaccaaaagtacaaaaattagccaggtttggtggtgtgcacctgtaatgccagctacttgggaggctgaggtgggaggattacttcagccctgtctccaccccgcccccccaaccaaaaaaaaaaaaaacagaaccaggaaaacattaaccttggcttccacgtagtcaggatcatcagtatcacttgtcttcctcctctacatcttgccccattggaaggtcaccaagggcagtaacacgcatggagctgtcatctcctgtgataacagtgccttctggaacacctgaaggacctggctgaggctgttttatagtttttgttttgttttgtttttgagacggagccccgctttgtcgcacaggctggagtgcagtggcgcagtcttggcttgccgcaacctatgcctcccaggttcaggcaattctcctgcttcagcctcccgagtagctgggacaacaggtgtgagccaccgcacccaagcctattttttaatttatttaaatttaaaaatattttttagttttttaaaaagtaggaagctgggcacagtggctcacgcctgtaatcccaacactttgagaggccgaggcaggcgaatcacgaggtcaggagattgagaccattctggccaacatggtgaaaccccatctctactaaaagtacaaaaaattagctgggcatggtggtgtatgcctgtagtcccagctactcgggaggctgaggtagaaggatcacttgaacccaggaggcggaggttgcagcgagctatcacaccactacactccagcctggcgacagagtgagacttcgtctaaaaaaaaaataagtaggaataaattaacgtacataaaaagcataacatactaaacacaaaccagtaacagtcatttatcattgtcaagtattatgtactgtatatatttttaagtcagatttgtaaaaatataaaactgccaatcttttctcattctcctggtaagtatttttcataaacatttatttggctgggtgcagtggctcacgcctgtaatcccaacactttgggaggccgagctgggtggatcacctaaggtcagaggtttgagactagcctggccaaaatggtgaaaccctgtccctactaaaaatacaaacattggtgggctcggtggctcatgcctgtaatcccagcactttgggaggccaaggctggtgaatcacgaggtcaggagttcgagaccagcctggccaacat

SEQ ID NO: 17830 - DNA, 12319 bp, Homo sapiens
aaattaaccaagcgtggtggtgggcatctgtaatcccagctactcgggaggctgaggcaggagaatctcttgaaatcagaaggcggaggttgcagtgagccgagatcatgccactacactccagcctgggcaacaagagcaaaactctgtctcaaaaaaaaaaaaaaaaaaaaagattacttaaaatttacttggaaacttaaaagtgcaccattaagtaactcctgggaccaagcagatgtcatgagaaaaattaagaaatatttgccacttcatcagttataagacaaaaaaaaattttttttaaattttaagacatacttaaattgagtgataatgaatgatatggttgggtctgtgtccctgcccaaatctcatgacaaattgtaatccccaatgttggaggcggggtctggtgggaaatgattggatcttgtacgcaaatttcccctttggtgctgttctcgtgatagtgagtggattatcaggagatctggttgtttaaaagtgtgtagcacctccccactctctctattcctcgtgctctggccctgtaagacgtgccttcttctcttttgtctttcaccatgattgaaagtttcctgaggcctccccagcatgcttcctgtacagcctgtggaaccgtgagccaattaagcctcttttatttaaaaattacccagtttccggtggcacacacctgtaatcccagaactttgggaagctgaggtgggtggatcacctgaggtcaggagttcaaggccagcctgaccaacatggaaaaaccccgtctctactaaaaatacaaaattagccaggcatagtggcgcatgcctgtaatcccagctacttgggatgctgaggcaggagaattgtttgaactctggaggcagaggttgtggtgagccaagatcgtgccactgcactccagcctggtcaacaagagcaaaactccgtttcaaaaaaaaaaaaaaagaaaaattacccagtttcaggtatttctttatagtagtgcaagaatggactaatacaatgaaaacaccaaacatcaggctgggtgtggtggctcatgcttgcaatctcagcactttgggagcctgaggtgggaggatcacttgaggccaggagttcaagaccagcctgggcaatatagtgagacccaattgctacaaaaaaatttaaaattagctgggtgtggtggcaagcacttgtattctcagctacttgggaggttgaggcaggcaggaggagcacttgagcccatgaatttgagattgcagtgagtatgatagtaccactgcactccagcctgggcaacacagcaagaccctgtctcaaaaaaaagacagttctaaaaaatgaacataaggtataaacaccaacattcaacatgtacacacacacacacacacacacacacacacacacacacacatgcagttggccctctgtatttgtgggttccacatctggggattcaaccaaccacagataaaaaatatttggaaactaaaaattccaccctgcgcttctggacctcagcaccagccccagggctgctctaggggccacatggctgaagggagcgcaaggagctaccagaggcagaatgaagagactgaagcaatgacagccacttattttgaggaattacgtgtcattgatgactatgccaaaacattttgtattagaattagtgatgatattgattaccccaaatggacactttgctcataggtgatgctactgaattaatatacaggtacagctccacctacttattagtaggtaagactcttggcttaaaggacaagaatgtgcagatttatcaaatgggcttgagaaaatacaattcagaatattggtgaaagtattctttacctgtgggtggagaaaataagagatgctcggccacgcgcagtggctcatgcctgtaatcccagcactttgggaggccgaggtggacggatcacgaggtcaggagatagagaccatcctggataagatggtgaaaccccatctctactaaaaatacaaaaaattagccaggcgtggtggcacgcacttgtaatcccagctactcaggaggctgaggcaggagaatcgcttgaacccgggaggcagaagttgcagtgagcagagatcgagccgctgcactccagcctgggcaacagagggagaaaaaaaaaaaaaaaacaactctaggggaatggaaatacctgatttccattccatttcattgagacactcacactgttaaaggaatattgccttttttttcttttttcttttttgattatataaatagagatgcgtctcactatgttgcccaggctggtcttaaatactgggactcaagtgatcctcccacctcagcctcacaaagtgttgggattacaggcatgagcctttgtgcctgacccattttttgttttgttttgttttgagacagaatcttgctctgttacctaggctggagtgtagtggcgcgatctcagctcactgcaacctctgcctcctgggttcaagcaattctcctgcctcagcctcccaggtagctgggactacagatgcctgccaccacatctggttaattttttgtatttttagtagagatggcatttcaccattttgcccaggctggtcttgaactcctgacctcaggtggtccacctgcctccagcctcccaaagcactgagattacaggcatgagccaccgtgcctggccctgtctggcctttttactgctttttatggcttattgaaatagcttgtattagtcctttctcatactactataagaacacatccaagactgggtaatttagaaaggaaagaagtttaactgactcacagttcagcatggctgaggaggccttaggaaactgatgatcatggtggaaagggaagcaaacatgttcttcttcacagggcagcaggaaggagaatgagggtcaagtgaagcagcaagctccttataaaactatcaaatctcgtgagaacttactatcacaacaatagcatgggagaaactgccaccatgattcaattacatcccaccgggtcccttacacaacatgtggggactatgagaactaaaattcaagatgagatttgggtgcagccacagccaaaccctataattctgcccctggcccctctcaaatctcctgtcttcacatttcttttttctttttttttttctttttttttttttttgagatagagtatcactctgtcaccaggctggattgcagtggcacaagcttggctcactgcaacctccacctcctgggttctagccattctcctgcctcagcctctgcagtaactgggactacaggcgcatgccaccacacatggctaattattgtatttttagtagagacggggtttcaccatgttggccaggatggtctcgaactcctgacctcaggtgatctgcctgcctcagcctcccgaatgctgggattacaggcatgagccacactgcacctggccgatgataaacctttgaaagctaaaaagcaaagagatgattgcagactaactcagaagaactgagaaagctgaattatgtggcaacagtagagaaaaattgaaaacagaaatgattatattgtagaatcacaaacagacccagatcttctacctgctctcatgctgctggatgactgtttctccctagtttcagcagaagttggagtctgtggactgggaaacatcaagtacagctgagagctttgataccaaacaaaaatggaggtttacacaatcacatgcttgctgattgctaagcccctgcctcctgcctcacagccttcatcaatcatttagtgcccaaaccatgtcagccagatctttaccctctaggaaggggattgtcacacctttctctcaggaatcaaagcagcccaagaggaaagaagagaaactgataagattacccaacaaataaatggccctacagtaaactcagaaatacaagagctctccatatactgcaaacttccaatcagctgtagtccttcattcctcatcgtaagaaaccaaaaattaccagaactctaaagtaagcctctatcatgcaagacaaaaagcacacaagcagggaaagcaccttggagaaacagaatactatgtggatgaaagaaaactaactcatgttcagtcaaagcttctcataaaagaccaggtgccggttgggcgcggtggctccctcactcactttgggaggccgagggaggtgtatcacaaggtcaagagatcgagaccatcctggctaacatggtaaaaccccatctctactgaaaatacaaaaattagctgggcatggtggcggtcgcctgtagtcccagctactcaggaggctgaggcaggagaatcacttgaactcagggggtgcaggttacagtgagccgagagcgccactgcattccagcctgggtgacagagcgagactccatctcaaaaaaataaataaataaaagaccaggcccggtggcttacacctgtaatcctagcactttaggaggctgaggcgggcggatcacttgaggtcaggagtttgagatcagcctggccaacatggtgaaaccccgtcggagtgagactctgtctcaaaaaaaaagaaagtttctcataaaagagcagcaaagaaatctgttatggttaaaacatagaacaaacaaataacaaataacaataactaaggaagcttagtttattagaaatgtgccaggcaagggagatagtgagcaaatggagtcagtcaaatggacgccgagtagctttaacatttgagttttatacagtttcactgaggaggcgttagccaaaggatgcttttagggcggggataacaagagttgggggaggggcaggaaggaagggtagagttagggcaggaaagaattggtcaaaagttgcaaagttgagtcactgactgtgttgataggctaggcaaggctgtctgtgaaaaagtctgtggttttgtttcctgaacacctgggtccaagctgagctgttgctgacatagtttatctgtcttgcaaattgtggtctctgtactgtttttcaagttgtggtttctgtagttttccatttctcagtcttgagaaagataagataagaaaagatactgcattctgaaaacaagaacaagatgttattttgtaaaaagaggaacattcagagaacaagaagaaattttagacgttaaagacatgataagaaatgaacattttaatgaagaattgaaagataaaattgaggaaattacacagaaagcgtggcaaaaagacaaggagataggaaatgagagaaaaaaggtaagaaaatttatgaactctatgaagttcagcagccaaataatagaatttccaggaagagtaaaacagaggggaagaaatcaacaatgaaatagttcaggctgggcgtggtggctcacgcctgaaatcctagcactttgggaggctgaggcgggcggattgcctgagctcaggagttcaagaccagcctgggcaacacagtgaaaccatgtctctactaaaatacaaaaaattagctgggtgtggtggcatgcacctgtagtcgcagctacttgggaggctgaggcagaagaatcgcttgaacccaggaggcggaggttgcagtgagctgagactgggccgctgcactccagcctgggcaacagggtgagactccatctccaaaaaaaaaaaaaaaagaaatagttgaagaaacacactcagaatagaagaaccaaattgaaagtgtccatcataatagatgaaaattgtcctgcactaaagcatatgattgtgaaatgtaaaatatctaggacaaacaggagattctcaggcttccagaaggggtagaagggtggcacaaaagggtggtgggggagtcggaattggattgggtttctcagcagcaacacaggaataagaaaagaaacaaactaaaagaggaaggtgtggctttcttttcctccgggacacagaaggtcgtccttcctacctactggctgccctcgggggcaaccccttgcccagcaccaaggaygtcaagaagatcctgtacaatataagcaataaggccaatggcaaccagtgcagcaagatcatcagtgagctgaatggaaaaaacattaaaggtgtcattgcccagggtattggcaagttgccattgtgctctcccacaaggctgtggccgcctctgctgccccggctctgtagctcctgctgctggccctgcccctactacaaagaagaagaaacatgagaagaaggagtcccaagagtcacatggtgacatatgatttgacttcctgctcccctgccaattcccctggaaagaaagaaagaagggagggagggaaggagggagaggaaggggagtgggggaggggaggggagggaaagggaagggaatagaagaaacaggagagacgcaaagtgatggcgaaggaaaatcacaggatcaaaaacagcaaatgtagaaagcaactgatccggactgggagaggcataactcaaaagacaggcatgttggggatttgttatccaccatttaaaaagataaagccattcttagcccatgggtcatacaaaaacaggctgcaggtcagttttctgaccccgatctagtcaataaaaaagaaacaggatgaactgacactaatttctggaaagaaggaaggaaggaggaaaggaggcaggaaggaaaaaaaagaagaaaggggccaggcgtggtgtctcacccttgtaatcccagcactttgaaaggccaaggcgggttgatcacgtgaggtcaggagtttgagaccagcctgggtaacatggtgaaaccccgtctctactaaaaatacaaaaattagccgggcatggtagtgcacccctgtagtcccaactactcgggaggctgaggcaggaaaaacacttgaacccgggagtcagaggttgcagtgagcctggatggtaccactgcattccagcctgggtgacagcaagactccgtctcaaaaaaaaaaaaaaaaaaaagaagtaagaagtaaggaaagaacaaaggaaggaaggaagcaagaaggaaagaaaaagaaaggaagaaaagaaagaagaaagaaaagaaagaagaaagaaaagaaagagaaagaaagaagaaaagaaaggaaggaaggaaggaaggaggctaggtagaggtgtgaccctggtattgataaagagataggggagtggtcaaaggcatttccctacatcatactgtaaggaaaattcctgggtgagcccacagaaacgacaggttaatccaaattataaactgagtaatctcattgtagagcctttgcataaatccaggatacctagttatccaatagtctccctggccagattgccaaagctttcgctgctctgggtcttcttcctcattgtagtccctgtcatcagggtttccacagcactcaactcattctccaagctttgactgcagtattcttcaggatacatcatcaatcatcttccctctgccttgacatggtgcttggcactgtgacccttgacacaatgttaagtgccttgacatattgctacactccccaaataagacttacttcaagtgaatatacattagatatctgcaggaaaaatgaagaagagcaagacagcaaccatcccttccctttaagaattcccttcaagaacaaggatttttctccatataacaagaatgtgattgcaaattgcttcacaaaaaagtaatctggcagagctgtaatctccactggcctctccaaaaagccacaaataaaatagcctttgatatagacaataaattgtaaatatcagtagaagcttccttagaagctatcttgatgatagacactgacttttttgtttatttttatttatgttatttccattgcattatgtggcaaaatatttcacattaatctaaccatcagtctgctttctatcactatatacaatatttgccttttctaaaattttataaatgtggaatgatatcgtagaatcttcggtgtctggctccttgtatttagcataatgctttttttttttttttttttttgagacaatcctgctaggctggagtgcaccagtgtgatctgggctcgctgcaacctctacctcccaggttcaagcgattctcgtgcctctgcctccagagtagctgggattacaggcgcccaccaccacacctggctaatttttgtattttcggtaaagacagactttcaccatgttggccaggctggtcacaaactcctgacctcaagtgatccaccccactcggcctcccaaggtgctgggattacaggtgtgagtcaccacacccagctgtcttcagcataatgctttcgagattcatacatgttgtgatgtgtattggtaggttttttgtttgtgtgtttctattttgttttggctcacaaacagaaaaatctaaagtagctctttttggtaagtagctttgcattgtatggatgtaaaacagtgtatccattcaccagttggttgtttccagttgggagatacatactatgaaaaaaactccaatgaacagttgcacacaagtctttgtgtggacatgttttcatttcttttggggaagtacgtaacagttggattgctgggtcatgtggtaactctgtctttcacataatcagaaaccaccaaactcttttcaaagtattcataccactgtggtttgtgtccctccaaaactgatgttggaatttaattaccatggcgactctattaagaggtgggaccaggctaggcatggtggctcacgtctgtaatcccagaactttaggaggccagcgcaagaggattgcttgaggacaggagttcaagaccagcctggtcaatgtagtaagaccccatctgtacaaaacatttaaaaattagacagacatggtggcacacacctgtggtcctagctactcaggaggctgaggtgggaggataccttgagctcaggaggtcaaggctgcagtgagccatgatcatgccactgcactccagcctgggcaacagagcaaaatcttgactctaaaaaaaaaaggggaggtgagaattttaagagacagaccttaagccctcatgaatggattaatcttttcatgaattaacagattagtggggttatagtggaagggaataagttatctcaagagcgggtttgtgataaaagccagccttgcactcttcttatcctgtgatgccttcacatgttatgacacagcaagaaggccccctgcagttgtgactccttgtccttgaatccaagcacttgccagtttccagaactttaccaaatacatttcgtctgggtgaggtggctcacaccggtaatcccagcactttgggagaccaaggcgggtggatcacttgaggtcaggagttcaagaccagcctggccaaatggtgaaaccctgtctctactaaaaatacaaaatttagccgggcgtggtggtgcctgtaatcccagctacttgggaggctgaagcaggagaatccctttaatccgggaggtggaggttacagtgaaccgagattgcgcggctgtactccagcctgggtgacagagtgagaccccttcttaaaaaaaaaaaaaaaaaagccagtctctgtggctcacgcctgtaatcccaacactttgggaggccgaggtgggcggatcacgaggtcaggagattgagaccatcctggctaacacagtgaaaccgccgtctctactaaaaatacaaaaaattagctgggtgtggtagcaggtgcctgtagtcccagctactcgggaagctgaggcaggagaatggcgtgaacctgggaggaggagcttgcagtgagccgagatggcgccactgcactccagcctgggcgacagagcgagactctgtctcaaaaaaaaaaaaagaaagaaagaaattttgttttattataatttacccagtctagggtattctatgatagcatcagaaaatggactaaggaacataccattttcattcttaccggcaatgttcctgatgctccaaattctcttccacgcctgatattgttagtctttttaatttgagtcattttagtgggtgtgaagtatagtttttattttcttattattatatttccataagttattgcggtacaggtggtatttgggggggtgtgaagtatatttcctcatggttttaattcacatttccccaatgaccaagtgatgtggagcatcatttcatgttggttttttgccattcacataacttatttggtaaaatgtatgttcacatttctctcttgttgttgatcattcttgccaaattttgtgtagtcttttaaaataactgctttgttccttttactttggatttattttctgtttttctgacttattataaatgattacttactaatataagtcttttaagtttatacatttattttttgtttgtttgtttttgtttttgtttgagaccgagtctcgctctgtcgcccaggctggagtgcagtggggctatctcggctcactgcaacctccgcctcctgggttcaagtgattctcctgcctcagcctcccgagcagctgggattacaggcacctgccaccacaccgagccattttttgcattttttagtagagacagggtttcgccatgttgcctaggctggtctgaaactcctgacctcaggtgatccgccctcctcagcctcccagaatgttgggattacgggcgtgagccactgcgcccggccaagtttatacatttctttctacacactacgtagctgcatcccacagttgtcatctgtaatactttttttttttttttgagacagagtctcgctctgtcgcccaggctggagtgcagtggtgccatctcggctcactgcaagctccgcctcccgggttcacgccattctcctgcctcagcctcccgagtagctgggactacaggcgcccgcccccacgcctagctaattttttgtatttttagtagagacggggtttctccttgttagccagtatggtctcgatctcctgacctcgtgatccgcccgcctcggcctcgcaaagtgctgggattacaggcgtgagccaccgtgcccggccgtcatctgtaatactgtttattacattcaaaatgtttaatttgtgtctttcttatttcctagcacataaaggaaattttttagctttttttattgtttatttgtagcttaatagcattatacataggcataccttattttattgcacttcattttatcatgctttctagattgtatttttgttacaaatcgaaggtttgcggcaaccttgtgttgagcaagtatatcagtgccatttttccaacagcatgtgctcacttttgtgtcgttgtgtcagcattttttactgataaactatttttaaaataaggtatatttttagacataatgccattgcatactaaatagactacattatagtttaaaaataactttatgtactaggaaaccaaaaaaaattgtgtgacttactttactgtgatgtttgttttattgcaatgatctggaactgaacctataatatctctgacatgtgcctatggtcagagaatgtcctcattttaattctgtcaattttcttgagatttgatttacagacaatctgtcttcaattaataaaaattttgcgtgcttaaaaagaatgtgatttttgcagttgttagtatagcgttctatgcttctaccatagtaaatatgtaatcatgtttatcaaatctactcgatgaacattttctgtcaattattaattttcaaatcctccaatatgattgaatataaatttgtctgtttcttcttttttttttttttggagatagagtctcactctgttgccaggctggagtgcagtgacgcaatctcggctcaccacaacctccacctcccaggttcaagtgattctcctgccttaacctcttgagtagctgggattacaggcatccgtcaccatgcccggctaattttgtatttttagtagagatggggtttctccatgttggtcaggctggtctcaaactcccgatctcaggtgatctgcccacctcggcctcccaaattgttgggattacaggcatgagccaccatacccagcttgtttcttcttgtgatgtttttgctttatattttttttaggctatgtttatatgtttacaacctatgtatatatgtttataacctatgaatatatcttaataaacctatgtgcataagtttcagtctatgtacataggtatgtctatgtacatag

SEQ ID NO: 17831 - DNA, 18235 bp, Homo sapiens
tgcaagcctcagcctgattttatgattcgcacacctgctccatgggtatgacctcatccaacccctgtgaggtccctcccatttccaccccaccgcaacggaagaccccttcgcagatgagcacctgacacccagagagctgatgcttctcacaaggggcaccaggaccccgagaaccattctcttgattccacttctgcagcctgggtgaccttcaccagtgacccccgcactcccgtctgctcatgtgttaaatgaatgaatcgtcataatttactatatgctctgagctcctaacacaaactaagtcgttactcctcgaaaaactctacgaggggatcctctgattttaaggataagaaactgagacacagagaagaaaaaactcttaccagggtctcccaaaatagtaagtagtggaacagagatctgcacccatgctgtctggatccagacccagcgccctgaaacagcagcttgtctggttccagaaggaacggaggccgtggtgagactaagttagaagagggccagcacctcatggggaggcccttcgggcaccacgagtccagtcccgctccggaggtgggcagtctgcaggccccctgagaagggggtttgaggggaggctttttcctgctggggaatctcaaagggcttaaaactgcagaccgagaagccgggaccttgcccaggggtgatggggagctgcaagggaaggctgtgagcaggggaggggcggggtgatctccaagtgcagagagaccctctagggccacgtggtgaccgacaggaggctgtcctcccggacaggaggagcgagggtccagagagagaggaggacgtctgagctggagccaggccaaggggacagagaggaggggacggggcagagagaggcaggggccgaagggacaaggctggggaccgatgggctgtaggggataaggggagagatggggcaaggtcagtgccaagggcgtctggccgaataactgggtggtcggtgacgctgcccctgagatgaagaacgtggaagaacagggaaggagggtttggggaaatagagcaatgagttgggactcggtaagtgagaggggcctagggacagtggtgcagggggcgcccaggagcaggtggctgcccaagccggagttcagggtcagatggaggagacctgcgtggttggtggatgaaccacgggagttgatgaaaaactcccagggaacgttctcaggaggaggagccgggcaaaagtgagactcaggccgcggtgggcgggacccaggccgcggtggaggtgaaggacgtccgcggacacgtccaggaggacatcgatcgcgcgagcctgagccagacacagtgggcggggacggggcgccgacgtcaccgcgtgggggcggggctgcgggagccgctggctgcgcgccctccagggagccgagcgcagaccgggtgcgcgcctgggttcggcgcggcgggagcgccctcagtgtccccgtctgtatcaggggtgcttcatcagtacctgcctaggctggttaggaggaggagcacgtgcgatcgtgacgggaagcgctcagcacagacctggcaccgaggaagtcccaggggctcggctcctttccctcgtcaccaccgcgccccaacagagggaggcggctgcaggggtggcggcgaaagggcccaccgggcgttccggagtcggaacactgattcctctcccgcgtggcctctcgcttctgcaggaaccttgcttgtgctgcctcctgtctgggcctcagtttcctccgtattcagcaggaagccataaggttattaatataaacacctcacagggctgccgggagccggagtgagatcctacaaagagagcacttggcacggaggagtggcctgcagccgcattccataaacagggctgctcagctgaagcggtggcccagggtgaggcccgcagactttgagcatcaatttgtggggagggaggcaaagggacataggagttctagaatagcttccaacctggggatctattatgtctgccggtctgggcttgtagaatgtctggagacccgacgttctagaatgcatgaggtttctggggactccagagtgcccgatgttcgaaggttctagagtgtttggagctctgtggttctaggctattctaaaatcttaccttccagagtgtcctccactgccagaatgtcttagggcctgtgcttttagaatctgaaagtctgatattctagaaattccaggggcctgtagttctagaatggctgaatccttcccataaagatgatgactttccacacatggggagagaccacgcttacaacaggtcccatccttcactgggtgacctgagtgaggtcagtccctcctgtctcgggacctcctcattaattaagccaaaatagactctagataattgcttggggccctctggggttctgagacattggaagccagcctcaaatacccaaagccttgggtcatctcagtgatcatctccagcctctgggatgcagaatccagatttcaagctctagaacccagaaataagactacaggaccagaatagagaccctgggttcccagactctaaattcagactctagagtcaagattctagcaatctcagaatcgtgaaagccaggtccctgtctctcaattcagccttttaaaaatttatttacttatttatttatttatttagatttttcatagagatgaggtattgctgtgttgcccaggctggtctcaaacccttcagttccagcaatcctcctacctcagcctcccaaaggcatgagtcactgggcccagccacagtccaggttttcaatgcaaaaacagatttgaaactccagactgtatgttccaaagtctactcctgaaagctcagaggctagatccaccctgtagaatccagaccccaagcctggcatggtggctcacgcctgtaatcccagcactttaggaggctgagtcaggtggatcacttgagatgaggagttcgacaccagcctggccaacatggtgaaaccctgtctctactaaaaatataaaaattagctgggcgtggtggtggtcgcctgtaatcccagctactcaggaggctgaggcaggagaatctattgagcccaggaagtggaggttgcagtgatctgagatcgcgctattgcactccagcctgggtgacaagagcgaaacttcatctcagaaaaaaaaaaaaaaaaagaatccagaccccacaattcaaaatcccaaatctaccatttgtagtctaggccccaggcttctcatagcaggtgcaaaggtttccagcctcgattgccagattccaaacaccagattccaggctcctattgtgggttctagattcgaatgccccgggatccagaatcaaggttcacgatctgtcactcaaaggcccgactccaggatccagattccagacccccagcccaagaactcagactttgaaatccatattccagactgcaggtcattaatctccaactcaagatcctcaaatccagaatccaagacccagatccagaaccagatccggatccagaacccgggatccagaactctgccccaagcccaagaacagggactttaggatccagtttccacactccagaccccaaattccagactctgtcttttgatctcctcctaatttctgtttttgtcctcctgtcccctcccccttgaggaactgctcctggtggagaattcctctttgtggactcagacaacagcttcaacctaataaatgctcattaggccaagtctcccaccccaccagcaaccaaggcgtctctgcctgtaaacctgactctcagccacctcccaccccaccctacaccaccacacccccagacccagctgggactgggagcttataaattcaggcatcctggtacctgctcccttctggcacccaagctgccctagatgctgctggaggatctggaggaggtgagagctttgagacaagactgagggaggggcaaaggggagattcactgtgccctggtttcaaggggaaacgttgaccacgcttggagaactgagtgtcaagggcatgggtagatccacgtgtcctttaccaatgccccaaattgaacctgaaccaagaaaatgtcctggaatggccagaaggagctgcagtggtggggagggagggggatggagtggatcaggaggacgtccctgaagtacttgtatcagagccaagaacgtggtcaggagtgatcacgggttcaagtcagttcagcacaacctcccggaggcctcctgtgtaccaggccccaggtggggcagtgctgaggtcacagaaagaacctgacctgagccccatcttcaagacccccagatggagaaaagaacaggccagacctcagcaagtatggggcatctgcgctgtaatggagacagaatgggtgctgtgggattcaggggagacacctgttaggtgttggggcctcccagaagaggtgggggcagagtgtcagaggacaaagatgaatttggaagatatggggaagaaggatttcaattcaccctcaaagcttcctgaggcctcccgtgggtcgggccctgcagtactggagacccagagtggagtcagaccagctcctcggggagctgccagtctcgtaggggaggcagacaccactgagggtcaggggaggtcagagaaggcctcaaggaggaagcggggctggaagggaatggcgttggatatgcggtgggaggaatagcctaagcatgaaatggcaggagggaaaatggcagcactggctgcgtctaggacaaggtcatgggagacccagggagaggggctggaagggaagaagccacttttgtccttgaaagtgaggctggagccaggcaactcatgcctgtaatcccagcactttgggaggctgaggcgggtggatcactagaggtcaggagttcaagaccagcctggccaacatggtgaaactccgtctctactaaaattacaaaaattagctgggcgtggtggcacacacctgtaatcccaattgcttgggaggctgaggcaggagaatctcttgaacccagaaggcagaggttacagtgagcggagatcacgccactccactccaacctgggctacagagccagactccgtctcaaaaaaaaaaaaaaaaaagaaaaaaaaagaaagaaagtgaatttgaagagctggactttatcctggtggtgccaaggatccatggagggtggtgagcaggggaggggcacagccagctccagatgtagaaagaccctttggggtcatggctggagggcaagctggtggaggggactggactggagggggacccaaaaggccagataagaggttgagatagaccaggcgcggtggctcatgcctgtaatcccagcactttgggaggccgaggtgggtggatcatgaagtcaagagattgaggccatcctggctaacacggtgaaaccctgtctctacttaaaaaaaaaaaatttccaaaaaattagccgggcacggtggtgggcgcctgtagtcccagctactcgggaggctgaggcgggagaatggtgtgaacctgggaggtggagcttgcagtgagccgacattgtgccactgcactccagcctgggtgacagagtgagactccgtctcaaaaaaaaaaaaaagttgggacaggggtccttggtgatgatggagagagatccaggggctggtagcatggtgctggaggctgacaggtggaggaggtggggcagggtctgtccgagtgcctagaggaagagtaaaccttccagagatgggggacccagaaggaagcgcagagtggggttgggggaaggggataccggtggtcagaagaaatttattaacagtggatgggataagtctgtgtctggagggatcctggtggaggcagaagggtcctgcctcacctggattctctcactccctccccagactgcagccgaaccctggtccctcctccacaatgtggcttctcctcactctctccttcctgctggcatccacaggtgaggtggccccaggagggggccaggtctgtgggagcaggtgcccccttcccaagcatgtctgggcccagtgatctgccagcccctacctcacccagagaccactaaagatccttccttcaccctccacctgtgccaatgtccctaagcccttaccgtcaggtgctggtgctgctgctctggagtcgctatgttgcctggggcctctcgctgcccacgacaaggaacacggtcctggggttacacaaacctgagctgagtcctggggcaaccgcttccttgctgtgtgtccttgagggaactgcttcacctctctgggcttcgaatgccttctctataagacagcacccrcttgagacaataacagtgaggtctcaatagcataacagaggtaatatacatagcaagcattagacaagtgctgagaggccaacagcacagacagactccagcttgagtcccacrcctgccactccctgtctcttacagggtctttgaggggattaaatgtggttgtgtgtgaggcagaagcataagcctggcycaggtagtgcccyttcaggtgtgcaagccaggcacggtgcttagagcttacatacaacgtctatgtgtggtgggcaccmccgacctcatttgacaagggaaggggctgtggctcagagggacggccacaacatcaaggtcaccttgggtgtcaggcaaactccagattgaactcagctgccacacaccaagaaattaattgtaacctgatgcctctcttctggagaaattggggggtggactttcattaacgttctgccacaaatgaccctcactcctgggggcccytgagacccccacgcctccagcctcccctccggctctctctgtgcactcacctacctgcctcgcgcctgcctgctgcgcccagctggggcctccaccttcctctggcttggactggccaggtgcagcctcggtgcccagctgttcagcccgtaccctccgcccttcggaggacgacctcacccttcctttgttaagcccctygtccaccacatccgcattcccctggtctcacgggggcctttggcccagttcctgactgtgatggggagagtgtgggcatttggtctggctgtgcaaatcctgcccctgtgtgggtgggagtgtgcatggcttcaaccttcaggggatgcatccacattgcccagtggagaggggtcctggtcctgtgaccttgaatgtctctaatcatgtccttaagcataatgccattctgtgtgtgtgtgtgtgtgtgtgtgtgkacatgcacgtgtgcagtgggtatacaaggccctgtatgttcacatcctctccacatgcatgagccagatccccatatgtgaaacccaatcagtgactccacagatctggcttgggggctgatctagagatggataaatatgtcctgccctggctgcctctggcttcagctgcatgtctytgaccttgaatgcccagccccgtgtctgggtgctgccccagacagcaagtccacatctgagtgttggccttctgggttggtgtctgcagctctaactctacaaaatgtcttgtgggtgaatcacggttttaaccttgacttttttttgtttgtttggttttttttgagacggagtctcgctctgccgcccaagctggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctrtgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaartttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttsctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggatcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcarggtcctgagggagcctggttcggggggaagagctcctakatttgggggaagacggaggcagacgccasaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccscacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggtkaggcttggagatggagtaggaagagaagttagaataggggtgaggttggagttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtragattggatataggttgggtgagttgtattgagctgtgttgaattggggttggggttggggttgggttggctctgtttgggataaactgggctgtattgagttgagttgggttggggttccctgggatggggatggattgggtttggggtgagattgcaaatggtgattaggatgaggatgaatccaggaggtttcactcaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactgagtaaataccctctatctctggatcccagttaaaggacctaacagacactagattaccaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttaggaggcaggagttgcagtgagccgagatcgcgccactgcactccagcctggtgacagagcaagactccatctcagaaaaaaaaaaaaaaaaaaaaagatttagttctgggcttcctggtagccatggcaaaaaggcaaatactgtcctttccttagccaggtccctgatatacagcagaggctggaactctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccataactgggagcaagaagtgggaggctcattgagaccccagcattgtttgggagggacactggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaaggccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggaggggggggggcaattgtccagcccccaggcaacaggggaagggccttggccaacatctgggtgccagcagggcaggggtggggctctgaggggataagggcttttaaaagcctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcccacagtctatcctagtccggggtgccccggctcttatctatcttgcgcggccccaccctaaacttccacccccgctcctccatgttgtcatagtgctcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgccccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccatctggtatgggggggggtctgcaaatgtcccttcccacccagcacccccagctctcccaggaaaaacaccacaccctcccaccacatgctcctttccttggggaagttccatcccgccccaggccccagcccttctctgcctgaattgttcctacacagctctggttttctggaaccccacgccaaggatcctgaatgccttctcagccagcgcttctgccctggcctcccccaagtcagtatgtgattctacaacctcacatcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcagattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtccagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccctttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgaggcagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggcgcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttctcacccctctgtccttttgagctcttttttgctctgtctcttcatttgccttttgcactctcaaactctttcatcttcccattcgctgtctgtatttctccataactatatctttcttcctctgtctccgcccacccacatttttctctttccctttctctctttggggaccctcccccatgctcccctgccccatccccttttccccttcccgtcttctcatccctccattcccatctttccccagcaattaccagctctggctgggtcgccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagacgctgtgaaggtcgtggagttgcccaccgaggaacccgaagtggggagcacctgtttggcttccggctggggcagcatcgaaccagagaattgtatgtgggggcagactgtgtagcccaaggcggggatggggactcctgcgtccaagggagaaagggccagggaagcaggtgaggtcgggctgcagccctttttctcccgggttcgtagtctcatttccagatgatctccagtgtgtggacctcaaaatcctgcctaatgatgagtgcaaaaaagcccacgtccagaaggtgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccgcaggggcagcgtcctgcagatggtcctgcccctcctccccctaacctgtctgcaggcactgtccacctggaccctgccccatgtgcaggagctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggct

SEQ ID NO: 17832 - DNA, 75327 bp, Homo sapiens
  misc_feature (1)...(75327): n = A,T,C or G, or insertion/deletion polymorphism (see Tables 1-2)
tcatgggagttatgtgctgctttaaccagtgactgtctatggtagggtacaaatgttctggtcccttgcctaagggcagacagattctgcttgcactttatgcttcagggctcccggtaggaataggctgagtctagacttcccctgaaaccattcttgctttccttcttcccctcccctggcctgcttccctccctcaccctcctagatttctacctagactactttcctaataaatcacttgcctacgaagctccaccagtctcagcttctagggaaatagactgaagacactcacgtatgcacaaaatgacatatacaagattatccattgtttcattcataatagaagactgttaacaagcaaatgttcatcactaggctcctggttaaataaagtacagctgccccaggaaggaaactaggggttcaggaatacggtgaaaagtaaactttcactgaacttttagttctttctgaatttttttttttttgagacagagtctcccccttgcccaggatggagtgcagtggcacgatctcggctcaccgcaacctccgcctcctaggttcaagtgattctcctgcctcagcttcccgagtagctgggattacaggtgtgcatcgccacacccggctaatttttgtatttttagtatagatggagtttcaccatgttggccaggctggtctcgaactcctgacttcaggtgatccgcctgccttggcctcccacagtgctgagattacaggtgtgagccaccgtgcctggcctctttctgaattttgaagcatttggatgtattgctttttttttttttgagacggagtctcgctctgtcaccaagctggagtacagtggcgagatctcggctcactgcaacttccacttcccgggttcaaacgattctcctgcctcagcctcccgagtagctgggactacaggcgtgcaccaccacgcccggctgatttttatatttttagtagagatggggtttcaccatgttggccaggctggtctcgaactcctgacttcagatgatctgcctgcctcggcctcccaaagtgctgggattacaggcatgggccaccatgcctggcctgcttattttttaaaaaaataaaattaatgttaaaataattaattaaggctgggcacagtggctcacacctgtaatcctagcactttaggaggccgaagcaggtggatcacttatgcccaggagttcgagaaccagactgggcaacatggtgaaacctcatctctacaaaaagtaaaaaaattaaccgggcatggtcgtgcatgcctgtgttcccagctacttgggaggctgaggtgggaggatcacttgagcctgggaggtcgaggctgcagtgagctatgattgtaccactgcactccagcctgggtgacagtgagattctgtttccaaaaaaaattaattaatcaaaaaatccactaaacaagtaaattggatacttaggtgaaaatcttaagtgtaggccgggtgcagtggctcacgcctgtaatcccagcactttgggaggccgaggcgggtggatcacaaggtcaagagatcgagaccatcctggctaacatggtgaaaacccgtctctactaaaaatataaaaaattaaccgggcgcggtggcgggcgcctgtagtcccagctactccggaggctgaggcaggagaatagtgtgaacctgggaggcagagcttgcagtgagccgagatcgtgccactgcactccagcctgggcgacagagcgagactcagtctcaaaaaaaaaaaaaaagaaagaaaatcttaagtgtaagtacctaaacaatctattaaatgacctgtgaaaccaagggctcctaatgctatgaccaaagactgaagctctctatgagatgccagccactcaatagtgcactttttctgagaagatataagacagccactcagaattatgatgtaataattggtaatgtggggaagtaaataaatgtctcaaagttttgcttttgaaaaatgactagtaaatagtaataacaaaactgttatttatggagggatgagtctgtggcctatctctcttcccttttatgtctacgtttctcacagtcatctacactccctgtcacttgtacttattcccttgacactgcaatctagcttcatccactcccccaaaatgactcttcccaacgctatcaatgacccctttgtctttccatccagtggctgtttttcaatcctcgtattccttaactctcagcagcattctgtgacatgatgctctcctggtgttctgcctgcatctctgctcatttctttttagactcctttgtcagtttatgctcttctgccagtctttttttgagacggagtttcgctcttagtccaggctggagtgcagtggcgcgatctcagctcactgcaacctcagcctcccggggtcaagcgattctcctgcctcagcctctccagtagctgcgcctgccaccaggcccagctaattcttttcttcttttttttttttttttgagacagagtctcgctctatcccccaggctggagtgcgtactctatcccctaggctggagtacagtgtcgcaatcttggctcactgcaacctccgccacccaggttcaagttattctcctgcctcagcctcctgagtagctgggattacaggcgtgtgccaccatgcctggctaattttttattttttatttttgaaatggagtcttcctctgttgcccgggctggagtgcagtggtgcgatctcggcctactgcaacctctgcctcctgggttccagtgattctcctgcctcagcctctcgagtagctgggactacaggtgtgcgccactgcgccaggctaatttttgtatttttagtagagacagggtttcaccatattggtcaggccagtctcaaacttctgactttaggtgatctgcccacctcagcctcccaaagtgctgggattacaggcgtgagccaccatgcccggccaatttttgtattttttaattagcaacggggtttcaccacgttggccaggttattaaccacatccatggctctgattaccacctgtggataaatatgtccccagttctcctctgagctcctattttcctttttttttagagggtctcactctgtcacccaagctggagtgcaatggtgcgatcatggctcattgcagccttgacttccagtgctcaagccatcctcccacctcagcctcccaagtgtctgggactacaggcatgagccaccaagcaccagctaatttttgtatttttttgtagagaaggggttttgccatgttgcccagactggtctcaaactcccgagctcaagcgatctactggcctcggcctcccagacagctgggattacaggcacaagccaccgtgcccagcctctgagctcctattttccttttattattattattattattattattattattattattattattattattttgagacggagtctcactctgtcacccaggctatagtgcagtggcacgatctcggctcctgggttcaagcctcctgggttcaagtcattctctagcctcagcctcccaagtagctggggctacaggcatgcaccaccatgcccggctagtttttctatttttagtagcgatggggttcaccatgttagccagactagtctcaaactcctgacctcatatgatccacccacctcggcctcccaaagtgctgggattacaggcgtgagccaccgcgcccggcctgagcgcctatattcaactgcacatttaacatttccacttgaatatcccattgaatggcaccaacattcatccaatttctcctttcaggagcttggggaccatctttctcttttagtattcatatctaacaaatcaccaagttccatcaattttatcatttaagtatctttctaatctgttcatttccttccatctatactgtcaccaccctcattttaactaccttatagtttctcacctgattagtccaaaagccttttaacttcctttctgctttcaatcttgttttttctctattgcattcctcacactgcacccagaataatctttttaaaatgtaatgtcacactcccttcagtaaaatcttgcctttgattttcagtgcatttcaaatgaagtccaaagttctcaccatgaactccagtgctgtgtgatctggcctttgcctgcctctcccattttgtttcacagccctctccctttggctccctctaggttccttcctcagcagtggttctttattgtctcagggcatctgcttttgttgtttcacagttgttaacattcttctttctgctttcatgtatttggccttttctcagtgttcaagtcttggatcaaatgtcacttcctcagaaagccctctccaggccgggcacagtggctcacacctgtaatcccaacaatttagaagaccatggtgggaggatcacttgagcccaggagttcaagaccagcctgcgcaacatggtgaaactccacctttacaaacaattgtttaaaattagctggatgtagtagcgtgcacctgtagtctcagctactcaggaggctgaggtgggaggattgcctgagaggttgaggctgcagtgagctaggattgcaccactgcacttcagcctgggtgacagagcaagaccctgtttcaaagaacaaaatgcatcttattcttggtacttgtaatttgtaaacacattcatttacacatgcacatacgtctatataattacatattaaatatgtaattatgtattcacgtgtttattgtccatctccaacacccacctctatcccaaatgtcaactccatagaggcagggaccttattagtcttgttcaccagtgtattccttttagctagaataatgcctagcacacagcaagaaaagtaagaaaaatgatgtggggaatcttttaacaaatgattattcattcagagattccccacatcatttttctttcttttttgccctctagttacattggctttgaattcttttttctttttttttgagacttagtctggctctgtcgcccaggctggagtgcagtagcgccatctcggctcactgcaatctccgcatcccgggttcaagcgattctcttgcctcagcctcctgagtagctgggattacaggcgcccgccaccatgcctggctaannnnnnnnnnnnnnnnnnnntttcaccgtgttagccagggatgtcttgatctcctgaccttgtgatccaccagcctcggcctcccaaagtgctgggatcacaggtgtgagccaccgtgtctggcctcagctgaacattttttaagaattcaaagctggccaggtgcggtggctcacacctgtaatcccagcactttggaaggctgaggcgggtggatcacaaggtcaagagattgagacaatcctggccaacacggtgaaaccccgtctctactaaaaatataaaaattagctgggcgtggtggcatgcgcctgtagtcccagctacctgggaggcggaggcaggagatcgcttgaacccaggagacagaggttgcagtgagccgagatcttgccactgcactccaacctggcaacagagcaagactccgtctcagaaaaaaaagttcagctggtgctgtggcttatgtctgtaatcccagcattttgggagggtgaagcaggaggctcacttgagtccaggagttcaagacaagcctgggcaacatagtgagagctccatctctacaaaaaaatacaaaaatagctggacatgatggagaacgcctgtggtcccagctactcaggaggttgaggtaggaggattgcttgagcccaggagtttaaggctccagctgaccatgattgcaccactgccctccagcctggacaacagaatgagaccctgtctcaaaaaaaaaaaagaaagaaaaagttatgtaactttctccctcatttccttagaatatgctatttgctctgcctgataagctccctgccaccacatatttagttaatgactacctgctttctaggtctcagtgtaaatgctactgctttagcgttgctactcctgacattctagacaaggtgaggtcactgttatataatcccctaaaacctatcttttcccttcagaacacttatgatttgtaattatttttatttatttttgtttggctgggttttttgtttgtttgtaattatattttcttgttggtctgtttgctctagaccagagatcagcaaactccagcccatgggccaagtccagcctaccacttgttttataaataaagtttttggaatacagtaaaatgcattcatttatgtattgcccatttggctcctaaaatatttaccgtctgctttttttttttttttgagatggaatttcgctctttttgcccaggctggagtgcagtggtgcagtctcagctcactgcaacctccgcctcctgggttcaagtgattctcatgcctcagcctcctgaatagctgagattacagatatgcaccaccacgcccagctaatgtttgtatttttagtagacatggggctttgctatgttggccaggttggtcttgaactgctgacctcaggtgatctgcckgcctcagcctcccaaagtgctgggattacaggcgtgagccacggtgcccagccaccatctgctctttacagaaaaagtttgctcacctctactctagactagagtataatctctattaggacaaagatgatctcttcctacacactactaaaatttaaagaatttccgtaaaaactagtgaaataaaataaatggtaatcgctctgctaagtactttayatgtattacccacatcaattttatgakaaaaatattattatctacaatctacacrtgaggaaactgaggctcagagccatctggtgagttgccctaaggtcacacagctgataagtagcaaactgatgtttgaatytaagtttaaaacaatgtttcttctttaaattttttttttttttttgagacagagtcttgctcttgtcgcccaggrtggagtgcaggcgtgagccaccacacccggcccttctttaaatttttaaatgtaattaattgatactacaactagtcagtgaaagtttgataaggagcatcttatcataacacaattaattacyactaattaattamaaaagaaaaatagtaatgtgacagtgaaaacagttaatcaaagttaataccaccaataatggggcaagctgacatcattttctcctgctgtactgcaatgagatggtcataatagctcttatatagttttttgccaaaaatgcaaaatctgaatctaatcacaaggaaatatcyaacaaagccaaattgagggacatgttacaaaattcaaaacatcacataatccaaaagacaaaattttaaactgtcaacatcatgaaagacaaagaaaaactaaggaattgttrcagattgagaccaaagagacatgacaactaaatgtactgtgtgaacctagattggatcccagaccagagaatcttctttttctataaagaacattattgggactattgtgaatcggtgttacaagttgtgggtaattaaatatagctacagggagctgggcaaggtggctcacgtctgtaatcccaacactttgggtggccgaggtgggcaggtcacctaaggacaggagtttgagaccagcctggtcaacatggtgaaaccccgtctctactaaaaatacaaaagttagctaggcatggtggcgggctaatcccagcttgggaggctgaggtgggagaatcgcttgaacccaggaggtggaggttgcagtgagctgagatcaygccactgcactccagcctgggcaacagagtaagactctgtcgcataagtaaataaataaagctacagattatttgtatcccctcctgaaaagaggtgaagtctatttacccacctcttgaatcttgggctggtcttgtgactttgaccaataaaatggagaagtgatgacttctgaatttcattttgaaaaggtctyctggcttctgctcttgctcttagaattctgccctgagactattgtataaagaagctcagtatagcgtattaaagatgaggccacrgcctgaagtatacaagttgatagcaccaagtgctacgtatgtaaacaaaagaccatcttagagagatgacaagtcaagtggttccagggragatcagcagaagcaccactcagctgattccagtccaaatttcaacccacagaaatatgaacaataaacagatgccattataggctactaattttagaggtgatttgttttttttgtttttttgtttttttttgttttgttttgtttttgagatggtgtcactctgtcgcccaggctggagtgcagtggcgcgatctcgtctcactgcaacctccatctcctgggttcaagcaattctctgcctcagcctcctgggtagctgagattacaggcatccgccaccaggcccagctaatttttttttatatttttagtagagacagggtttcaccatgttggccaggctggtcttgaactcctgaccctgtgatccacctgccacggcctcccaaagtgttgggattacaggcatgagccactgcacccggctagaggtgatttgttatacaacaaaggctaactgaaacagacatatcttgagatcatttggctacttgggcaagggctcagaggtgaaaatgttaagarttatcaacttatagtctggtccccagttctcaggcgtgaaaattcaaaattgtgaatgaatccagaattgatgagattccatgaataccaggataaccaaagaattcatgataaccaaactcataagaaactatgtaagccaggatatctaccagaaaaatttatagtgaaaattacatatatttttcatgttctctttttggtaactggtaagtatcttttttttttttttttttttttttgagacagagtctcactccatcacccaggctggagtgcagtggcgtgatcttggtggttcactgcaaccttcacctcttgggctcaagccattctcctgcctcagcctcccgaatagctgggattacaggtgcccgccaccacacccagctaattttggtatttttagtagaggcgggttttcaccatgttggccaggctggtctcgaactcctgacctcaagtgatccacccacctcaacctcccaaagtgttgggattacaagtgtgagctgctgtgcctgtccagtaactggtaagtattgacagaatcagtttacttaaaggagagtgaaactggaataacaggagttatatagttttaagagatactttatccaaactgaaataaaccattcttatcccacaatagtatataactatggaacaactagagtatttgtgtccactatagtaaatttctctggactctgaatagtgagagctaatcagtgcaaaatcttgctctctggctgkcctttacttatctcttctgacctttgttttgattgcaaactttctttggacagtataaaaatcagtattttaggattagaacccaatcaatatattgagttcagttacattctagttctttctgcctgatattacactccaattgccttaatggatcttgagtgcttccagatattcttattaaatatttgtcatttttcttttggctttgttaattgtgacttatgccatgcataattttttgcttagtagtcaaatttatcattctaaaacaatctcttctgtgttttgcattatacttggaaggtcaaggaccttagagacatacytctggctattggatgtagactttctttcttttttttttttttttttttttgagtcagtgttttgctctgtcctcaagcctcgagygcagtggtacaatcacagctcactgctgcctccaccttcagggctcaagcaatcctcccacctcagyctcctgagtagctgagactatgcccagctaattttttattttttgtagagatggggtctcactatgtaacccaggcttgtcttaaactcctgggctcaagggatccttttgcctcaacctcccaaagtgctgggattacaggtgtgagccaccacacctggctgcaaataractttcaataaaaaaaactttcattccaggatcatcagtgcaggagtaagctagttgacctggtaacaaaacacatgacctcaataataaacaggaactcctaaagacaataagaggtaagatcttaggaaaaaaaaaaaaagttttcctcattcttgacctgtgaaacaatttcctggcttatattagaaacaatcattttgccagttcttgttttgtttcattttggcagggtctggtgctggtgctctcttctatgtaataaggtgccggatacgtacctacttacaagaaagattatttgtgtcttcaaagcaggtttacttttgttcataaagcaaaataaaatagcatactagtcatctgctacttattttaatttatggttgtttgtgtttacacaagaaagagggccttttgtgaaaagtaaatgatttacatatcagagataattaagataaccctatrcctctgatgagcaacctcacattttaaccatcttgctataaatmtatatagatcaactgaaatttatacaccttagtcacacccaaatttattatctttaacttcaagatcgattatctcctgtcacatcaaagtaaaattgtctgttacagaaatatatatgtgagcatgcaactgcrtaaaaataaggcagcttttagtgtattttgtgcatattgccataaatttgtacagastgacattctaatgatatttcttttattttcagatttataaatatgtgattacatattgtggaaaaataatgctataggctctgtatttcagttattattatatcttattcattctttactgcatttatgccagtaaaattgatctcacaggcctgctttttgcttataatgctaactaatgaaaatccagagcttggcttatcaatgtgagcctttgtaattaacagaagtcttggaaataaataaaggatatgctcctctcccctatagcacagagaggaggatgtctttctgagatataacacatattcaaaatatctgattttgtaaagtgtcaaatggtygatattgacaaaaatatcaatcttttttctcttttgtgcaatatggagagtggtgtgaatcttcggtttcttattrtaagtcwttttctttgaaaaaagagttttataaaactaagacttagaaacttacttgccctggccttgaaaattacctttggaaaaatgcttgtgctttatgggtcctgagaatatactacttttgagatttgtcaggacgcatttggctgagtaacaggttattctcatggctaaaagcctattacagcaaaggatattatacaggatcagcagaaaaaagttatgcctacaagaagacccgaaagattaggtgcagacttctaggttctccctccatgctggtcacagtaaggtgcttttggcacgactacaaattatacgaacatatatgagatgtctctgcccacgtaagtccacttaggtctgaggwcccggagttcttacaggagtctggttgcacaaggcacattcctcccacgtgacaatctatggtgcagatctttacccaggaggcaggtgctcatggcacatcttgatatttgtgttaggcagtgctggcaattgagcatgtcatgcctcagtgcctcaggagcacaaaacaacttcattggtgactatgttaactccaaggacttagccccaagtggttggctaagggttggtaccgtgactccaggtactcctggaaataagctgagtgaactcctttctcatagattataattctgattggtagctttacttgataatttgttgccctgatagtaatgttgtaattgacatttctgcatgtgtaaataggataaattcttgaaagattrctctgcaaatctgatcatttgtttctcatctcttttttttatattttattttattttatttatttattttttttttgagacagatcttgctctgtcacccaggatggagtgcagtggttgttcgctgcaacctccacttcctgagttcaagcgattcttgtgcctcaccttcccaagtagctgggattacaggcacgggccaccatgcccggctaatttttgtgtttttagtaaagatgagaattcaccatattggccagggtgatctcagactccaggcctcaggtgatctgcccaactctccacctcacaaagtactgggattacaggtgtcagccaccacatctggactgttcctcttttcttttgtgtataatggggttgggtggggtggtagggagaaaagtctgactttgctagatttcttattttaacaaagaatctgtgagtcttttctaggtaaaattaacaactagcaaggggttctagcagagtgtaatttcaaaatactctattatgcttgtaaaataaactattcacaatacatagtgtrgtataataataacagatgtttttgtcagcctaaaaataatgagttgaaggttctaacggttgcctttatagaaaataacatctttggccrggcgcggtggctcacgcctgtaatcccagcactttgggaggccgaggcaggcggatagcctaaagtcaggagtttgagaccagcctggccaacatggtgaaaccctgtctctactaaaaatacaaaaattagttgggcgtggtggcaggtgcctgtaatcccagctactggggaagctgaggcaggagaatcgcttgaacccgggaagcggaggttgcagtgagccragatcacaccattgcactctagcctgggcaacaagagcaaaactcygtctcaaaaaaaaagcaagtaacatctttgtccaggcgcggtggctcacgcctgtaaccccagcactttgggaggccgaggtgggcagatcatttgaggtcagaagttygagaccagcctgaccaacatggtgaaaccctgtctctactaaaaatacaaaaaaaattagcctggtgtggtggcacatgcytgtagtcccagctacttcggatgctgaggcaggagaatctcttgaacccgggaggtggaggttgcagtaagtggagatcgtgccactgcatyccaacctgggtgacacagtgagactctgtctcaaataaataaataaataataacatcttcactgagatacaggtatacttcagagataagcccatatatcaggaatatcaggttttgtgatatcaggttttgttctagaccactgchataaagtgaatattgtgataaagcaagtcacacaaattttttggtttcccagtgcatgtaaaagttatgcttacactatactgtaacctactagrtatgcaataacattatgtcataaatgtgcaacataaatacactaattataaaatactttattgctgaaaaaatgctaacaatcatctgagccttaattgagttgtcatcttgtgtcatcagcaaaaagctggtggagagtcttgcctcaacatggatgacttctgactgatctgagtggtggttgctgaaggctggagtggatgtggcaacttcttcaaatcagacaacaaaaaagtttgcygcattgatggactcatttttaaaatattttattttatttcaatagttcttggggaacaggtggttttgcttacatggatactttctttagtggtgatttctgagattttggtgcaactgtcacttgagcattgtacacggtgcccgatctatagtcttttatccytcactcccctcccaccttttcctgagtctccaaagtccaaagtctattgtatcattcttatgcttttgcatcctcatagcttagctcccatttataagtgagaacatacaatatttcgttttccattcctaaattacttcacttagaataatggcctcccrctccatccaagttgctgcaaatgccattatttygttcccttttatggttgagtagtattccatggtgcatatataccacattttctttatccagtcattgattgatgggcacttaggttggttccatatctttgcgattgtgaattgtgctgctgtaaccatgcacatgcaggtgtctttttcatataatgacttcttttcctttgggtagatacccagtagtgggattgctagatggaatggtagttctatttttagttctttaagkaatctctacactgttttctgtagtggtaaatgcgtttgcatttactttacactcccatcagcagtgtagaagtgttcccttttcaccacatccatgccaacatctattagtttttgattttttaattatgggcattcttgcaggagtaagctggtatctcattgtggttttaatttgcatttccctgataattagtgatgttgagcattttttcatatgtttgttggccatttgtatatttcttttgagaattgtctgttcatgtctttttccctcttttggatggtgttatttggttttttcttgctgatttatttgagttacttgtagattctcaatactagtcctttgttggatgcatagtttgtgaataatttctcccactctgtgggttgtctgtttactctgttaattctttcttttgctgtgcagagcttttttgtttaattaggtcccatctaattatttttgtttttgttgcatttgcttttgggttcttggtcatgaactctttgcctaaaccaatgtctacaagagtttttctgatattatcttctagggcatttttatggtttcgggagttagatttaagtctgtgatccatcttaagttgatttttgtgtaagatgagagatgaggatccagtttcattcttctacatgtggcttgccaattatcccagcaccatttgttgaataggatgtccattccccactttatgtttttgtttgctttgtcgaagatcaaatagctgtaagtatttggctttatgtctgggttctctattctgttccactggtcctatgttcctatcttcttcataccagtaccatgctgttttggtaaccacaggcttggagtatagcttgaagttgggtaatgtgatgcctccagatttattccttttatgtagtattgctttggctatgcgggctctttttcggttccatatgaattttagaattttttttctagttctttctttttttgagacggagtctcgctctgttacccaggctggagtgcagtggcgcaatctcggctcactgcaagctccgcctcccgggttcacgccattctcctgcctcagcctcccaagtagctgggactacaggcgcccgccaccacgcccggctaattttttgtatttttagtagaggcggggtttcactgtgttagccaggatggtctcgatctcctgacctcatgatctgcccacctctgcctcccaaagtgctgggattacaggcgtgagccaccgcgcccagctttttttctagttmtgtgaagaatgatgatggtattttgatggaaattgcattgaatctgcagattgcttttggcagtatgttcattttcgcaatattgattctactgatccatgagcatgggatatgtttccatttgtttgtgtcatctattatttctttcagcatgttttgtttatgttatttctttcagcatgttatttctttcagcatattccttgcagaggcctttcacctgctttggtaagtatattcttaagtattttgtggcttttttggttttgttttgttttgttttgcttttgttgttttgttttgttttttccagcaatgttgcaaaagagattgagttcttgatttgattctcagcttggttgctgttggtgtatagcagtgctacggatttgcgtacagtgattttgtattctgaaactttactgaacagggacagtttgacttccactttattgatttggatgccctttgtttctttttcttgtctgattgctctggctaggacttccagtactatgttgaatagaagtaataaaagtgggcatccttgtcttgttccagttctcagagagaatgctttcaacttttccccaatcagtataatgctggctgtggtggactcttcctttcacaaaagatttctctaggatgttatgctgtttgatagcattttactcatagtagaacttctttcaaaattgtaataaatccttttaaaggtgctttatcaactaaatttatggaatattctaaatccttcattatcatttcaacaatatccacagcatcttcaccaggaatatattccctctyaagaaaccactttctttgctcatccataaaaagcaactcttcatccattaaagctttttttagcatgtgattgaagcaattcagtcacatctttaggccccacttataattccagttctcttgctatttccactacatcttcagttacttcttctactgaactcttgaactcttcaaagtcatccatgaagattaaaatcaatttcttccaaactccagttcatgttcatattttgacctacttacatgaatcaaatggcacctaaaatggtgaatcctttccaaaaggttttcaatccactttgcccagattcatcagaggaatcactatctgtagcagccatcgtcttacaaaatgtatctcttagataagaaggcttgaaagtcagaattgccccttaattcatgggctgctaagtggatatgttaggatgcatgaaaacaacattaaccttcttgtacatctccatcagagctcttgggtgaccaggaacattgtccatgagtagtaatattttgaaaggaagstttttttttggagcagtaggtctcaacagtgggattaaaatattcggtcaattggccaggtgtggtggttcatgcctgtaatcccagcacttaggaggctgaggcaggtggattkgttgagctcaggagttcaagaccagcctgggcaacatggcaaaaccctgactctaccaaaaatataaaaaaattagccaggcatggtggtatgcacctgtagtcccagctactcaggtggctgaggtgggaggctcacttgagcccagtaggtagaggttgcagtaagccaagatcagaccactgcactacagcctgaatgacagagggaaaccctgtctcaaaaaataataataataatagtaattcagtaaatcatgctgtaaacagatgtgctgtcattcagacttttttgttacaattatagagcaatagagtagatttagcataattcttttttttttttttttctgagatgtagtgtcactctactgccaaggctggagtgcagtgccacaatctcagctcactgcatcctctgcctcctgggttcaagcagttcccctgcttcagcctccctagtagctaggattatgggtgtgcaccaccacacccggctaatttttatatttttagcagagacagggtctcaccatgttggccaggctggtctcaaactcctgacctcaagtgatctgcctgccacagccttccgaagtgctgagattataggcgtgagccaccgcgactggcccaacttagcataattcttacgagccctaggattttcagaatggtcagtgagcactggctccaacttaaagtcattggttgcattagtccctaacaagagtcagcctgggccaggcacagtggctcacacctgtagatagtgtggagttatgcagacgactttacagataagttactcaacaactaaagagatgagaggagtttcctataaaaacttttaaaaaatcaggccgggcatggtgcctcacgcctgtaatcccagcactttgggaggccgaggtgggtggatcacctgaggtcaggagtttgagaccagcttgaccaacaaggtgaaaccccatctctactaaaaatacaaaagttagccgggcatggtggcaggcacctgtagtcccagctactcgggaggctgggacagaagaattgcttgaacctgggaggtggaggttgcagtgagccaagatcatgccactgcattccagcctgggtgacagaacaagactccatctccaaaacaaacaaacaaacaaaaaacacacaaaaaaacttctggccgggtgcggtggttcatgcctgtaatcccagcactttgggaggccaaggtgggtggatcacctgaggtcaggagtttgaggccagcctggccaacaaagtgaaaccctatctctactaaaaaatacaaaaattagccaggtgtggtggcaggtgcctgtaatcccgctacttgggaggctgaggcaggagaattgcttgaatccgggaggtggaggttgcagtgagccaagatcgcaccattgcactctagcctgggggacgagagcaagacttcatctcaaaaaacaaacaaacaaacaaacaaacaaacaamccaaaaaccttttaaattaaactgtaaaaacggcagcccacttgggctcccctctccactatagatagctttcttctttcatttattaaactttcactccaacctcacgctttgcatccacattccttaatttgcatggtcataagacaaagaactcctggtgatactacacaacaagagactactacattatggtatattgatgagactgtagcagtatttagagagatccaacatatatttcaagtcttttttcatctgaagtcacacaggatgtattttctctctagaaatgaacatatgtgaaatgtctctgctcagggaagcccattcaggtttcagagtctaaggcttttatcagggaccaatcacaaagacatatcctgttatgcgattagccatagcaaccaaaactcaggatcacaacaatgagaccaggggtacatcatcaatctcaatgtttgtgcaaagcaaattagcaagccagyatggcatggtacattgctccaagtgtacacaacaaaatcatcaattagtgacataaagaacatcctaagaacatttccgagggtttgccaagggtcaatcatgattccaggctcccttggaggtgtaaggactgagcaactagacctacttgctatgtagatttatctcagaaatggcctcttaaagagaattctcatcattctagwacctcatttgtcaacaggatttatacactaaaattcaatcttcctaaagaattgagaacaaatttaataaggagtaaactcagattgcaaagataattgtaaagaagttaatggaggaagtcctagccagagcaatcagacaagagaaagaaataaagggtacccaaattggaaaagagggagtcagactgttactattcactcattatatgattgtatacctagaaaaccctaaagactcatccaaaaagctcctagatctgataaatgaattcagtaaagtttcaggctacaaaatccatgtacacaaatcagtaccacagctatacaccaacagcgaccaaactgagaatcaaatcaagaactcaatcccttttacaacagctgcaaaaaatatatacataaaataaaatacttaggaatatacttaaccaaggaggtgaaagacctctgcaaggaaaactacacaacactgctgaaagaaatcataggctgggtgtggtggctcacacctgtaatcctagcactttgggaggccaaggcagatggatcacctgaggtcaggagttcaagtcaagcctggccaacatcacgaaaccccgtctctactaaaaatacaaaaagtagctgggcatggtggcacatgccaataatcccagctactcgggaggctgaggtaggagaattgcttgaacccgggaggtggaggttgcagtgagccaagattgtgccactgcagtccagccagggagacagagtgagactctgtctcaaaaacaaacaaacaaacaaacaaacaaaaaagaatcatagatgacagaaacaaatagaaacacatcccatgctcatggatcagtagaatcaatattgcaaaaatgaacttactgccaaaagcaatctacagattcaatgcaattcccatcaaaatactgccatcattcttcacagaactagaaaaaaagatcctaaaattcatatggaaccaaaaaagagcccacatagccaaagcaatacaacataaaaagaataaacctggaggcatcacattacccaacttcaagctatgtgccaagcctgtggttaccaaaacagcatggtactggtatgaagataggaacataggaccaatggaacagaatagagaacccagacataaagccaaatactaacagccagttgatctttgacaaagcaaacaaaaacataaagtggggaaaggacaccctattcaaccaatggtgctgatataattggcaagccacatgtagaagaatgaaactggatcctcatctctctccttacacaaaaatcaactcaagatggattaaagacttaaatctggctggtgcggtggctcacacctgtaatcccagcactttgggaggccgaggcagggggatagcctgaagtcaggagtttgagaccagcctggccaatatggtgaaaccccgtctctactaaaaatacaaaaattagttgggcgtggtggcaggtgcctgtaatcccagctactggggaagctgaggcaggagaatcgcttgaacccgggaggcagaggttgcagtgagccaagatcacgccactgcactccagcctksggacagagtgagactgtcaaaaacaaaaacaaaaacaaacaaaaaaaaaccacttaaatctaagacctgaaagcacaaaaatgctagaagaggccaggcacagtggctcatgcttgtaatcccagcactttgggaggctgaggcgggtggatcacgaggtcaagatttcaagactagcctggccaagatggtgcaatcctgtctctgctaaaaatacaaaaattagccggtcccagtggcaggtgtttgtaatgccagctactcaggaggctgaggcaggagaatcacttgaactcagggggcagaggttgtagtgagccgagatcgtgccactgcactcaagcctgggcaacagagttagactctgtttcaaaaaaaaaaaaaaagtgctagaagataccatcaggaaaactcttctagacattggtttaggcaaagagttcatgaccaagaacccaaaagcaaatgcaacaaaaacaaaaataaatagatgaagcctaattaaacaaaaaagctctgcacagcaaaagaaagaattaacaaagtaaatagacaacccacagagtgggagaaaatattcacaaactatgcatcccacaaaggactagtattgagaatctacaagtaactcaaataaatcagcaagaaaaaaccaaataaccccatccaaaagagggaaaaagacatgaatagacaattctcaaaagaaatatacaaatggccaacaaacatatgaaaaaatgctcaacatcactaattatcagggaaatgcaaattaaaaccacaataagataccagcttattcctgcaagaatgcccataattaaaaatcaaaaactaatagatgctggcatggatgtggtgaaaagggaacacttctacactgctgacgggagtgtaaagtagtacaaccactatggaaaacagtatggcgattccttaacgaattaaaagtagaactaccattccatctagcaatcccactactgggtatctacccaaaggaaaagaagtcattatatgaaaaagacacctgcatgtgcatggttacagcagcacaattcacaattgcaaagatatggaaccaacctaagtgcccatcaaccaacgactggataaagaaaatgtggtatatatgcaccttggaatactactcaaccataaaaaggaatgaaataayggcatttgcagcaactggatggagtgggaggccctaagtgaagtaacttaggaatggaaaaccaaatattgtgtgttctcacttacaaatgggagctaagctatgaagaagcaaaagtacgagaatgataaaatggacattggactttagggactcaggggaaaaggtgggaggggactgagggatgaaagactacacattgggcacagtgtacactgctcaggtgatagttgcactgatatctcagaaatcaccattaaagaacttatccatgtaaccaaaaaccacctgttcccccaaaagctattgaaataaaagaaaaaaagaagaagtggctgggcatggtggctcatgcctataatcctagcactttgggaggccaaggcaggcagatcacttaaggccaagagtctgagaccagcccagccaacatggggaaacccgtctctactaaaaaaaaaaaaaaaaattagcagggtatggtggcgcatgcctgtaatcccagctagttgggaggctgaggcacgagaatcgcttaatcctgggagscagaggttgcagtgagccaataacktgctgctgcactcttacctgggcaacagagtgagattctgtctcaaaaaaaaaagaagtgaatggcatcaatcgtgaaaggtatcacataaatatgaaaggttacacaactcttttaacctatttgcctagaaaagagtggtaagtagggcttattgagttgttttattttattttactttttattattcatttgtgtattaatttattctttggtgacagagtctcattctgttgccaaggctgcagtgcagtgacatgatctggcctcctaggatcaaacaattcttatgcctyagcttcccaagtagctgggattacaggcgtgtgccaccacgctcggctaattctttttgtatttttaatagagatagggtttcaccatgtcgaccaaactggtctgaaacccctgacgtcaagtgatccgcccatctctgcctcccaaagtgctgggattataggcatcagccaccacgttcagctaatttttacatttttagtagagagggggtttcaccgtgttggtcaggcttgtctcgaattcctggcctcaagtgatccgctggcctcagcctcccgaagtgctgggattacaggcataatttaccgtgctcagccattgtcatttattttgaatttgggagaagatatcacacccatttctatgttctggagcaggaagtctatcttctggagcagcattgcagtctaaatcactccttagttcagctacatccgagttcttatcccaggaccaagaagaataaggaacacagacaccacagagtaagtagagtaggatttattaagcaaaaggaaagctctcagcaaagagaggtgccctgaaagcaagttttcagaaatggggctgagttctgggtcttttatgtggaagaggaaggaaggaagtcttctgtgggttctgcccaaaatgggaggggtaaagttccctcctaagggtgttgcatctgcacatgcctgggattggccagagtgactccatcttggttgttacccacgagtgcctaagtgaaacccaccaaggggctaaaaccacaaaaatgtcatgttaatgacactatgatgakctgggccaaggacacttaggttgatttattccgcctgtgcctaagttaggacagtcccttctgagcaacatcctggcataaggggaagttcttaaccacatttcttcccattagctgcagaggcggtgtaggtackgtcctgctagcgttcttgtgaacactgcccttctccagagaccctccctctctatctgcctaaccagcctctaactgccttctctctcagcaggaagtctatcttctatcttgggatgacttgaaagataacccaataggagcccagaacctaggcatccaagaataagagaaacgaacatgtgtcagatggagaaaacagaaactatggacatcaaaaggctaaattagggccagatatcaaggtcacactggtgcttttaggaaagtgaagtgtaaacagctgagagtagaactacaatgtagatgaggaagcaaaaatgcttagtatagggaaagcgcagaggcagaaaggaaaatagaacccacaagaattgtattttttcttcttccttcttctttcctatttctcaataaatacttacagaatacctataaggcttcattaagtatgtaagcactaagaatatttaatatgtgtcatgaagagtgatcttcaagtaaacatgactcacatgcatctggtgatcttcctaacctgtgtaaaacccttccatttgttgaatttggcaccaaaggctcttaaaggccatttgttgggaatgtgtggataataggctgacttacatctgtaytggaaaaactctatctttgcctttggagaattatggacgtttggttttttacctttagcggatagaagggcagcaagatttgtcatgtgctgtttaaaatctgaatctgggccaagcgcagtcactcacacctgtaatcgcagcactttgggaggccgaggcaggtagatcacctgccaggcctctgtccaggtcaggaatttgagaccagcctggccaacatggtgaaaccctgtctccactaaaaatacaaaacctagccaggcgttgtggtgcacgcttgtaatcctagttactcgggaggctgaggcaggagaatcgcttgaatccaggaggcgaaggttgcagtgagctgagatggcaccactgcactccggcctgggtgatagagtgagacaccatctcaaaaaaaataaataaataaaataaataaaaataaaaactgaatctgggaaaccccagggtcaatttctttactgatggttttaacaagttagatcacctgacttgattatgtggccaaagggacagaaaacccagctggaaacttctgctttaccgctgtgcgtgcgcgcacatgtgtgtgtgtgtgtgtgtgtgtgtgtkttttctcttttccccctacactacacagaagtaagttagcctctcctgaagccaagtttccttgcacttgataggtcaatctggtgatgaagtcgcatcccaccataaygaccctggggaatttgtgtttattgttgttttaagctactatgttattggctaatttattttttttatttttatttatttatttatttatttgagacagagtctctctctgtcaccaagccagagtttagtggtgcaatctcagctcactgcaatatccacctcccgggttcaaacgattctcctgcctcagcctcccaagtagttgggattacaggcgcatgcccagctaatttttgtatttttagcagagatagagttttatcatgttgaccaggatggtcttgatctcctgacctcgtgatctgcccacctcggcctctcaaagtgctgggattacaggtgggagccactgtgcctggctgttctgggctaattttctatgcagcaatagatagatagctaattaatcaaggtatgaatctgggtatctggatgaaataaggctgaatagtacctttattttgtgtttcagagagtttgtacagcccctcacccctgcaccctacacaacataaaagttttgggatgggtgagaagtctgccttattttgtatgctaggagaagggggactggaatactagcagaccatagacacattcccaggtaggtcaattttacggagtgcaaatggaagctgagactcagaaattggtcctttcaagctgttcctgcccatgtacatcatagaaattcttcaagttcccccaagggtacacatcgcaatttgaccaccattggagaggaggtgctatgccattttgggaaatgctttaaacaggaaacagtgcatgtgattaaataaaccctattcagaaaggttccagtagattcagtttctgcttcttaggctacactcaacacggaaagccatcagaaactagggtcaaggctcaggcaggtctccttgggacaatagaacacatcatgcattggccctgcctcctgcctttgaagtttctcttccctgagaggtrgaagacgggtgtcagattgcatggttcgttttagagarcgttattttttctagaataacttcctggtagtgtgtagrttgtgtgacagagaacttctaattgtttctctcttcctcatacacatttaccaaacacagaacatcttgtccttcacacatttcacatggcaattctggatacatttagtcaacataggacatttcaagacatgattctacaatggctatttcaccagtgcataatcacatttttttaatcttcttttttttttttttttttttttgagactgagtctcgctctgttgcccaggctggagtacagtcactccatctctgctcactgcaacctctgcctcccagattcaagtgattctcatgcctcagcctcctgagtagctgggattacaggcatgcaccaccatatccagctaatttttgtatttttagtagagagagggtttcaccatgttggccaggctrgtctccaactcctgacctcaggtgatctgcccacctcagcctccgaaggtgctaatagctgactttttatttattttttgagatggaatctcactctgtcaccagtgcagtggtgcaatcttggctcactrcaacctctgcctcccaggttcaaatgattctcctgcctcagcctcccgagtagctgggactacaggcgcccgccagcacgcccagctaattttttgtacttttagtagagacggggtttcacgatgttggccaggatggtctggatctcttgacctcgtgatccgcctgccttggcctcccaaattgctgggattacaggcgtgagccactgcgcctggccaatagctgactcttaataaaggacgaagatagcactccttctcagctgtctgcagttctttatatwttggttaactctcatggcttcaattaccacctgtgcatctataacaagatgccaaaagtggctgcttctgttgaatcaaaatcaaggactaacgtcaaaagccgaggcaaagaagaaccaagaaagatatgttttaaagagagccacccatcactggagctagattctacccctgggtttactaacgaacagcagaatgagccttattcatggcagctttcaccctatcctcaactcccgtctatagaaaagaggctggggagaagtggagcagacagaggaaatgagagttgcccttggccatgtggtatttctttccttcacaaaactaagtgagggtggccagacgcggtggctcacacctgtaatcccagctctttgagagaccaaggtgggcagatcatttcaggccaggagttcaagaccagcctggccaagatgatgaaaccccgtctctactaaaaatacaaaaaaattagctgggcatagtggcacatacctgtaatctcagctactcgggaggctgaggcagaattgcttgaacccaggagacggagcttgcagtgagtcgagatctcaccactgcagtccatccagcctggactacacagcaagactccgtctcaaaggaaaaaaaaaaaccaaaaaacaaaaaactaagtgagggagaagcctccagtagaaacgctgagagagactgggggtgcctgcaacaagtagacaggcatttcttttttttttttggagacagagtctcactctgttgtccaggctggaatgcagtggcgcgaccttggctcactgcaagctccacctcccgggttcacgccattctcctgcctcagcctcccgagtagctgggactacaggcacccgccaccacgcctggctaatttttttttttttttttgtatttttagtagagacggggtttcactgtgttagccaggatggtctcaatctcctgaccttgtggtccacccgccttggcctcccaaagtgctgggattacaggcgtgagccaccacgcctggctgcatttcttttcttttttttttttttttgagacagagtcttgctctttcacacaggctggagtgcaggtgcagtggcacgatctcggttcacagcaacctgcagcctccgcctcccgcgttcaagtgattcttctgcctctgcctcagcctcctgagtggctgggattacaagcgcccgccaccacgcccagctaattttttgtatttttagtacagacggggtttcatcatgttggccaggctggtctcgaactcctgagctcaagtgatccaccccccacccctcagcctcccaaagtgctgggattacaggcgtgagctgccacgcccggccagacaggcatttcttgcctcaactgaaccttggcttcgagatggcagcacaagagagagggcaaccttggagtagttgctgctgcttgctggttgggtggcagggatacacatgttttcttggaccttagctggccccaagacatagttggtcaggtaagggaactccagcagtaagagtcagaggctaggcagggtgtgggtggggtggaatgggagtcaagaaaatgaaagccagatttcacctcagtgtggtagaggaaataatgaagttgactctatccccgcctcctgaccgccacctcttttggttcctcaagctgtagctctaagcaaggaatgaaggatagtgtcttagtccattcaggctgctataacaaaacatcataaacagggtagcttgtaaacaacagaaatttgttcctcacaattctccagaaaagttgaagatcaaggcaccagcagattctgtctggtgagggcccactccctggtccacgaaccctcatgtggcagaaaaggccagggtctctctgaggcctctttcataagggcacaaatcccatccatgagtgccccaccatcataacctaatcaccttccaaagctctcacctcctaacaccatcaccctggcagttaggatttcaacatacgaattttggagggacgtcaacattcaggtcatagcagatagggaagttttgaattaggtatgtgattgtggttttcagctggactgaactcagttttcacactgaaagtgaggaatctaaatggaaaatcatgatatctgtccagcatgttgttaaagtataggaaaaggggatttagtakaatatggttgaaagcactgatttgaggaaaaataattttttcatatatactccccactgagttgagactcataaaatggttactggttgaggacaccaacgttttctagctacagattctcagtggcctcctgggcatctccattgggataccaggtcaggctctgtacagaagagcagagatagcagtcattggtgtgcgcccaggagccaggctgactgggtgatttctcagctctacacttagctagctctagaacccttggcaggttgtttaacttctttttgcttcggttttttcatttgtgaaattaggataataatagttctttatgatatcattgtaagggataaatgatttaagttgttggagcatagcaaatgatggaccagggatttaaacccagttttatgtgactctagagtctgtgctgtcaatcactggatatacccattgttaaaactgattataggccaggtggagtggctcatgtctgtaatcccagcatgttgggagactgatgcagaaggattgtttgagcccaggagttcaagaccagcctggataacatagtgggacttggtctccacaaaaagaaaagaaaaaaaagttagccaggcatggtggcatgcacctgtagttctagctagctacctgggaggctgaggtgggaggatcacttgagcccaggaggtcaatgctgcagtgagctgtgattgttccactgcactccagcctgggtaacagagcaagaccctgtctcaaaaaataaataaaatagattatatgttaaaagcatattttgtgtgtgtatatacatatatacacatatatataatatgaaaatatattattaaaattatttccaattaattttatgtttctttttccttatttattgtattttattattatttttgagacaaggtcccaatctgtcacccaggatggagtgcagtggcacgatcatggctcactgcagccttgacctcctgggctgaggtgatcctcccaccttagcctcccaagtagctgggactacaggtgcacaccatcacacctggctaattttttttctttcattttctttgcctttgtttgtttgtttgtttgttttgtagaggtcccagtatattgcctaggctcatcttgaagccctggactcaagcgatctttccaccacagcctcccaaagtactgggattagaagcatgagccactgtgcctagccttttcactttttttttttaaagaaaatgtggctattagaaaattcaaaattacaaatgtagttcacattctatttctgctggacagtgcagctttgggctttgtcatcccttgaagtgttctaaaatggtaaacatctcacctccaaattttttttttttttttttagatggagtctcaccctgttgtccaggctggagtgcaatggcatgatctcggctcactgcaacctctgcctccagggttcaaacgattttcctgcctcagcctcccaagtagctgtgattacaggtgcccaccacacccagctaatttttttgtgttttttgtagaggtgggggtttcaccatgttgtccaggctggtctcgaactcctgaccttgtgatctgcccgtctcggcctcccaaagtgtcaggattacaggcatgggccatcgcacccggccaaacttccaaaatctttttttttttttttgagattgcagtggcgcaatctcggctcactgcaagctccgcctcccgggttcacgccattctcctgcctcagcctcccgagtagctgggactacaggcgggcaccataatcatgccactgcactccagcctgggcaacagagtaagaccctgtctaaaaaaaaaaaaagaaaaaagaatgaaagaaagaaagaaagagagagagagagagaaagagaagagaagaaagaaagaaagaaagaaagaaagaaagaaagaaagaaagaaagaaagaaagagaagaaagaaagaaagaaagaaagaaaataaactggccaggctcatgcctgtaatcccagcactttgggaggccaaggtaggaagattacataacactaggagttcaagatcagcctgggcaatatagcaagacccgttctttccacagaggtgaaaaattggccaggcatgatagtgcatgctgtagtcttaactgcttgggaggcggaggcaggaggagtgtttgagcccaggagtttgaggctgctgtgaactatgattgcaccaccaatctggaatgtacactagaatctttatagtgtatatgtattcctcaacaatacatcgagctcctgaccttgtgatctgcctgccttggcctcccaaagtgctggtgctgggattacagtcgtgagccactgcgccccatgtgaacttttaaaaatacattcctgagtcctatctatgaattgccttttgcccatttttctgtgtatttatttttccatttttattgaagttaaataaaatatattatgggtaataatccttccagtgatatgatatgcagatatcttcgttttgttggtcatttcctttggcatcatctttcatttactttatggttatcttttgatagatgctcttcatttattgcagttcaatttctcaatcctttcctttgtcctgtgtttttcacacattgtttaataaatattttccccctctagtgtcttaaaatattttcctattttggcttctaaaagttgttataattttgccttttacatttagggctttaattctctgaaactgtgtttttgttgctgttgtttcagaaccattttcccaggagccatctttttttctcctctgatctgtggtggtgttccaccccagtcatgtttctgtgtatgcataggacttcattcctggttttcctttctgtttcatagacctactttttaaaaaaaccctatagctaatactaaatttttttttttttttttttttttttgagacagagtctcgcagtgtcgcccaggctggagkgcagtggcgcaatctcggctcactgcaacctccgcctccctgcaacctccgcctccctgcaacctccgcctcccaggttcaagcaattcccccgcctcagcctcccgagtagctgggactacaggtgcatgccactacgcccagctaatttttgtatttttagtagagacagggtttcacagtgttggctaggatggtctccatcwcttgacctcgtgatccgcccacctcggcctcccaaagtgctgggattacaggcgtgagccaccagcacccggcctactaaatcttacaaacaagagtgtttgactgtgcttggccctttattcctgtataacactttttattgtttatttaggtggttttataactttgacaatcagtagtttgttctcattcacattgactgtagattttttaaagtggtgacaggtacatgagttaccaaggtagagagcttgtttggtgaatcttcatcctcattacatttctggacaatgcatatggagacggtatgggacactccttattcctttggcccagacagcttccttgagcctgctgtccatccacacatttggagtccccatcaccctatggcaaatttctgaatatcttagacagcttgaggggcatgcttcttggagctcactgcatggatgcaattatgaatattgatggcagtattcttaggtcaccacctgtggatggcaaaatggcccttcttcacctctcctttctttgccagcgccattctgccaggttcaagttgaaaagaaagactgtgagcaattccacaatactttcagaatcagctggagatattgatccttcttatccaaaaataggttatgtctctcaacttatttaggttttctttaatgcagctcaataagattttataattttatccaaagaaggatttatatgcctttcgttaggtttattcctaagcacttgaaatttcttgtaaaatatgtctgttctgtgtgtattttcccccaatattttattattataaactttcaaatgcaaggaaaattttaaaagtacaatggaagccaggagtagtggtacactcttgtaatcccagaattttggggggctgaggtgagaggatgacttgagcccaggagttgaagcttgtaatgagctatgattgtgccactgcactccagcctgggcgatggagcgagaccctgtcttaaaaaaataaataaatgaaataataatacaatgaattagctacatgtccttcacttagactcgatcactgttaatttcatcatatttgtcttaacatctgtctttgtgtacgtaattttgggaggctcattttaacaaactgcaagtggtagagtcatcatttgtaactagaaaatctaattttagggacacaacaagatgttccaggcataccttatattttctttactttttcttttcttttcttttttttttttttttttttgagatggtgtcttgctctgttgcccaggctggagtgcagtggcaccatctcggctcactggaacctccgcctcctgggttgaagcgattcttctgcctcagcctccagagtggctgggattacaggcacatgtcaccatgccgagctaattttttatatttttagtagagacaaggtttcaccattttagccaggatggtctcaatctccttacctcgtgatccacccacctcgacctcccaaagtgttggtattacaggcatgagccactgtgcccagcctgtattttctaactaagcattcacaattgcccatttcttaccctctgctttgtcttaaccaaagccttctctttttcctatgggcccctgaactctgcttgcctccagatctgagcaaaaagaagtagaacttgccctttatcagcttctcctgggagtcggctaatcacatcgagcccactttcctgtcagatctactggtcatttcttcttacttatctagcttccccttaaaagaggctcttatctctgcttcctctcccctaccctaaaaggaaacttttttctgtttgagtttgagatgcttatacatttctgagttcagagtgctctccctatttgatatggttaggctttgtgtccccacccaaatatcatcttgaattgtcatccccgtaatccccatgtgtcaatggagagaccaggtggaggtaattggatcatgggggtggttcccccatgctgttctcatgataatgagtgagttctcacgagatctccctttgctcagcacttctccttcctgcctccctgtgaagagatgtcttctgccatgagtgtaagtttcctgaggcctgcccagccatgcagaagtgtgagtcaattaaacctcttttctttataaattacccagtctagggcagttcttcatagcagtatgagaaccgactaatacactattacaatagtctttctctctagttaaattatttccctaggctggttgcagtggctcacgcctctaatcccaacactttgggaggccaaggcgggtggatcatctgaggccaaggagttcaagatcagcttgggcaatatggtgaaaccccatctctaccaaaaataaaaattagccagtctcataacccagtctcaaaaaaataaataaaactttaaaaataggccgggtgcaatgactcacgcctataatcccagcactttgggaggtaaagcaggtggctcatctgagatcaggagtttgagaccagcctggccaacatggtgaaaccccttctctactgaaaatacaaaaattagccaggcttggtggcacgcacctgtagtcccagttacttgggaggctgaggcagcagcagaatcgcttgaacctaggaggcggaggttatagtgagctgagatcatgccactacactccagcctgggtgacagagcaagactctatctcaaataataataataataataataataataataataatawtaataawaaaataaaataattttaaaaaatgatctccttaagtccagatttatttttattggacatttctgtgccccagacctggaatgggccatttttccaatgaaaagsaaattattcmttttagtgtgtactggtttatttttggtgccagctgcttcctcttgttgttttcttcccccagcaccaatctggcactggagtcatacctccctggaggtttcaaaagccttttttttttttcttgtaagtgtttgccccttgtattctttgaataaaaacattatgtgggcagggaccatgctttattttttaattgaggacgtatattttatgtcttatgtcaccgagtggaaatacagcaaactacctggcctctcagatttctgccttcagttccataaatcctcttaaactaagagagtcacccggtcactttcggatgggacagatacctcagtttattyacatttttcctgacttttcttaattccttcttgtgaagtcagaaactgaaaagtctgagattttctgctacttgcaagctaacaagttaccgtgccacaattttttttttttttttttagacagagtctcrctctgtcgcccaggctggagtgcaatgcagtgatctcggctcactgcaacctccacctcctgggttcaaggaattctcctgcctcagcctccagagaagctgggattacaggcgtctgccaccatgccygactaattttctgtatttttagtagagatgrggtttcaccatgctggccaggctggtctcgaactcttgacctcaggtgatccagccacctcggccttccaaagtgctggaattacagacatgagccaccacgcctggcccacaaatttttatatacatcgtgttagaaaacaggagatctctgagtcagagacaaagacgtgtattcacagtaaaagcagcagccaaggtgacttcagagcttggrttccctgagccccaattcccataaggcaacatagggagggccagatggtacttacaggtgctttcaggtgcaatacaggaggcgaagtctgagtttaggaggctcacattttgcatagggctgcaggaaaatctgcccatcctcccttccagagagaaacattctacactggaatgtgagcaaatatttctggggaaagatgtctgtaaatctctcggtgaaagttaccgttttgatctttatttatctaggaatgtaaatacatttgcttcaggggaagtccttgtctttatytctccagggctgcctgcttgcactaggcattcctagaaagataatcctggcacacaggagcgaaacatgtaggagtgctgaagattcacagacagtcgtctcaatgtctctgaagttttttttcccttaaacttctccttttggacattccccttcattttccttttaaaaatctcatcctttccaacactttcagttgtaagaatttccawatcaagcactcaatatcaaaacaatgtgtgtgacaaacttaaagtgttgaatctgactatgtcagcagaaagcataattatcgatgatgtatgggacagcaatcttgaattaaagaagaaggtgggaaagccccaaatctctcataaattatgatgatgatgatgatgatgatgatkatttagcacacctctgctggcaggaaacaatttattttaaagatgacctgttacattaggtatttgtattgaatgttaccttatgtgttgaaaagggagtgaagagagaatatatatgtaatttcttgtgtatggataacatcgatgtaagtacaaccaaaataccaatgtaagatctgtacaccaacctaataacatgagcatgattgataggttgatcagtagtttggcttattgttcaatgaatatccactcccctctcccttctactgtrggaagattatacttcttgggcctggccctgtgacttgctctggcaaatgtactactaatggaaagacaggagagagaccttgaatatgtttgacttggctcttggtttgacatagctctcctagtcctgccattgttcataagaacaacatgtcccaccagcactgcttcttcagcctgggtcccagaataagactcasgaaacagatatgagcacaacctgaaccccagagcctaggcatctgagtgtcagtctgaggcacaattatcagctgacctgcagatctgccagtaagataaataaattcttggccaggcatggtggctcatgcctgtaatcctagcactttgggaggttgaggcaggtggatcacctgaggtcaggaattcgagaccagcctgacaaacatggaaaaactccatctctgctaaaaatacaaaattagccaggcgggtggtgcatgcctgtaatcccagctactcgggaggctgaggcaggggaatcgcttgaacccaggaggaagaagttgtggtgagctgagatggcaccattgcattccagcctgggcaacaagagtgaaactccatctcaaaataaaagaaaaataaattcttaaattacctgggcatgttggtgcatgctataatcccagctactcgggaggcagaggctgaagtgagctgagatcacgccactgcactccagcctgggcaacagagcaagactcctaaaaaaaaaaaaaaaaaggaattcttgttgtaagccatttggttttggtatgtatgtgttttgttgttgttgttattgttttgttttgtttttttttttgagacggagtcttgctctgtcacccaggctggagtgcagtggcgcaatctcggctcactgcaagctctaactcctgggttcacaccattctcctgcctcagcctccagagtagctgggactacaggcgcccaccaccatgcctggctaatttttgtatttttagtagtgacgggtttcaccatgttagccaggatggtctcgatctcctgacctcatgatccgcctgctttggcctcccaaagtgcgggattacaggcatgagccaccgtgcccggccctaaaaaggggaggcatgaataatccaccccttgtttagcatatcgtcaagaaataaccataaaaatgggcaaccagcagccggctgctctgtctatggagtattcttttattcctttactttcttaataaacttgctttaactttattctatgaatgtgccctgaattctttcttgtgcaagatctaagaacactctcttggggtctggattggaacccctttccagtaacatctttctgacgacccagaggggactatagtgtggaaactcccaactcaaaggctaactttggttaagtgttggggtctgataacatctttctcatgaaccacaartgggacaatactgaaaatacttctcaacccaaaggaaacagactgcagcactaattggccaactttgggtaattggggtacccaagtaaaggatgggattgggttagaggtgcaacttaggggagttagagtctctcctgaaacagagtgggttagagactcatcttaataaaaggcaagaacgcttaaccaaccttgggttagaggcccaaattagaagagttatcccttctaagatttagggagttagaggcctctctcagtaaagtccttctyggctaagaatgggtttgacactattaactgctattctctttcaaataatctgccttgcactctttgctgacagctatgggtgacaggattaggcatgaacaggatcgtgggacatggggagctttttcttccctaaaaggggaaacttgagagctgatgggactgctgaaaaatatcccttcacagctgacaagcggccacctgaacttttgattcagtgttgctggaatgggtgggtctttctctcaactccctgagatcttcaccttccccatcctgccacaggcaaggcttttctctctctcctttccctttcttattttttctattactcagggtaaccatcyttcccagagatcacaagtcaaaactctctggtcagaggttggattaaygatgatggggyccaacagggggcaagtttgagccttgccagtttgatattgggtgctaagcagagtggcaggtcataaactgcttctttgacttttacaaattgttcaatttattttattctattttatttatttatttttgagatggagttccatgctgttgctcaggctggagtgcagtggcacaatcacagctcaatgtaacctctacctcctagattcaagtgattctcctgcctcagcctcccaagtagctgggattacaggcacgtaccaccatgcctggctagtttttgcatttttagtacagacagggtttcaccacattgtccaggctggtttctaactcctgacctcaagtgatccgccccacttggcctcccaaagtgctgggattacagacctgagccaccatgcccagcctcaattcattttaaagcattaaattctagataaggcctggggatatatgggattagccatgccccctagctatacaaagaaggttataaagaaaaagattttatataacaaaggatcttgtatggtaaattcttgttctaaagtaaaatggttgtttgacaagaggtatgtttaggacaagtccraaagtccaagcatgtcataaatggtctgtgtaagtcataaaaatatgaaaataatttatgcaaaaaatgttgtacaatttaaaggtaattaggcttcctaaatgtgtcataaaatgccactataacttgtaactgtaaaactttcctgctttacagctaggtaaggcctgggacacgtaaatgctaaaaaaaaatcagaccttatctgcacttctgtctgctgtcctcggctccatacctaattaaaaccctgaacttaccaaggttttcaccaaaagttaaagtcactaagagttaacagtgtaacatgtatttgtgactactgaagaaacagttttacatgcaaggtgtgtaagaaaagtaaactttgtttttagtaaaaaattataaaaaggcatgggcatgtattttttttgcctaaagggttaaaggattgctttaagtgaaataggaaaattctaaaggtttaaacaagttgtaaacgttttataaaaaaattaattataaaaaaaatctatgtgtgaacagattggctaaagttaaaggggtattattcagttttaaactaaacattggaataaaagcacaacaggtttttcttaaagcaaaaacctgcttttactctgctctttaacaaatattgtaaaggtagttataaaagaggtttataaaaatcttaccttatggtcaaactgattaaatacatttgtctataaggttttattaaaaactgggtttgacagtaatagtacactaatgtaaaagtgacatttggcttattttatataaaaatcatacaagaagcactgtcaaatataaaataatgtttagcttctttgggctatatttgtataaatatgttattggtatgtgttccaaaataattctaatataacttagtgtatattattaataattataattgttacataaaatcattgtatgccacagaggtaaccaaatttctttgtcaattgtgtttttaactgtgactgtcctaagacattttgtcatccacggacacttgttgttttattcctctttaaaaaaatggtttataatcagctataggactctaacaggtgctcttaaattcaggtttctaatacctttgaacactgtaatattaaaatacaggaaaaaactttcggactcayggaaagctgaaatgttcataaatatcaaacaggaattaactgcatggactaaactaatagaagctatttacagcttttaacaattaagtatactcctgtaaacaaaacgtggatcatatttgtttctctctaccagatttctctaaaatatggaaactatttgtaagtattcttaatttatggcaatatagttatttgcataagtgcaataaaaatccattttcttttgtaacaggatgcaattggaaaaactggttattttaccaaggctttaactggaatggtgtgttttcctttaaggaattaaatttaacttatagggccaatacaagtcccttgggagaactggcctcataccttgcctacacagtccctgcacagggtttctgacctgtgataagtaaagaatgtcactttctaacaggcccagaagccccaggttatcttggaacctcaagaggagaggaatttacctagctcataggtatttaagcatacaaaccaatggcagggctcggatctaaaaaaatcttatctaagattccttctatggaacagagttccaatttacaaaaagcttatgtgaaaaataattattcttgctacactttatrcaaacaatcaggccaagtataataaagcaagttggtgttaccataatttgtctttaataaaaatgggaaactggagacagaaaacttaatgtttcaagaactgtggtacacttgttattaaattctagtctcatcagttgctttaaatttttttccctgcaaattaaactgactctgcttattcctgtaaatcaaccagtaatctctaactgctgctcaaaagaaacgagaggatgggtaatgtcaaaatctgaatcaatatctaattctgggcacatactggaatcatctagcaaccccctatcagcttggttctaacacttgcccagttgatagaaagccttctaacttagttaagttgggataattttgcttatgttgttttagtgtggtgaaatatattgctgttgtactctttgtatagcaatgcaaaataagcttactcaatgttttcttaaacacttattaatcttccaaatatcaccttttgttggaactcaaaagttataaatggccctcaacataccaatgctttctttctttctttctttttttgagacaaaaatctcactctgtcacacaggctggagtgcagtggagcgatattaactcactgcaacctctgcctccttggttcaagtgattctcgtgcctcttcctcctgaatagctaggattacagacacccgccaccacgcctggctaatttttgtatttttagtagagtcggggtttcaccacgttggccaggttggtctcaaactcctgacctcaggtgatctgcccacctcggcctcccaaagtgctgggattacaggcgtgagtcactgcrcccaggccaatgctttctaactaagctcctctctaccgtaaacacaaaagaccctaatagttaggcaggaatatcattgcccctattcagcataaagaagttacagaaaatggatctttgtccctctgcagcccttaggattaagggttctcttataaaaggaaggtgggaaatgtcagaggcattggaaccagagcaactccatcttgaaaaggggctgggtgaaataaggctgagacctactgggtggcattcccagacagttaaggcattctgattcataggatgagataggaggtcagcacaaaatacagttcataatgaccttgctgataaaacaagttatagtaaagaagccagctaaaacccaccaaaaccaagatggtaccaagagtgacctctggtcatcctcactgctacactcccaccagtgccatgacaacttacaaatgccatgacaacrtcagaaagttattatatatggtctaaaaatgagaggcatgaataacccaccccttgtttagcatattaagaaayagccataaaaatgggcaaccagcagcccttggggctgctgtctatagagtacccattctttcactcctttactttcttaatacattgttctcactttaatttacagactcgccctgagttctttcttgcacgagatccaagaaccttctcttggagtcaggatcaggacccctttccagtaacaaaagtagattagagattatcagaggttggggagttattgcttaataattagagtttattttgggcatgttgaagtttcagaagtaaatagtggtggtggctgctcaacattgtgaatatcattcattaataccactaagctatacacttaaaaaagccaagatggcaaactttatgttatacatactttaccacaatttgtaaatgaataacgaattagccaaaatatattgaaatgggtgaattgtattgcatgtgaattatatcttgacatagttgttagggacaaaaagggcattcacaatttcaaccttgctgaaaagacagaattctgcagtgctagtaagaagagttaggacacgggataagattgacatgcaattatttagtaagtgtatgcaagcttaaaatccaaaaaataataaaggaaacgcgaagccagtaattgaggacagagccactagtctcctacttttcatgttttgctattcaatacttgctacgagaaagactatttggctaacttcctagaacttgtaacattgtcagtgcccagctaccttaatattccagggagcattgctgacactgttttggcttttgcatgatgagtaattataatgctataagagaggcaagcctgagtcctgggattacccctttacctctatttaggtttatctattccattccagtaatagttactcaccrctaytttaaaaaagaaaagaggytttttgacatcagctgttgctattctatatgttatcttctttctgtaagggaaggtacccttatcwccattctggatctgagcctgaaatctggccaccttttcttcattcatgctgatagtgaacctgaagcaggaggctttttcaacactagcaagtggcaacagcaaaatggcagctctgatgaagacagagaatggaccattggcagttagttttwagaaaatgagtttctagattctcaacttctgtctatgctttttcttaaaagagatcttctatcatgctagctctcagatgttacccagtcctactcttccagctccccatttatrtccaagctcctgctactgatatacacccactatggtgcattgcttatgggaggaggaacctccagggctccaggaaagatacatttctaaatatcagtgctggccagtgaggaagtggatgactctgatgatggagtaatgcatcttttgcaagttagatgtttcccaattctttgctttcaacaaaattgaaagagagctgagaaagttgacataccaaatttcattaaaaatcaacttttgataatcagtaactatgtgggttttggcatatacttcagaaagagttcaaataattgaatgaaatcactataataaaaccccttctattccattctacctatttatgctacaaggagtccaataaaaacaaatccatacttagataaagaaaggcctttttcaaaaagacttatgtaatgggggtggcagggggaaagctattgtgaaagaatactccactggagcaaacaaggttagaaggaacagagtatgggggaaatggaatcagagagtggcacattggacaatttttctttgcartcagccaattctggaagggtcattaaggaggttgttccacattccaatgcttgtttaaactcaacagtaggccaaagttcaggggcctcaggggaaaagagaagcctaactagagtttggtcaggtcagattagcaggtattttgtccagactggtcagtgcaaacagttcatctaatcatttatgagataaaataatgggaatttggagagcctgtgttgtctttgtcttaggtaaacaagggggtcgtcatccattggtcttatctaaatcatatagggaagggtggatttttgcagtaagccattttcaggaccgcaraagagtggagggatttttaaactattgctattttccaggagtatgatgctcaggtaaagttcaacattgccaacctttttgtttgtttgtttgtttgtttgtttttgagatggagtttcgctctgtcgcccaggctggagtgcaatggtgcratctcagctcacagcaacctccgcctcccaggttcaagtgattctcctgcctcaggctcccgagcagataggattacaggtgtctgccaccacgcccagctaattttctgtatttttagtagagatggagtttcactatgttggccaggctggtctcgaactcctgacctcaggtgattcacctgcctcggcctcccaaagtgctaggattacaggcgtgagccaccacgcctggtcccattgccaaaggtttacatggatttgatgctgaaccctgtgcattttattaaaaagtcatgagcatccatacgacatccatttcactaaaataagtatttccagtaatgttttacttccatattggagcacccactaactcagctattagtgttaagttcaggaatgacagaaggactcattagatacaatttgtttccataatatagatgcttattccatgcaaactgcttcattatgmagaatccacaattacatttttggcatcctgatcattttatctaaggatccaagatcacaaggatttcttaagcagttgctgttatttttcaacaaaattactcaacttctttatactataatgcttgtcctctgtaacgccttgcatgcccctattgggatctgggctagtttgattaaggagggatctcagtgggatggcagtgtgatttaactatgttgtccctccctttccctcacaggtactagggaagctatgaagatcagattttgctaggcttagagctcttggctttcctttcccttctctttgtcaatgctttcatttccaaaaaagccataagaaacgaacatgggatagtatttctagcttttccctgcactgcttgcttctcttttttcaacccatttaatcagttcttagtgaattagatcaatgtttttttaaatttcactgataagagcaattcttggatggagtcatatcaaacaacatgatggttaagcaatctttcaggcatcaaaattatttgttccctattcatcttcttacaacataagggttttttgcctctacggggtcagaggtcttcgtatcaattgccactttatttttaatttaatttttctttttcatcactcccaaagcaccggaatcaatcgccacttttgatacaaacctggattgatggaaagactaacaaaacaacgcagtttcttttttcttttctgagatggagtttcactcttgttgcccaggctggagcgcaatggtacaaactcggctcactgcaacctccacctcccgggttcaagcaattttcctgcctcagtctcccaagtagctaggattacaggygcccgccaccatgcctggcttgtatttttagtagagacagggttttgccatgttgcccaggctggtctcgatctcctgacctcaggtgatccaccagcctcaacctcccaaagtgctgggattacaggcatgagccactgcgcccagatcaaaacgacacagtttcaataccagtttacttattttattcaaaggatgcaggacaggtagttcagcatccaagcaagcactgctttgagcaaaaggccttgcaatatcccaggcacagyttccaagcttatcatttcatgggtcatgctcagttacaagggatgaaggtaaagcaagatggaccaccttggcactgsgaagctcttctactatctgctctttgactttttataacttattagtcatatcattcctcagggtgtgtataacttaataaataactttttttttttttgagacagagtctcactctgttgcccaggatggagtgcaatggcccgatctyggctcactgcaagctccacctcccgagttcaagcaattctcctgcctcagcctcctgagtagctgggattacaagttcatgccaccatgcccagctaatttttgtatttctagtagagacggggtttcaccatgttggccaggatggtctcaaactcatgacctcatgatctgcctgcctcggcctcccaagttgctgggattacaggcgtgagccatcacgcccggccataaataacattctttgggagcagctgtagcacctcaatgaaaggttatacaacaaatagccccaacaaccagatacacttcaggtggaaaaagcatggtccacacaacattctacacttaccrtaacttagtacattttgagaactaattttgcaagaaagtaaattcagggtcagcttcccaggtgtccctggacctggaccaagagtttcaattctctgagaattgtttctcttacaatgcttaacaattattttttaaaagtgtatttactttttgtgattgtttgtttattactaataactgtagtgatcatttaatccagaagaaacattgaccacttagaactttaagatcggctgggtgcggtggctcacgcctgtaatcccagcactttgggaggccgaggcgggcggatcacgaggtcaggagatcgagaccatcctggcgaacactgtgaaaccccgtctctactaaaaatacaaaaagttagctgggcatggtggcgggtgcctgtagtcccagctacttgggaggctgaggcaggagaatggcgtgaacccaggaagcggagcttgcagtgagtggagatcacaccactgcactccagcctgggcaagagagcgagactctgcctcaaaaaaaaaaaaaaaaagaactttaagatgacaggaaataaaaacaatttaaaataatttcaattcttagacacatttttgctcagagaaatatgataagatgattaataaaagacttttgaacacatattaaaatcaaattttgtgaggaaaaggaatgaaaaatttttcaaagataaaataaattatataaaatgtctgtctattgaagaagagtgttattttctctcttgtatgatgaatgatggaatataccaaaaccctatgctaattagatttggtagatacactttaagaagtaatataacgtctgtttttatttatttrtttatttagacagagtcttaccctggtgcccaggctggagtgcaatggcacaatctcggctcactgcaacctccgccttctgggttcaagcgattctcctgcctcagcctcccgaatagctgggactacaggcacacgccaccacgcctggctaattttttgtatttttagtagarcyggggtttcaccatattggccaggctggtcttcaactcctgacctcatgatccagtcacctcagcttcccaaagtgctgggattataggcgtgagccaccacacccggccagaaaaagtaatataacttctatttttaaaagtcaatatttacattatgcctcaaattatgttctttgaaacaagttagaagtaggtgaggaagaacatatctttttgaaattattttaggtgtactgagaaaaagttaagtttaacagagagaagggatgactaaattatgttaaactatgtgactatccgagggttcttttagtactctcttaatctagccatagcccttagatctatcctcacmgtaagaaacacatgtttttctccaattactttaggggckactactgtatgtcaaagatcatgtcacttgattttatttatcttttcrttgcaacactattcacaacttgtcacttttkaaaaaacacaaggtcagttaggtagatcacatgactattcttagtttttcatactctgtatccaaattttacctttatactctttgccrtgtgactttgcagttctccccactagggaagggatgtatttcctgtgagttactttgactaatgaaatatgagttgaggccgggcatggtggctcacgcctataatcccaacactttgggaggccaaggcgggtggatcacctgaagtcaggagtttgtgaccagcctggccaacaatggtgtgaccccatctctactaaaaatacaaaaaattagccgggcatggtggcggacgcctgtaatcccagctacttgggcagctgagacaggagaatcacttgaacctgggaggcaaaggttgcagtgagccgagatcacaccactgcactccagcctgggcaataaagagcaaaactccgtctcaaaaaacaaacaaacaaacaaacaaacaaataataaaaaaaagaaaagaactatgagttgaaggaayggtgtgacagttcttgcttcaagagacaataatttccgatatgttcctgcgattatttatttatgtatgtatttatttattcttttttgagatggagtctcgctctgtcacccaggctgaagtgcagtggcaccatctcagctcactgcaacctccaactcctgggttcaagcgattctcctgcctcagcctcctgagtagctgggattaacaggtgcgtgccaccacgcagggctaatttttgtatttttagtagagatggggtttcaccatgttggtcaggctggtctcaaactcctgacctcgtgatccgcccgccttggcctcccaaaatgctgtgattacagccatgagccactgcacacagttgttcctgtgatttttttaacgaagatttaggagtttttcctttgagtgagaaaactggcgatatttgaataatggctgaagaatagtattgtatgaatgttaatttcccggttatgatcgctgtactgtgattgtgtaagatgttaacaccagggaatgctgcgtaaaagatatacaggaactctgtactattttggaaacactgtagtaagtctaaaattatttcaagacaaaaagtttacaggacatgccccagttagctgctggtccaaagaactgaggaaacatgttgagcagtcctgaacccaagtagaagcctrgagccacactcaggcaccctatagcctaaagcaaggttgctccagcccatgcaaagatccatgaacttgttgttgtaagtctgagacataggaggtgtgttatgaagcattattgtggtaataactgactgttttagtccattctcacactgctgtaaagaactgcctgagacttggtagtttaaaggaaaggggtttaattgaytcacagttccgcagggctggggaaacctcaggaaacttataatcatggtggaaggggaagcaaaaccttcgttcttcacatggcagcagcgaggagaagtgctgagcaaaagcggggaaagccccttataaaatcatcagatctcatgagaacgcactattatgggaacagcacgggggaaaccgccctcatgattcaattacctcccacagggtccctcccatgacacgtggggattatgggaactacaatacaagatgaaatttgggtggggacacagccaaaccatatcactgatgaatataatggagttgaaatatcttgtctttaatttgtatgtgcacatatgtgcatgtatgtctgtatgcccatgtattttaatccagcacctctttattcatgcattagagtgacagtcagaggtcctcaataattgatgagttttcctttgagaatgaaataagagagatttgataacttgattaattcatagacaccaccttaactaagtgatcagagttaatatcaccagtaatgagatatatcaacataatataatcccttacataatgcaccaagaagggggcaacatacctgctgtggaattcttgccaaaaatgcataacctcaatctaattgtaagaaaatatcagacaaactaaattcagctactctctgtaaaataactaatcagcagtcctcaaaagtattaaggtcatgaaagacaaagaaagactgaggaactgtcacagattggaatagactaagaagacatgatggcttagagaaatgtaagatcctggattagaccttggaccaatgaaagaacattagtgggaaaactggcaatatttgaataacggctgaagaacagtatttagcaatgttaatttcccggttttgatcattgtactaggttgcgtaagtgttaacactagaggaagctgggtaaaagatactacaggaacgctactattttggaaactttgaggtaagtctgaaattatttcaaaatgaaaagttttaaaaaacatcaggaatgaggccatttatctttagagtaatacattttaaggaatctttagggtttccatttaggataatatttgccagacctcatgaaattaaatcaaaatctctgaggtgggagtgaggcatcggtattatttttaagccctttaggcgatcccaattgcagccaagtttaataacaagtagtatagacaataaccatcaaatgaacaccagtgtacccaccacctagtttaagaaatacccagttttgtttgtttgctgrgatgtcaaggcaagaaatatctagttttaagaaatacgctgtagactcttccctgatcctgcctgcaaatttctccaaccatagttttcctcattctgtaatcaagtttaatttaatttaatcatagtttaatcaaatacacatgtatccttaaaacatatagttttaaacatatacttttatttttacacgtttaacttaatatgaatgaaaccaacattataaatatatttttggcagctagctcttttcttactcaacattatgtcaatgaaatgtatagattttaattcatgtagatgtagtttattttcattgctttcagtattttattattttgttatatcaggatttgtttgtccattctaattgagaacataagggctgtttctagttttttgttatgatacataatatagctttgaacattcttgtttgcctcattgcgcccacatgtaagagtttctcctgagcacatgcccagtaaatggaatttctgagtcatagggcacatccatttcaggtgttctagataatgccaaattggtttccaaaatcaatacaccaatttggagtcctatcagccgtgtgtaaggttgcttattgctccacatccttgccatcttttgattgtgtcaaacttaactcctttttttttttttttttgcaatatggtgggtataaaattatctcattatggtttgaatttgcctttccctgttaagtagtgagactgtgcttctgttcgtgtttctgtgggttgtatactcatgaaatgtatgtatgtgtttttcttccatttttctcacgggttgtttggtatttctttwtttttttcttttttttttttgagacagaatctcgatgcattgcccaggctggagtgcaggggtgatctcggctcactgcaacctccacctcctgggctccagtgattctcgtgccttagactcctgagtagctgggattacaggcacataccaccacacctggctaatttttgtatttttttagtagagacagggtttcaccatcttggccaggctggtctcccactcctgacctcaaatgatctgcccacctcagcctcccaaagtgctgggattacaggtgtgagccactgtgcccggctgagttgtttggtatttcttacttatttgtagaagttagttatgtttttctcagttataattctttgtcaattatgtgccaaatatcttctcccagtttgtagcttatattttcattttcattgtggtatcttttgaaaaccagaagttcttaattttaatataatacaatttatcaatctttccctttatatgattttcttctttttcctgttttaaatgatggactattagaacgtggaactatattattttaaatattatgataaatacatagaatacataatacaaaaaagttaaacaactggtatatatattggataagaaaagataaaatgatatctttcagctgattataagatttatgcrgccgggcactgtggttcatgcctgtaatctcagcactttgggaggccgaggcggacggatcatgaggtcaggagttcgagaccatcctggctaacacggtgaaacccccatctctactaaaaatacaaaaaattagctgggcttggtggtgggcacctgtagtaccagcaactcgggaggctgaggcaggagaatggcatgaacctgggaggtggagcttgcagtgagccgagatcgtgccactgcactccagtgtgggtgacagagtgagactccgtctcaaaaaaaaaaaaaaaaaaaaaaaaaaagatttatgcctgtatatcccaaggactccggtttgaagaaaaaaaaaaactacttgaatcaataaaagtagtgatatggtagttgtattcaagataaaaatacaggccagatgcagtagctcatgcctataatcccaacacttttagaggccaaggtgggagaggattgcttgagtgcagaagttcaagacctgcctgggaaccatgccgagacctggtctctacaaaaaataaaaaattagctgggtgtgtggtgatgcatgcccctagtcccagctactcaggrggctgaggtgagaggatcccttgagcccagaaggtcaaggatgcagtgagccatgatcatgccactctaccccagcctgggcaagagagtgagatcctgtctaaaaaaatttaaaaaaagataaatatgcaaaaggtataaaaaccagtatgttttttcaattcttgaagtagtggcacatgcctgtaatcccagctacttgggaggctgaggcaggagaattacttgaaccctggaggcagaggttgcagtgagccgagatcgcgccactgcactccaggctgggtgacagggcaagactctgtcttaaaaaaaaaaaaaaaaaaaaaaaattggccgggcgcagtggctcatgcctgtaatcccagcactttgggaggctgaggcaggcggaacacgaggtcaggagatcgagaccatcctggctaacatggtgaagccccgtctctactaaaaatacaaaaaaatacaaaaaattacaaaaaattagccgggcgtggtgacgggcacctgtagacccagctgctcgggaggctgaggcaggagaatggcgtgaacccaggaggcagagcttgcagtgagccgagatcacgccactgcactccagcgtgggcgacagagcgagactccgtctcaaaaacaaaaaatcaaacctgcaataaacttatgcatatatatgtttayattgttggaagtttatcttcagggtaaatttctagaaatgagattgctgggtcaaaatataagtgcatatgtcgtttattcagatattaccaaatttctctccagaagcgttgaaccmattttcattcccaccagtaatgaatgagactgtgtatttcccttacagtctctccaacagaatatactgtcagtctgtatttttaaatttttgtctatctaaacttttccaggtaaaaatggtatctcagtgttgttttaatctgcatttttctaattatgaatgagtctgacattttttcatatatttgagagacatttttctatctttttttgtttgttgtctgttcacatcttttcccatttttctgttgagtttttggtcctttgtcctcaaattttaagcattttttatattttaaggattttactccttgtctatggtatatgtgtgaatattttctcctatttttgtcagttatcctttgtccttctttatggtacttttgtcacgcaaatttaagcatttacatatcatcacatttatcaatcttttattacgtctgaattttgagccccagttcaaaagccattccctacactgaagttaaagaggaatctacccgtgtgtttttctaatatgttggtgcaaaagtgattgaggttttgccattacttttatttatttatgtgtttgtttgtttgtttatttttgagatagagtctcgctctgttgcccaggctagagtgcagtggcacgactggctcactgcaacctccacctcctaggttcaagtgattctcttgcctcagcctcccgagtagctgggattacaggtgcgtgccaccatgctcagctaatttttttttttttttttgtatttttagtagagatggggtttcaccatgttggctaggctagtcttgaactcctgacctcaggtgatccgaccacttcggtctcccagagtgctgggattacaggcatgagccactgtgcccagccctgctgttacttttaatggtgcttgaatggtttccttttttacatatagatccctcatctattagaagttgattcttacatatggtgtgaagtattcatctatatatattttccaagtgcctacccatttgttctagcattttttcaaagtctttctttacttcagtgatttgacatgccatctttgccagatacctaattgtatcttgataaataaaagttacttttaatggctaagtactttaaaatattatcttaagttacttttagaatttataaayatttctccctctttttaacccctttaaggtaaagagtcccaaagcagctttagggagggaaaaaggtcacagtgggaccttggcctggccttaactgtcaagacactaagctgatgagtggcagctgtaaagagttgtcctggggactgtgccaggatactttttatattatttttatctctatgaaagcaatacatgtgcatagttttatatgtcaaaaagtgactgggcatggtggcatgtgcctgtaatcccagctactcgggaggctgaggtgggaggattgcttgagcccaggaggttgagaacrgcctcagcaacatagcaagaccctcatttcaaaaaaaaaaaaaaaaaaaagaaataaaataaaataaatgtaaaaatgaaaaaacaaaaagtgaagtgtgaacaataagaagtgtaaatcctggccgggcatggtggctcacacctgtaatcccagcactttgggaggccgaggtaggtggatcacgaggtcaggagttcaagatcagcttggccaagatggtgaaaccccgcctcttctaaaaatacaaaaaattagccgggtggggtggtgggcgcctgtaatcccagctactcgggaggctgaggcaaaggattgcttgaactcgggaggcagaggttgcagtgagctgagatcgcgccactgcactccagcctgtgcgacagagcaagactctgcctcaaaaaaaaaaaaaagaaatgtaagtccttggctgtacccctcccctaaccttgatttccaactagagtttaagccttaagaggggagattagaactaataaataattttagcaaggctgcaagatatgagatcaatacacaaaaatcaatcgtgtttctacacacttgcaatgaacagttcaaaaataaaattaataaaagtttcatctacaatagtatcaataagaatacattatttaggaataactttaacaaaagaaatgcaaaaattatactccccaaactgcaaaccattcttgaaagaaactaaaaaacatccaaataaatggaaaaacattctatgttcatggattgggagataatattgttaagatagcaatactyggccaggcacagtggtgcatgtctgtaatcccagcactttgagaggctgagctaggatgatcacttgagcccaggagttcaagaccagccgaggcaacataggaagaccccatctytacaaaaaatttaagaattagcccagccaggcacaggggctcatgcctgtaatcccagcactttaggaggccgaggtgagtggatcacctgaggtcaggagttcgagaccagcttggccaacatggtgaaaccccatctctactaaaaatacaaaaattagcctggcatggtggcatatgcatgtagtctcagctactcaggaggctaaggcacaagaatcacttgaacccaggaggcagaggttgtagtgagctgagatcacgccactgcactccagcctgggcaagagagcaacactccctctcaaaaaacataaattaaataaatttaaaaaaaattagttgagtgtggtggtgcacgcctatggtctcagctactcaagaggctgaggttggaggatcgcttcagtgcaggaagtcaaggctgccaaggctggtgtgagctgtgatcacaccactgcattccagcctgggtgacagactgagatcctgtctcaaaaacaaaacaaacaaaagcaatactcctcaaattgatctatagatttacagatttgaagatttgatcagaattccagctagttatagaaattgacaaaatgatctaaaattcatatggaattgcaagggacctagaatactcaaaacaatcaagaagaacaaagttggaggactcgcactttgcaatgtaaaaacttaataagggctggaagcagtggcttataccagtaatcccagcactttaggagtccgagtgggcagatcgcctgaggtcaggagtttgagaccagcctggctaacatggtgaaaccccatctctactaaaaatacaaaaattagctgggcattgtcgtgggcacctgtaatcccagctactcrgcagtagaattgcttgaacccgggaggcagaggttgcagtgagctgagatcatgccactgcactccagcctgggtgacacagcgagactccgtctcaaaaaaacaaaaacaaaaaacttattgaaaagctgtagtactcaaacctgtgtggctgtagtctaagaattgtcatgtagatcaattgaatggaattgagggtccagaagtaaacccacatgtttatggtcaacatttttaagaagagtgccagratcttcaaatgaggaaagatctcctgattggctacaagtagacctgcccttatttgggtataaacccatggaaagtccctagttagaagttaattgacagtttctggttggttaagtctctagttttgttttactttttacattgggcctcagtttgcttacataggaacccaaaaagctgagactatctcagcctaatggcctcccagttaaaatgttttgttttgttttgttttgttttgttttgagaaagagtctccctctgtcacccaggctggagtgcagtggcgcaatctcggttcactgcaacctccacctcccgagttcaagcaattctcctgcctcagcctcctgagtagctgggattacaggtgcatgccaccatgtgtggytaatttttgtatttttagtagagatgggktttcgccttgttggccaggctggtctcaaactcctgatttcaggtgatccgcccaccttggcctctcaaagtgctgagattacaggcatgagccaccacgctccrcccccagttaaaatgtttttaacgggcagtattaatatcattccatttcacagctgaagaaactgccttaggctatgtaacttaagatcaaacagctgtaaagggtgaatctgggatgcaaacccagccactgactacagagctctgctcatcttttagactatatggcactcaactcacgtcaacttttaaatgtggtttctttcttttagagcaaattttgcaatgaatacattcttgtaaaagcacttaactttacataagtgtttaaaggaaaacacatagatatatccccaaccttcttttttyttttttytttttttttgtggcagggtcttactttgtcacccaggctagagtgcagtggtgtgatcatggctcactgtagtcttgacctccgggtgcaagtgatcctcctgccttagcctcccgagtagctgggaggtgcatgccaccatgcgtggctaatattttttgtaaagaaggggttttgccatgttgcccaggctggtctcgaactcatgaactaaaagcaatccactcacctcagactcctaatagtgctaggattgcctrcatgagccactgctcccrgccgcaccccccacctttgtacagggcaaagactttgttatgtattcttccagacttttacattttagggagaaatttgtgcttccatcgaaaactgcattttataaattgcatccttcctggttatctgattctatgagagttactttataactctataggtttgttagcaatgcaaagtaattaatactatattgataacaagatacaagaattaatgtaaaataattcttatctatatatatgacaatggtctgttagggggaggccaacccacctgccccaccccaagccagtttgcacaatcatttctacatttstttactccacataaatttcttcttctttgacgcctttgaacaggttataacatctgcctacttttctcatttaattaatacgttaagtaaaatctttagcatttgagaagatacaactataaatatagctatgattcagtaattatgggtttcttacatcactgcccattagtcccctccagccaccagaccagactgattatttatggttttgcttgctttgcttttgttttctaggtggckatctcttaggaaccccagtagtttggacacacacacacacacacacacacacacacacaggcaaggtcacagtcagatccctggcacgttaatttggccatttgcccaggagcagctggtagcaatccttgtgttccagcacttaaatttctcctctcaggttaggatctctgagaatataggaaagaaaaaaaaaaaggagtttctcctagtctctcactaacaatcaacgtagaagactcctgtgacctctgatcaccaaaatgtgtaggggtttcttctcaccagcaactaatcaatcaatcctgaccagttgggtgtcttctaaatcagctcagttctgacactatccacctggagatagcatcagattccacaggttgaggactcaattcccgagactgccctgttttccattcagatgccarttgcaagctccaggttgttttacctgtgcttctgactgaccaagctatacatcgggtttcccaaaaacccctccttgggtttgatkgatttgctacagcagctcacagaactcagaaaaacacttaactaacctttactggtttattataaaggatattacgaagaataatgatgaacaccagatgaagagatgcatagggcatggggtgagggaaggggcatggagcttccaggccctctctgaatacaccaccctccaagaatctccatgtgttcagtcatccgaaaaacctctgaacactgatttttggggtttttatggagtctttgttacataagcatgattgaytaaaccattggctactggtgatcaacttaaccttcagcccctgtcccctcccaggaggttgaggagtagggctaaaagttcgaaccagcaaatcctaccttagtctttcaggtgaccagcccccatcctgaagcctagaggctgccagccgtaagtcaatttattagcatacaaaaagacatttctcactttgcagatttcacagattgtaggagttcttatgccaggaaacaggacaaaggccaaatatatatttcataatatcacagtctctaatttcattgttcagcttctccttcccataagactgtcaagcctctccagaacacagactgtgcagtattgaccattccttctactgtcccatttcttagccctgtcttagatactcctatctctgggagaattttgcttgcataccagtatgtctgttgaagagagctcttaatgctaggtcttttattttatttattatttttttttgagagggagtcttgatctgtcgcccaggctggagtccagtggcgcaatgtcagctcacttcaagytccgcctcccgggttcttgccattctcctgcctcagcctcctgagtagctgggactacaggtgcccgccaccacacctggctaattttttgtatttttagtagagacggggtttcaccgtgttagccaggatggtctcgatctcctgacctcgtgatccgcccgcctcggcctcccaaagtgctgggattacaggtgtgagccactgcgcctggcctattttatttttatttatttatttttttgagacggagtctcgctctgttgcccaggctggagggcagtggcgygatctcggctcactgcaagctctgccttctgggttcacgccattctcttgcctcagcctcccaagtaactgggactacaggcacccaccaccacaccccgctaatttttttgtgtgtttttagtagagacggggtttcactgtgttggccaggaaggtctcgatctcctgacctcgtgatctgcccgcctccgcctcccaaagtgctgggattacaggcgtragccaccgcgcytggccattttttttttttttttttttgagacaaagtctcattgtgttgcccaggctggagtgcagtggtgygatctcggctcactgcaacctcctcctcccgggatcaagtggttctgcctcagcctcccgagtaactggaattataggcatgcactaccacacccagataacttttgtatttttagtagagacagggtttcaccatgttggccaggctggtctcaaacttctgacctcaagtratcctcccgcctcggcctcccaaagtgctgggattacaggtgtgagccaccaggcccgaccaatgctaggtctttgcagtgggtctcatatcattccacgtacactgaggcrcacttgttgccagagaccaaaaactttactgagcaccctttcacccccagcgcccmcttggctgggtctatttccaattcttttagtctctggggctgatgaaatgaagatgggagggtagggcaagagaaacaagaagagctagccaagaagatagaaaataaygattttcagctcactgccacctccacttcccgggttcccgcgatcctcccaccacagtgaagtggtgtcatttgcctgggaaaatacccaaggttcattgtctcataccaaggaaatcgaagacacggacacacaagagatgagtaagagcagaggcttaataggcaaaagaaagagaaaagagaatagctccctctcctgcagagagaggggtgcccgagtrggtcttccagttccatggtgaggtgcacgggttttatagactggcttgaggaggcagtgtctgatttacatagggcccaaagattggttagaccaggtgtgacgtttacatagctcacgaagaagctggccaccccaccttaatcttttattatgcaaatgggttttctacctggccagagccatgttgcctgttccttactggacatgtggttgacaaagaaaagggaagatggagctgccaygttgaacatgcctagcccccaggtaaccttttcctattgtcacagctgccggcattcacccatgcaaggttccagcttgcttatctatgtctgcagctcaattttacaggctgactttttcaaaaagaaatgacttggggactgcttttcattaaaaggaaaaccttactgaggactttcttaccctyactatctgcctaaatcatttctttttaactcctatatcaatagcctcccaagtagctgggactatacgtgtgcgccacgacactcagctaatayttgtattttttgtagagacagggcttcaccatgttgcacaggctggtcttggaactcctgagctcaaagtgatctgcctgccttggcctttgaaagtggtgggattacaggcatgagacaccatgcctggccttcaaaaagttaatctaaaaatatatawacatatatcccagaaggagaagcagaagggtcagataggtgagaaccagggctttgaatatcagaaaaaccaggaagagataatatgtcaagtatggagtgatcaatactctcaaatgccgtaagaggatttgtgagcaattgagaaagccatgggatttgttcattagaatgccactgtgaggctcaactgatgaatctcagtagggtggtgaatgtaaaggctagactatgggaggttatggggctgggaggttgagagaaggaaaaycatattttatactgttcctgagacatttaatgaaggaaaaaaaggaaacaaaaaagcaacttaaaggttaagtcccacaaatgaattcttcaagtgaactgaagagtagcaaaacatgccactccaaacatgccactttggcatattgattattttgagataaagacagtgaaaggaagggaaatgggatacttccctgattcccyttgcaggacrtgcaacagaagtgtagctcacctgttcagttgcctcactgcttaatccccttgtgagacagagagcatgcagacaggcaggtgcagaggctggggtgagcgctctggggtctggcccggcygtagtgtctaggagtggatgcctgcagccccagcgttacaaagctttcagcttggccgcccgaagacagcttgaatgttaaccagcttaatggamcytttgccttttcacaagggcagagggccaacatgatagcttgctgtatcccgagctcttgttcagcgtcctggaaaaatcaggtcacacacggactcaaaggatgaatgcgaggttttattgagtggtggaggtggctttcagagggatggatggagagccagayggtgggtggatggaatgggaaggtgatcttcccctggagtcaggccgcccagcggctggactcctttcctaccgcccccagctgaactcctcttggcatccagacgtctctcctcttctctctttccctgctgtgctgttccaccgtccatctgctggtmtcctcctctactcacctgctgctctgctgtggagcttggggtttgcggtttayrtgggggcaggatagagrgtgtggagggacaaaaggcaacctctttgtcttgaaaacaggaatgcctgtcctcatttagggccgcaggtcttcaggcttgaaggtgaggtctttgccagggatccaccctcttctaaccagtattttccctgtcccctgtccgtatcagaagcagatgcagatacaagaaaacttctctgcctgccctccatatttgcctaaaagcaggacataatttttgtttgtttgtttgttttttgacacagggtctcgcactgtcaccaggctggagtgcagtggtgtaaacatggctccctgcagcctcaacctcctgagctcaagcaatcctcccacctctgcctcccaaagtgctaggattacaggcatgagccatcacgccagccaggacacaaatttttttttttgagacagagtctcgctctgtcgcccaggctggaatgcaggggcgcaatctcggctcactgcaagctccacctcccaggttcacgccattctcctgcctcagcctcccacgtagctgagactacaggcgcccgccaccatgtccagctaattttgttttttgtatttttagtagagagggagtttcactgtgttaaccaggatggtctcgatctcccgacctcgtgatccacccgcctcggcctcccaaagtgctgggattacaggcgtgagccaccacgcctggttcaccaggacaaaaatttttaaaggtgtctgcccttccctttctaccaggaaggaccaaagttaatcactggagacaactgtagattcttatcagcccagagatgacaccagaggaatctacatttcaaacttcattaactagctcttaccatctattagttcccccatttaaacatatttactttcccacaatttatcaccctagaaacttaaagtcgttttcctttgtattatcatttctctacaaatgttctttcttatgaagctagaaaaaactgaggcatggtttaaacgtcaaataatttatctgagccaaatgtgagtgactgcagtctgaaaacacttccaggttaccttgagaagtgctccagaaatcaaaaaagagactcgggccttaaaagaaaaaaaggatgaatcaggaaaggggcgactagaaaagttgtttttcgctaggtctggggctttggggaggtgggtttcccatttgcaaaatggaactttaaaagtccacggcacctaacatttccaagctcctctaaatcttccaggaagcacaggagatgcagggcagatgggagcattctcatcctgcagataaacaggcctggggtcagctgggaggttggaaaggcaggcactagaataccaggtactgggtgagtgaaagcacagtgtgacctggcaagggaaggggaggcgagagcaaagcagttgctgtctctccarwttctccttcactaaccacctcagcccagggcctggaaagaaaaagaacttaaggacttccacaggctgagactggatgctgraggtggacagtggctcacacaccttcttgaagtcaagtggctcctcccctgcccaccagatgccaagasggtctgttggacccagacctgtggtgacagctacaagagaaggaggagacaccaaagttgagtttgctttataagtgacattgcaggctgggctgcagtgggggggcaggatgaagattcaggctgtacttttcaagggaccaagggcttgggatccacataggcctcccacaccgtcagatgtcagctccatcaatactgaaagacaatrggagatgaggtagggagggggtgagaacgtggggagagggaagggaggtggtgggaaagagaggaaggaagaggtgaggaaaggcaaggaggaaagggaagggaaaaaaaagttgtttttcaactattatgatcagtgtgatcgtatctaaagcagtcttggagtcaggagacaggctgtaattgtttaaaaggtggcctgttcctggggacttcccagctcagcaggaagcagtcacagatgttttggcagttgtttagccaggaagttctctgcttaagacatgcgtggggtggctgggcgccgtgactcatgcctgtaatcctggcactttgggaggcagaggtagggggattgcttgagcccaggagttctaaaccagcctgggcaacgtagtaggaccttgtctctataaataaataattaatttaawtttttttttaaaaagacaggcctgaggtccaaaccgaaatggcctcccgactccattttatgtgctttgactaacccgtcactgtttcccttcatcattttgttaagwtgctggacaagccccagttctagccaccctttttagttactcatcactgaatgctcccatgtgtatacaggcagcacatgttaaaaaactttttcggccaggcgcggtggctcacgcctgtaatccagcactttgggaggccaaggcgtgcggatcacgaggtcaggagatcgagaccatcctggctaacaaggtgaaaccccgtctctactaaaaatacgaaaaaaattagctgggcgtggtggcsrgcgcctgtagtcccagctacttgggaggctgaggcaggagaatggtgtgaacccagaaggcagagcttgcagtgagctgagatggggccactgcactgcactccagcctgggtgacagagcaagactccgtctcaaaaataaataaataaataaataaaaataaactttttcttggccgggcacggtggctcacgcctgtaatgccaacactttgggaggccgaggcgggcggatcacctgaggttgggagttcgagaccagcctgaccaacatggagaaaccccatctctactaaaaatacaaaattagctggtcatggtgacgcatgcctgtagtcccagctactcgggaggctgaggcaggagaatcacttgaacctgagaggcggaggttgcggtgagctgagatggcaccattgcactccagcctggacaacaagagcgaaactccgtctcaaaaaataataataatacaaataaaaaaataaaaaataaataaaataaaataaaracgtttttatcttgttaatctgtcttttgtcaatctaatttacagggcccagcctgtaaatctaaratgagtagaaggaaaaagaatttttcccctcctgggcagaacactcttgggcacgtgagccttggcttcttaaccacatatctgagcagccagtgtggcagtggtgagtggcagtggagagactccaggaagcagccatttccctatcctgggtgcttcctgtttctgtctaatgctacacatagtccatggtttcagtatgttgtatgtgtttgattgtcaatccctrtaattacatcctacctaaaatatgcatttttgttcccrgaaccaagccgggtccggctgcattttcttgaggcccaataacgagaagcagacagactaggaaagaagggaatttattgctgtaaccagatacaggcagaaggctggagataattccaccaggccaactyaaagtgtyaacaattgtcttagtgtttatataggttgggrttatgcgcctgtgtgcagtgtagcattygcctaagtctactggtaactaattttgtttcaactagaaggtcagaggcaaaaatgctttctaagtcggattaagctgtgagcggcccagtacctacaaggyctgtctrctgtggtaccagagtgattatttctatcttatctgcttyacagcttggtctggagggctgccttagactctccaatgaatctattcgaacagctgcctctgttaccttgactgtctcagatttcgttgacccgagacgggtcctggcactaggaatgaaagactgtctctattattttggtttgctccaggttagggagaagcccacrcaaggctcctactgaccatatgtttcatttctagctttgctgtctgggcaccaatttccctaggtttaactatttgctcaatgttaaggcagctctggggaaattcgtctgtgtaactggggtgctatgcaggcctgtctgtttgactgtcatgcaggtctgtctgtgtgatcatcagggagaatyggccggccacattttcaatctttctcctcttctggaraaaataaccactcagtctttagcgtcagctcacccttcagggtttgacacctggagcagcagtcaaagaagctgaaaacasgaccttcctttctaggtgttaactttagccactgtggtagatggtccagaaagatgaccactgctaattcctttcctccctgaatgtgcatactgttgcagccatcagaggcggagtcggtttccttcccttgaattccgtctggttttgcgacttcccttgactaataaacagaatgaggtggaagttaaagggaatcayaacccaccctatggtacaatgattcttttaagacattcaagttatagatgcagaaagaagcctcttctgagcttcccttatctgactataggcagggccttkggagaatgaagctgccataaatcccctctctgggggagcttccagccaggaaggagcctgactgttagcacctgggtgagaaattgcataaacaaacattatcataaactgtaatacctgccattggtttccctaaaagcccatttktacttcccacagaagctctagctttcccgctccttctgcctattaaattgttgttgtaatatacccttacccctagctgttcagcaagctactgctttctaatgctgtcacatgtatgaatataaagcatgttytttttccctctagttaaactgtctaatgtcargaaatttgcaggcccacttcctccccccaccaccacttgaacctaatttagtgatggaaaggttttattcccartatagttgtgttttatgttcctgttctaggcttaaattttcaggggcctggaagcttccatttttgtttcaggaagctagatgctatgctttgaagaagctcagccaagacaactggaagagaagagactacatggagagagaaaggccaygtggaggaccactggggctccacgcattgagtgaagcctttttggacttttgagccagccaactaataagaagtaaaaccaacactgtggagtggcaaacaaaagaaaatgcattttaatctgggtctcaggaattgcaattgggagacacagatccagcaaataggaaaatcatgttccgtcttggtgagattaggcagaggcttagaaggactactgtgagtttacacatctggaaggttttagcatagttcataatggatgatggctggttaacaatttagtacgtctttgatgatcaatctagttcagcatagctgtctcttgtcggtaaaaaaaaaaaaaaaaaaaagccaatctctgcaaaatatttaaagagctttattctgagcccatatgagtgaccatggcccagggaacagtctaaaagaggtcctgagaaagtgtgcctgaggtggttgaattacagcttggttttatacattgtagggagacagaagttataggcaaagacaaatcaatacatctaaggtatacattggtttggccaggaaaggcgggacagcttaaggaaggagcaatacaggtcataggtggattcaaagattttctgatttggaattggtcaaaagagttaagctgaagacttaaagtcaggctgggcgtggtggctcacgcctataatcccagcactttgggaggccgaggcgggcggatcacaaggtcaggagatcgagaccatcctggctaacatggtgaaacccgtctctactaaaaatacaaaaaaaaaaaattagccaggcgtggtggtgggcacctgtagtcccagctactcgggaggctgaggcaggagaatggcgtgaacccaggaggcagagcttgcagtgaaccaagattgcaccactgcactccagcctgggtgacagagcgacactccatctcaaaaaaaaaaaaaaaaaaaaaaaagacaaagtcagtagaaagaaatgcttgggttgagataagggggggtgggctgtgattcttgttatatagatgaagcctcagatagcaggcttcagagagaatagatggtaaacgtctcttttggaatttcacaggtgtcagactcttagttaatctctgctagatctgggaaaagcctagctgcattaataaagatcctctacagatgcaaaatttctttctcaaaagatggcttctcaggaccatttcaaaatatgccaaagaaatatattttgaggtaaaatattttaattttcttcaaggtctgttatctgtcatgtgatattataccagttggaatttggtatcttcttaccaaagagtctgtttttgtcagtcttatgatctctattttaatattaatgctggtctgttatacctaaactttaaaagggagagagtataatgaggtacgtccaacccttccttcccatcatggcctggaatttagtttttcagcttgctctggggtcccctcggcctagacagctgtctgttcagttggttgggggcttaggatataatttttggtttacactcttcaggttgatgatcaggcaaagcataaacagttcaaatcaaatgcagctggttttacaatttggcccagttacagtcagatttcatctgagggtccaactcttcatgccttctcaactcaactgttagatacctccaacaaaaccatcaaccatctccattgtggattttcttgtcagaaccccagcccatcgtctcactgaagccatcctagtgagtgaccatggctgtcaccacatgaactaaaagaaccatcaagccaagccctgtctagtgtccagacctacagaaacaggagcagtttggagtggtttattatctagcaatagataactgaagtagctacaaagataactttagcatgatttccaggcaaagtgctctctcctcagaatttgtaagattcctccaaagagcagctgtagagctgttaagtatccaatccaaacagatgggagaaaagataaagctcttgacaagctgctgtggaaaataccaattcatgttatctctgccttcctgggaacttgcaaatgaaccagccctcaaatgcagctctggatatgacaaaccatcccagatggacccctaaaggtccccaatagctttgtatctttcaaaaccacataaatcttagaatctacagtttaggttttgtttgtttgtttgtttgtcttagacagagttttgctcttgttgcccaggctggagtgcaatgacgtgatctcggctcactgcaagctctgcctcctgggttcaagtgattctcctgcctcaacgttccaagtagctgggattacaggcacgtgccaccaggcccagctaattttttgtatttttagtagagacagggtttcaccatgtttgccaggctggtctcaaactcctgacctcaggtgatccatctgccttggcctcccaaaatgctgggattacaggtgtgagccactgctcttggcccagtttagggtttatagtgtgccaaactacgagatccctcccagttctgcttatcttaatgtaaaaggacattaaatataaataatataaattatataattaatgacaattaaaattatttttaagttaattgtttttgtttttgtttgagactgagtctcactctatcgcccaggctggagtgcagtggcacgatctcggctcactgtaacctctgcctcctgggttcaagcaattctcctgcctcagcctcccgagtagctgggattacaagcgagtgccaccatgcctggctaatttttatatttttagtagaggccgggtttcaccgtgttggccaggctggtcttgaacccctgaccttaggtgatccacccacctcggcctcccaaagttctgggattacaggcatgcaccaccgtgcccggcctgctaattggttttttaactaaagaaataatttatggagaaccaaacataaaaaggtataagacaaaaagaaaaagtcaaatggtgtcaaagaatggtgtcccagactcccaagcaggaatccttgcagaaattttccatgtttatacaataaccaccataaacattgaacatttactatgtgtcaagtactctcctaaacactttatatgcattaattcagcagaaagcaaattttttatgttaaagttacatagcaaatattttaggctttgtagagcacttggtctccgttgcaactaatcaacactttgttgtagtaagaaagcagctatagggagtatgtaaactaacggatgcagctatgttccaataaaactttatttataaaaacaagctatagcgccaggcgcagtggctcacgccagtaatcctagcactttgggaggccaaggcaggcagatcacgaggtcaggagatcgagaccatcctggccaacatggtgaaatcccatctctactaaaaatacaaaaattaactgggcatggtggtgcgtgcctgaagtcccagctacttgggaggctgagacaggaaaatcacttgaacccaggaggcggaggttacagtgagctgacattgggccactgcactccagcctggtgacagagcgagaccccatctcaaaaaaaagcaaacaagcaacagccagatttggcctatggctattagtttgctaactcctgaattatactcatgtaatagtcaaaaaaaccttatgaggattattatcataacaccattttacagataaggaaccagggatagatacaaaaacagagaactcaagtaaattgcccaacaagttatcaagtagtgaaactgagatgtaatcccaggctgtctagctccagagtgttttttagacactattttttaaagcacacatgtatgcatgtatgtctttaaaatttttatttatttattttttgagatagggtctcactctgttgccccagctggagtacagtggcatgaacacagcacactgcaacctcgacctcccagactcaagcgatcctcctctctcagcctcctaagtagctaagaccacaaacatgcaccactatgccttgctaattttttaaattttgtagagccaggtcttgccatgttgcccaggctggtcttgaactcctggtgagagctgaagccagctggacttcctgggttgggtggggacttggagaacttttctgtctagctaggggattgtaaacgcaccaatcagcgctctgtgtctagctaaaggattgtaaatgcaccaatcagcactctgtaaaaacataccaatcagtactctgtgtctagctaaaggattgtaaatgcaccaatcagcactctgtaaaaatgtaccaatcagcgctctgtgtctagctaaaggattgtaaacgcaccaatcagcactcggtaaaatggaccaatcagtgctctgtaaaatggaccaatcagcaggatgtgggtggggccaaataagggaataaaagctggccacccccccagccagcagtggcaacccactcaggtcaccttccatgctgtggaagcttttttcttttgctctttacaataaatcttgctgctgctgactctttgggtctgcaccacctttaagagctgtaacgccatgaaggtcggcagcttcattcttgaagtcagcaagaccatgaactcactggaaggtagaaactctggacatatctgaaggaacaaactcctgacacaccatctttaagagctgtaacactcaccacgaaggtctgcagcttcattcttgaagtcagtgagaccaagaacccaccagaaggaaccaattctggacatgctggcatcaagtcatctgctcaccttggcctcccaaagtgctgggattagagatgtgagccactgcgcccggctgtgctgttttgttttgtttgttgttgttttttaatttgagatggagtctcgctctgtcacccaggccgtagtacagtggcgcaatctcagctccctgcaacctctgcctcctgggttgaagcgattctcctgcctcggcctcccgagtagctgggactacaggctcatgccaccatgcccagctaattttttgtatttttagtagagacagggtttcaccatgttagcccggatggtctcaaatctcctcacctccttacctcaagatctgcccacctcagcctcccaaagtgctgggattacaggcgtgagccaccacgcccggcctatgtgtatttttttttttttaactcatactgtacatgctgtttggcatcttgcttttctcacttaacaatatcttgcctatctttccacgtatataaatctacctcgttcctttaatttgctgtatagtattccattgtatgaatcaccaatcaataaatacctagattgtttctgtgcattttcccttaaaagcaatgcttcactgagtatccttgtgctgaggtatttgcctgcagacgctcacacagctaagaatgaaggaaaaattattataaataaaatggttggaccaggtgaggtggctcacacctataatccccacactttgggaagctgaaacgggaggatcacttgtggctagaagttcgaggccagcctaggcagcaaagtgagacctcatctgtacaaaaaataaaattaggccgggcgcagtggctcacgcctgcaatcccagcattttgggaggccgaggtgggcggatcatgagatcaggagatcgagaccgtcctggctaacacagtgaaaccccatctctactaaaaacaatacacaaaaattagccgggcgtggtggcgggcgcctgtagtcccagctacttgggaggctgaggcaggagaatggtgtgaacctgggaggcggagcttgcagtaagccgagatcacgccactgcactccagtctgggtgacagagcgagactccgtctcacaaaaaaaaaacaaaaaaaaaaaccaaaatacaaaattagccgagtgtggtggcacaggcctgtaatcccaactactcaggaggctgaggcaggagaatcgtttgaacccagtaggtggtggt

SEQ ID NO: 17833 - DNA, 41299 bp, Homo sapiens
  misc_feature (1)...(41299): n = A,T,C or G, or insertion/deletion polymorphism (see Tables 1-2)
ggctgccgtgcacaagtgtggtggctactgctgctcaccatggcccacagggtcacagggaggaggctgaggcagcagcagcccttgctgccaggtgccttgagacatttgggaccacctcctttccttagacagcctcccctccacctgccagaccttgaggagaccctggagccaacagccctcaatatacccgatgggagctgcttgcttcctctgggaaggcactgtgagccccaccgacccctctccagctcgccctgcacacaggctgactcctccaaaactgagagactttcagggccaggctgtccatccctggtccctcaataaaggactgagcaaacactagcctgtggagttgggtgggcatggggcaccggaggcatctgcctccccccaggaggccactgcagctcagcccttctgtgccctgggcccctcctcaccgcaccccccccaccacaccatccggggcagaggaaacacaggaggctacagcacagagcctttttaattttttctgtgctatgcacagaagctgtatgaggacagatgtgtgccttctttttttttttttttgagatggagtcccgctctgtcacccaggctggagtgcaatggcgcgatctcagctcactgcaagccccgcctcctgggttcacgccgttctcctgcctcagcctcgcaagtagctgggactacaggcacccaccaccacgtccagctagttttttgtattttttaatatagacggggtttcaccatgttagccaggatggtctcaatctcctgacctcctgatctcgtgatccgcccacctcagcctcccaaagtgctgggattacaggcgtgagccaccacgaccagccccagctgtgtgccttcttatggccacaccaggaggcactatggtccgggcacacatcaggccctccagaccctgcagcacttctcacagctgctgctgtggggcctccagcatcttgggccaaataccagatcttccagggtggggccagtgggcctgctgggtcttggcggctctcagaaccagggaagcaggggtggccctgcctgccgtgggagctccggacacgatctgtggccagggtctgagtgactgagcgtggccaggtcggctctgcttctgcaactcctcgtgtgcttatgagtggacgccctgccctgccttacttcagggacccctcacgccctgccccctgcctcactgcagggaccactctgctcccaattgtccacccagagaccctccacagcggccacctgaccactggctttcaatggaactctctcccgcgataggccgagggccttggtgacctccagctcactcagtctcagggagccccagggtttcagcacatccttctagagtctttccagctgcacccatgaggctggggccaggtgaagacagagaagcatccaggagcccacatctaaggaggcccccactcccagcgccatccgaatgcaggtaggtcttaaaaaggaatgcctcagggccaggcgcggtggctcaagcctgtaatcccagcacttcgggaggctgagatgggaggatggcttgagcccgtgagttccagactagcttgggcaatacggcgagaccctgtctctactaaaaccttaaaaagaaaaaaaaaaaaaagccaggtctggtggtgcaagcctgtagtcccagtgactcagctgaggtgactggatcacttgagcctgggaggcagaggctgcagcgagctgcaatcatagccctgcactccagcctgggcaacagagcgagaccttatctaaaaaacaaaaagtgcttccttaaattttgcacccaggtgccccctctggcctcaccctgatcctgaggcctccgtctacctgggttcgttctaacctgcgtgaccatcattctagcatttgtctggcacaggtcatgtggctgtgccttgttctcaggctcctcagccagctgggtggctcctggggctgtaatctcaccatctcagatgtcgagattacttttcatacttccttatcttgttaataaagatgggacaaaatcatagcttgtaaaaaactgggatgatggtgaacccagttctgaggcttcactttctgcttttgtttggttctccatgctgtcaaattctctgaagaggctgttgccctcctgagtcagctgcagcccagcaaggccctagaagagcctctgctggtggacagaggagctgctgcatgcagacgaggaagctgggctgagggccggcaccagggcacggggcagggaggctgcgggtcccgggtctcatgggtctcagttctatggaggtgcctgtcagtccaggtattcagtcccccaaccccgtctttgggtctcagtggtactggatccaggtgtacctttgggagaagctgttgagaagctggctgagggaggaccacccacgtgcacgcccatgctcttatgtggatccccgggatcataaccttgtggctgacacatttcctctccaaggctgtgctgtcctccacgacttgctgggtcccctcaaggcccttgcctgtgtgggtggggtgctcatgggaatgagggtcttgggaggggggggtgggaaatcaaacaacacagggatggggtagctgccacagtccccaccaatggggtctcctgggcagtgacccggcattctgcctccagtggctgcagtgggagtcctgatctcaggccagggaggggacgtgcaatggtggtccagacctggtcccattcctggccaggctcagtaaagttactggccagtttctgggcctcggtctcccccaggttattcagccttgagagttagtcaccatgcctgtgattctgcctcatcttcttgtgtcaaatagggagggtttttcttggcagaatggtggtaagactctgagccagaaggagactctcccagagaaggcagcagagagcaagagcaccagggccttctcaaggcctccgagagccagctgggcctgggcagtagatttgtgggagggtgccctgttgggactctgctgacagggagtcctcagggcttgtgtgagtgctctcaaagtcacaggatgggatgatcacctcctttctccaggccaggcagccagcgccggaaagctctgcagccccctgcgcggcctggagaagggcttccttccagttttaagtcagtgtttctgtctcattgccatgctcgcccccagtgctacgtcctgcaccaaccattgccacttcatactgaccaggtggaaccaaacactcacattccagttggctccccatccctccccagggagaacagatccacaggtggtgcacctgtgagtggagtggaggctggccacgggcctcatcacacctgccttccttgctcaaaagccctgcccagaacatgcctcggtcccaaaaaagggtacactgggccctaacccacatgcctcataatctttaagcagaaacagcaagcagattacgggacaggacagatcacgctagtaggattaagcttagaatatcccagataatcgcggatgcccctcccccaatgggggagttattccccttaacttctgaggattaaggggaataagaaaaagaagaagggctgggtgcagtggctcacaccagtaatcccagcactttgggaggccaaggcgggtggataacttgaggtcaggagttccagaccagcctgtccaatgtggtgaaaccccgtctctactaaaaatacaacaatcagccgggtgtggcagcacgcacctgtagtcctggctactcgggaggctgaggcagaattgcttgaacccgggaggtggaggtcgcagtgagccgagatcgcaccactgcactccaacctgggtgacagagcaagactcggtctaaaaaaaaaaaaaagaaaaaagaaaaagacggataaaagaagacagaaacatgggagtatttcctttgcacaagaatccaaggtctagaatgaagagatggtgaaatgaagccagcctccaggaaggtgcactgtgccttaatgggacctggggatgggaaggccaacacagaggtgtcagcgggacaaacacaaagtgtttctaacaagagcaaagatttccagtcttctctttatttccaaacactctgtaggtaaagcagagcctcagtaaacccaagaagcagaaaacctggcctcctgcctggggcagcttcagtttagacttttcttcattcctaacagcataaagaggctgtgcaaatgggaggcactcagcagagcctgaagaactctggggtcttagctcctgggaggccacacatgcttggtggcaccctgccggtcacggtgcctccaaaagctcccaatgatcagtggcctttcttttttttcttttttttcttagacagggtctcactctttgccaggctgcagtggcgggatcttggttcagtgcaacctctgcctcccaggtccagggagtcctcctatctcagcctcccaagtagctaagaccacaggcaagcaccaccacgcccggcaaattttttgtatttttagtagagctggggttttgccatattgtccgggctggtctcgaactcctggcctcaagtgatccacccgcctccgcctcccaaagtgctgggattacaagcaagagtcaccccactcggccagtgtggcccttcttcaggtcatcacttgccagccgcaggcggtggctctgcccctcaccggacacgacgtcacagccgggatgtgaacagcagattctgatctccaactccagacaatcactgatttacttctgcaaaccggagctgtccggtcttgcagggtcggaccatgtaaacaagcctgctgccaggcaactgaagacagaaacacgaataaagatgccccataaggaatgaaaaacaaaactcctcttgggaaacccagatttgggattcggaaacgggcttgagatcaacctgaagcttcatgacgtcttactgtttccactgcctttcctgttccactacagcaacgccctccacttcacgtgccaagtcctgactttctcctaatagttgccgacccagcaccccgtaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgggtggcggccggcgcccggtggggcatggcgggttcgcggggtgcggggcgcacggcggcgccgagcgtgcggccggagaagcggcggtctgagcccgaactggagcctgagcccgagccggaggtgactgtggcgatgcggggcggcggggcgcgtccctagagggcccggcgggcacgtggccgcgctggggcgggtgggcccggcttctgtcacctgggcgcccgcgcccagtgaatcggtcttgggcgtgggtgcagctcctctatcggggggtctcaggcagagcggactgcggggtaaaggacggcgtccgggaagcaaagaaacgggggagcggggagtggggacggggcgccccttgcagcagcctctccagccgttccatttgtgcatcctgccaataaaagggctcggcttgcgctcccagtaaatgcttaacctacgtatacgctagttaattgcgtttttatgctcatgggatagacatgagaataagaaaacctgaatagaacccagtgtctgctgcatttgctgtattagaactcactgttgctctctgctagctcagccctgtcttggttgtggggatcatcaaattgggtggtggaggggatggacagccagcccctcacagccccctcggccgcggccgckctgggttgttgaaactgccccattgctttgtgaagcgaattcaactcatcctggctcccatgggctgaatggcccgcaggccactctaggcgccaggttctgcgacttccacccttggactaaacggtcctcaggagccagttgtttgcgcccaggccacggatgccatttccactagttattgtgattgtgtagccgactgaataccaagacacatcatgactctgtgtgagagaggcattgtgtgaacactcggtatgcaatagctaatacatgcaggtcgtaccttaagtgagacttgtaaactattaggaaaacagtaaaatctagaattctgcattcaactgcttcctttttcttttcttttccttttctttcttttttcttttttttttttttgagacagagcctggctctgttgcccaggctagagtgcagtggtgcagtcttggctcactgcagcttccacctcctggctaactcagcctcctgagtagctgggattagaggtgcccgccaccaccagctaatttttgtatttttagtagagatggtttcaccatgttggccaggctggtcttgaactcctgacctcaggtgatccacccgcctcagcctcccaaagtgttgggattacaggagtgagccactgtgcctggccttcarctgcttcctaagagtctaagttcttgttccaccctttaaggccagtgaaggacccraacactgtgtgtgccggtgtcacgcagccagcagggctctgctcagaggcagctgtggtcctgctcagagagaggagtgggtgggttggtgcgtggttgcggttagagtctctatcattcctgtgactcttcagccaatcctttcaatttactgatcaatcgttggtcccaatctggttaaatgaggaggcgtctgcttcaggtggtaaaagccctttggggacccatttctcttccagcccccagccccttttctagtgacctcttggctctggggccttggatgccagggtgaggtgtggagagggctcaggcaggctgtctgagggacccagtggagtccagcccagcctgaccccacagggcctccggagtgtcagtgggtggtagagagcagtgttagttttgcgatgagagctgagctccaagaggaggaggttgtccttgaaaagccccttccctgtgaggtgctaggaattaaaatgtcgatggcaaaggcaagaggctgtcttgtcagtggaggtagaagatgaggaaggctcaggttgggtggatgcttttggtggaagtttgtgactggaggggtgtggtcctggaggccacatggagctgctggtgggtggctggaggggcgagaggcagctctccctgcagtgttcagtgccccatgcctggaggggcagttgtcaccaacccagtgtttccttgcagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggtgggtgagcgaggagccccctcgagggctgtcccccatgtgcaggtggccttgggctttctgagactgccactgtactgccttctccaccgtccctcagaaccccaaggccggcgtccctccttcactgcacctggggcacgcttgggctctaggacgctggtttccatccccagttgcgtgccgttcccaggaactctgaaaatccacatgcctaggcccttccccgtcagacgatgctcgggcaaccctcctggcaacaggttgggtttccttgaggtggggattttactgcttggaatccagtggcaggacccagctgaggagggagctgagcagcatggcagggctcaagcaggcggcatgggggccccaacggaacccagctgggcctgaccccacagggcttcaggggcctgagcagccgacgggtagagggtttaacattgtacctgttgcagcgatggtgggggaggatgcaccctactcttattgagaacaacaggagaaaagcataatttaactaaaacacagcatttgttatttttttttattttttatttttttgagacagagtcttactctgtcgcccaggctggagtgcagtggtgtgatcttggctcactgcaagtaattctcctgcctcagcctctctagtagctgggattacaggtacatgccatcacgcccggctaatttttgtacttttagtagagacagggttttgccgtgttggccaggctggtctcgatttcctgacctcaggtgagccaccacgcccggcctattttttttttttttttctaagacagagtcttgctctgttgcccaggctggagtgcagtggggcgatcttggctcactgcatcttccacctcctgggttcaaacaattctcctgtctcagcctcctgagtagctgggattacaggtgcccactaccaggctcggctaatttttttttgtatgtttagtagtgacggggtttcaccatgttggccaggctggtctcgaactcctgacctcaagtgatctgcctgccttggcctcccaaagtgctgggattacaggtgtgagccaccgcgcccagcccagcatttgttactctaaacattctggaaatcgtttgtaaggatttactctcccagtagtttcggtgttctggaagttacggccttggcagaggtccccgtgatagaagccaaggaaccatggcttgttcattgtgtgctagctgtgttgggttggcttgtttgctgggaagaaaagatttaaaatcacacttaattcaggctttaattataccactaacatacacagagaaaaaatgatgtgctgtgttggcagtggtttgtaagattatggacaactacgttaccccttcttgagtttttaaaatgatacaatactgggccaggcacagtggctcatacctgtaatcccagcagctcgagaggccaaagtgggaggatctcctgagcccaggaatccaggtcacagtgagctatgatagagccactgcactccagcctgggtgacaagcaagaccctgtttcaaaaaaaaattatgagataaaacatcctggaaaataatgtagatattgtagcagcaccattcagtagggtggaagctcccactcagggccctcacacctaacccgtgagcacagttagtggtctggtgtacatctttctgggtcttctgtccctttttaaattaaggatttacacatttacatgttaatgatttttttattaaattctttcagcgggcgtggtggctcacgcctgtaatcccagcactttgggaggctaaggtggatggatcacctgagctcaggagttcaagaccagcctggctaacatggtgaaaccctgtctctactaaaaatataaaaattagctgggcgtggtggcgcgtgcctgtaatcccagctactcgggaggctgaggcgttagaatcacttgaacctgggaggcggaggttgcagtgagccgagatctcaccactgcactccagtctgggtgacagagtgaggctctgcctcaaaaaccaaaacaatgttttcgcataataacatatccaagtacttgaaaggtactagaggtgtctgcggagtctagggaggcgccatcttctcttctcgctgcttgtctcctggcccctggagcaccaggtcctctgcactgctgagtgtgtgcttgtcctgcccattgccctgctcgggtttctgtgactgcgtaactggctgccccatgcagggtgttttccaaagtaccgctgtctgtggtctgtgtgctccgtcatccagcagggcctgaggtggcaaggccggccgggctggtggggcggtcctcagagttccccacgctgctggctgcccaagtccctgcctgaggccctgccctgttgtggcgctcatgcacctgcccgcgtgtcctgtgctttagctgaggggccgaggccctgccctgccatggcgcccgtgcatctgcccgcgtgtcctgtgctttagctgggaggccgaggccctgccctgccgtggcgcccatgcacctgcccgcgtgtcctgtgctttagctgaggggccgaggccctgccctgccgtggcgcccatgcacctgcccgcrtgtcctgtgctttagctgaggggctgaggccctgccctgccatggcgcccgtgcatctgcccgcgtgtcctgtgctttagctgaggggcaccttgggccctgtcagggtgttttcagttctaaagtgtgatcctcatgactgggtttaaattcttccaggtcaggagaatgaattgatgaggtgggggtgctttcagcttcttagtgggaacccctcccttttcccccctgttcatcagaagccacccaggcaccttggcctgctgagcggccactccctcctgcctgccctccgcgcccctcttgaatggtgggagtcctttcccattgtgcagccctgcaggtggaaactcagccggcagcccagtgctgcctcctgcatgttctcttggcttccatgagcgtggccacgtgaggcctcccagagtgccgccaagatggccccgtcatgcccagttagtggcctcaggttaggcctgtttctgtgtcatcccgaaggcagtccagggctccttacgcctgtatctcygccacctcccactcgcatcgtgggtccacggggccgggccaccaggggctctgccagacaccctcgcccgccacagccatctggaggattctgcccccgatgcccctgccagtggttgtgggtcctcaacccaagaacccttccgttgagcggcttctagaatcagtgccccttggttctgggaattcacaccacagtgacacagcagcttctcctgctgctaagtgtccttgccctgcagtgggcgcacctgggattctgtggtcctggccacggccactcgtgtggtcttgcagatggttcatgggcctcggtgggttacttggtaagtgagggtaatgtctgcctggcagcccctgaaggacgagatgatgtttttgctaatttctcttctgccacgtgcttctgcctgtccccccactccctcctgtcgctgtttcctccacagtggttggcaagacgtggcccctgtggcctctgcctcgtgcrtctgaaggacatcccagccacagcatcacatcagactggaacagtggcgggatggggctgggcatcaggcagcatgcatgtgtcatgtcacggacacctcagggacacacgaagtcaggcagggcgagggcctcactccccaggccgcctagcccttggtgggtatacccggccccgatggtgctgtgaagaaggggctgtgtgactggcatgggagggagctgcggcttttgttcatctctgccatcctggcagcgatgtggctgatgggtcaccttcagagagcctcctccataaatctgattccaagtgtgtgccccaaaccaacccagaccggcccggggcgtcctgcggagagccccacagtgggaggcccttgtagcggggagcccggtgactgctgggggtcagctgctggcggcccctgtggagacctsgcgacctgccaagggctccggacctgcctgggtggacccagggtgggcgtgcttctggctgcagggccgggccacaggcttccctctggctttctgccctcaggcctttagcattgacatgcacacgaccctgcctcctttmtaaggactgtgtagaattacgtggcattcagtgagcagctgcacgtggtgttctagggcacctttggatgctcaggtgctcctgaggggtgtgccagggaacgagtctcctacccttccctcctggctcctgttgctgcatccaggcaactactgtttccagtgctgaagtctctttccaggatgttctagacatatccaaactcgcacagagtttttgaatggtggtttcttaagagaaggggcagccgtgcgctgtctcaggatggttctgtcagggaggccatggctctggtttgtacagtgcttggtgcccgtagagtgcctggcagctcggcctcaacagctccagtgggtgggcagttgcaggcttttgctcttacagttgacctgacagtaacatgctgtttctcacatgtgcacaccattcttggggmaaattccaagagaatttctaggtcaaaggataaatgcttttttttgtttgagacagggtctcactctgtcactcaggctggagggcagtggtgcgatgttggctcaccaaaayctcaacttcctgggctcaagggatcctcctacctcagcctccctggtagctgggactacagggtccccgccaccatgcctggctagttttgttttgttttgttttgttttgttttttgagacagagtctcgctctgtcgcccaggctggagtacggtggtgcaatctcggctcactgcaacctccacctcctgggttcaagtgattctcccgcctcagcctcctgagtagccgggattacaggcgcccgtcatcacgcccggctaatgtctgtatttttaggagagacgggtttcaccatgttggctgagctggtctcgaactcctgacctcaggtaatccacctgtcttggcctcctgaagtgctgggatgacaggcgtgagccgccgcacctggccatcaatgcatttaattgtgaaggtgcttggagcgtccctccgctaggcggtgatgccatgcactactgcagccgcccctcagctgctttcccrccaccagcctccctcatggtgttgctgcttcatcttttcctcttgtttagtgatgtttttctttcattaagaatgaggctcgcacagctgggcttaactgaaaaaataaaaataaaaagaatgagtcacaggctgggcccagtggctcacacctgtaatcccagcactttgggaggccaaggcaggtggatctcttgagcccagaagttcaagaccagcctgtgccatataatgagaccccatttttacagaaaatttaaaaaatgagccaggcatggcggtgcgtgcccgtggtcccagtcccggaagcccttctgtctctttccctgtggcggcatcatccatgcacttagctggctggaaaccctcatggctgttgcccaagggcaggacagctagctggttcttgtcattttggtctgagctccctgggccaggagccctttgctgttttctctctgtttgtttgttttgttatctggcaccacaacaaactgccccaaaccatggagcctttcctttttttttttttttttttttttgagatggagtttttttgctcttatcgcccaggctggagtgcagtggcacaatctcggctcactgcaacttctgcctcctgggttcaagcgattctcgtgcctcaacctcctgagtagctgggattacagatgccagccaccacgctcgggtaattttttttttttttgtatttttagtagagagggagtgtcaccatgttggccaggctggtcttgaactcctgacctcaggtaatccacctgccttggcctcccaaagtgctgggattacaggcgtgagccaccgcacctggccaccatagtgcctttcaacaacgagcatttgctgtctgtgtttctggggtcaggagtcctggtgttttgtgaggtgcactcaaggagcagggtctggctgtgccctttgcagctcctcccctgactgttggcatgaggagctcaggagtgaaggtgaagaagggtactctgtgtctggggggtggtcagaggatagggatgaggacagggacagggcccaagaagatggggtgggtgctgtacctccctcttccttccctggggtatctgtgggccacggcagggcccacagctgttgctagtagcctscttggggccagtgggtttgatttatttttgtgtttgtgtggtttgagggcaggcatcccttccccaccctttgcgtccctgctacagtgacccctctttctgggtccacctgctctggcacgagcttggtgggccagcctcaccccagggcccaccccatctccagcctccctgccttgggcctggcagtcctgcctcttaattgcgttctgtgccacctgatgacccacgagttctgtctcctggcctggttcctactccctgggactttctgcagcccctgcccttccagctgttgactgtgtctgcgagccatcccactggaggggcgccctgggctgtgtgctccctgccctgcagcacccctgacacgggtgctcccagccctccactgaccagccagggaggaagctgcctcctgccggcctgtgcctcgcttcctgtcccctctccagcagcacacggcagcgcgggccgcgggctcaccggagcgaggactggttgcagggccttctctttatcgctggtgtctagtggatctgtggggtccgtgcgctcagagctgttttttcctttctgtgctcatttagattcatttttttcccagctttgcttggttttgtcttttcatttatgtgagtttttctttttattattttgtgcagaagtttctgtttttatcagtttaatctgcttgtcacagtcaagaatgtgagaaaagactggatgcggtgagccaaacctgtaatcccagcactttgggaggccaaggtgggcggatcacttgaggagttcgagaccagcccggccaacatggtgaaacctcatgtgaattgcttgagcctgggaggcggaagttagagtaagctgagatcatgccactgcctccatcctgggtgacagagtgagtgggactctgtcttgaaagaaaaaagcactagtaagagaaggcctaagacctagtattaaagtaagagaaggcctaagacctggtatgaaagtgagagaaggccaaagacctggtattaaactgagggaaggccgaagacctggtattaaagtgagagaaggccaaagacctggtatgaaagtgagggaaggccgaagacctggtattaaactgagggaaggcctaagacctggtattaaactgagagaaggccgaagacctggtattaaagtgagagaaggcctaagacctggtatgaaagtgagagaaggccgaagacctggtatgaaagtgagagaaggccgaagacctggtatgaaagtgagagaaggccgaagacctggtatgaaagtgagagaaggccgaagacctggtatgaaagtgagagaaggccgaagacctggtattaaagtgagagaaggccaaagacctggtattaaactgagagaaggcctaagacctggtatgaaagtgagagaaggccgaagacctggtattaaagtgatgattccagatttttttttttttctgagacaagagtctgtctgtcacccgggctggagtgcaatagcctgatctcagctcactgcagtctccaccccccagattcaagcagttctttctcctgcctcagcctcccgctgtgattacaggtgagcgccaccaagcccagctaattttttgtatttttagtagagacagggttttccatgtaggccagtctggtctcgaactcttaacctcaactgatcygcctgcctcggtctcccaaagtgctgggatgacaggtgtgagccactgggcccggccttcccagataatttaaggagagtttggcctgtgccggagcataatgcacactcttgggcaggggatcccgccagcgtctcagcgaaggctctgggaatggcaggtggcaggccgcgttgctgcagcgtgggaaccctgggctcgggccccctgtcgctgtggttctggggtctgggtgctggtgccgtctgctggagagtggtctggagctgcagctctgtggagtctgraaaggggctgcccagtgattctcaccagctagtcagtggtggagaagttgcctgggtgtggaccacagagctggggatggaaccaggggccagggctggtggtaaactccgctcttgcctctgcctgtggccttgctttgggttcttttgaagactgccagctccaagcttcttggcccccatgggggagtcaggcagctgttctgccacctgccctgacactttgcagcatcaaacagatattttgtagcattctggattcgaggggtcagagttcaggccgaaagcagcagggtcagtacaccctgagtacagtgtcatgctgaggggccggggagccccagagggttctggtacattccacctgaggaagatcgacactcagctcacatcctgtgctctgggacttgggtgaggatctcaggtgagcacagccgggcctcttgtgtgtccagaccgcccctgacagccatgttcacgaagggtacccctgtccagctgtcccctctcccagggctcagggctgcaaggacgtggtctcctgtgccaggcagagccacacggccttcacgacctcagcccagaatcctgtggtgtcagtgtgggctgcctcccttgggtgggtaaagcagccacaagcccacccagatttgcggcgggggggacatagactctgtctcttgatgcgatgaaaatcaaaggtttgtggccgtgttttaaaatggtcacagtcacccttacgcttgccaaatagtctcttcccccagcgctccccagaacctcattccactgccagggtctcatctaaaccaggcctgatagatgggggtccttgggcccctctctgcacagctgtctgcagtggggcaccgagtcacagtgctgtggagtggtctctggtctgtggtggtcctaaggtggctgagcacatggctggtggtggtcttggccatggtggtcttggcccgtggtggtcttggggcctgtggtggtcgtggcccatggtggttgtggcctgtgatcgtcagggcccatggtggtataggggacctgtggcagttgtggcctgtggtgatcgtggggcccatggtggtcttagggcctgtggcggtcgtggcacgcagtggtcttggggcctgtccttgagacccatgatggtcttgagacccgtggtggtcgtggcctgtggtggtcttgaggcccatgggggtcatggcccatggcggtcgtggcccgtgacggtcatggcccttggtggtcatggcccgtggtggtcttggggcctctggtggcagcacacatggccagtgcctcatgcagggttggcctccatgcctgggaacgaccctgccactcttgggctcctgccccgagttaccttccttttccctgagtaaaaagggatgtttttcggctgtattttctctgggcttttcagttcctgctgatgtactttctttaaaacaaaatgtgggtttcctaggtacctgttgatgagtcgttgctgtcacacgagccatcggcacagagctcttggatagcagcctgtctctgtgctgggcaccctgcggctagcgtgggcagggccctagggagccttggccgtgctgaggtgctgggtgtggggtctgtggtgcagcgctgggttgtcttggtgtccttggcaccccgacagcgatgttctggctctggtctctgggcaagttaggactgcttccctcctgctgtccacgtctccagcagaaccctcttgtgggcagccctgggagcagagttctcttcccaccgaaccgggacaccgcagctctgtcgccatcctctcccaggaggtgagggcagagcccgtgtctcatgcctggttggtggcagtggggcacggcctggctggcctgatgctggggaggggaggctctggtgtggtcacaatagggggctcatgcgcttggacaccgtttctgtctggctgagcccactgtgggtttctccctttggtcctcatggtgacattctagccctggggctgggcagaggccacgcagggttcagggactacagcagcctttccttggccccagcggccccgcatcctgctggcacctcgtccttgcgctccccctcggcggctccctgcccacccgtcggtccttcagacccgcctgcctctgcccagtggcgctcgcccgcccactctctcagcttttacttcaccctcacgcaactctcgtgctccatcgggcccgacccctcctcagtcaggccacgcacactgcgggtggtgctggagaccctggagaatccgggctgactccaggcatgggcgtggcgggagggggtcctgtccccaggagtccggagcgtggcgtgggctcatgttccgttgtctgtgtcgttagggttttggtggccttttcctctaatttttaagttaaaaaaaatacgttcaatgccccacagcatctgcctccaaaatctgaaggggccttctaggtcaggcagttcccagcagtggccgcccctgcctgcaccgcccctgcctgcaccgcccctgcctgcaccgcccctgcctgcaccgcccctgcccgcaccgcccctgcccttcgggcgctgggcctggctgagcgctgtcgccccctggtggactctgtgccccacagctgtcccacggggatgctgcgcccctgggaacccagcacctycgaaggccacctctgccccctgcccagagcctgcctgtgccgtggcctgtccacatccagcacaggggccacggggcacagagcgctgggtgacaagtcttttgtcacctgccaggaccctgggactgcggcccatgagcagcgaggctgggactccagcgtgcggtgcttcagcccckgccactgtgagggktcgggagcccagcccggtacccgtccgcagaggccaggcgggggcagccgaccgcagccgggtgtggaactgcccttgtgcgcgtctggggcttggggccggggtcacggatctgctgcggctgtgggggctcatgtgctccaggcaggggcaagagctccgtgtcactgagcgccccaggccactgtcagcagcagggggagacgtggaaactgaatccttccttgttcctggcctgggaaaaaacttagtctcccatctctctttatattgaaggaaaaaacaggcaggggaggagcccgggccggagagaagaggggctcggggtgggggcgggggcgtgcccgccttcgctctggggttcctgcgcccgagcactttactgcccccacgggtgagaggtgggcctgttttccccatcagccttggttccrccagtaaacccgatccggttggagccatcctcacctccgcagtcgagggcagaatctgttttccaggttgggatgtgaattctcagtggcgcccactctgtgacccggcgggatggggtcagcctgggctgtggacgtggtgggtgggagaacgctgggcaggccttctgagtgttcggggccctctctgggccctctgctggctggactgggcgggacgtggcccccgggatgggtggacaatgtgtgtcccccgccccttcaagagcattggccccagtgaccctgctgcgacggctgcgtctccttcttccccccgaccatgctgcccccgtcccaggcggggctcggcaggagcgccatgtggggcccctgggaggagtcctgtggctttgacatgaatgggggtrcgggtggttggcggtgggtcttggtcctcagctggcggctttgctcctgactgccccagtggcttccgtgtctagcctgacacccgtgtcagcccagggacagaggccccgggaggctgcartccagccctcacagaggacagggccgtgggcaggacctgcggcgccgggtgccagccacagcccccagaggcccccttagagctgggtgttctcggccttgtgctgaggcctgtgccaggctggagctgctcagagatttcggggtggtgggcttcctgggatccccccaaggtcaaagggtaccctgtatcccctgaagtraccattttctctctctctctgcaggccagcactccttgcccgaggacagagatggcgagcgcccggattggggatgagtatgcggaggacagctctgatgaggaggtaggactggggctgcttcccactgggcagggtggggcggcttccatcacagcctagcaggtgctgggggttggggctggggttgccctgggggtgctgggacctgccgcaggtgggccgcactgttggagccgaggcccacgtgggcgtcctgcttccccatctgcaagagcaatttcggggtctgggacacaagactgcaatgtatgtgtgtcatcatggcttgtgaaggggaaggacctgggtgtggctccatgcccctgtgtctggcctgtggacgggctctgggggctcctgtggcgtctgcagggtggctgtgggctccctgggcgtggcgtgcatggtctgggtgggggtcatggtcggggtgggggtcacgggcatgggtggtgcccctgtcgtgtgtgctgtggggtgggccacaggttggctgggggccaggcgggcagaacagggccagggccacctcctaatgtcctgatgttctgggcagtggtggcccttcccttcccctggggtccccctgccccccacccctggtggtggctgatgtgggctggggccgttgcctctggacctctgactgagtcccaggagcacatctcaggaggggcaggaggtcggctgtttctcataaggagcttgcaggcgaagggggatgcgtgctgctgggctgggctccaccagcgtggagaggctggcaccgggctgggctccgccagcgtggagaggctggcaccgggctgggttccgccagcgtggagaggctggcaccgggctgggttccgccggcgtggagaggctggcactgggctgtgtccaagagcagatttggctgcggggggctgccctcatttgggaggggctggaagctctgagaagctctgaagccagaggcagtgcctgcctataccctcctcagtgtggcctggccccagggtaggactgtggtcccagtggagcacctgggtgtgaggcagagtctcctttgggccctgggggctgtgggggaaggagaaggctttggtgtagggccttcctgaaggagctcttcctgcctgcctgtcaggaactgtccccggggggcctgggggagacacgcgcccccctccccccaggttcttcccccatccttcggctctcttggctgtggctgcaggagccttggccgcccgcccgatccggtctctgctgcgcgttcagagaacagagacaaaacaaaataaattggtttcctggccggagcagcgggctcactcagagcgggggggccacgccgcgcactccctgcctgtctcccctccccctcccaggggctctggctgtcggcagccacatcctgtcggctacttttttatatttggtattttgagaaatcgatgatgattgtaaacggagcgcggaggccgggggaggggcctcggcggggcctgtgggaccctgctgcccctgggggtgctttgccaggcctgtccagtgccaccgccgcctgccgggtgggcagccccctgctgtgctgggaggaagccggccagggatgtgggggctgcttcctccagtgatgactatcccatatgttggtctgagtgacagcgagggagcccgggtgctgcccggtgctcctgccagcacagccggccagtggctcgagggggcggcagagctcagctttcaggagccaggccaggcccggacagatgcctcccgtccagagaagtgcgcatctgcctgggcctctgttcccttggagcaaagtggggtggccctaggggagtgatttggggccacaggtgggcaggaaagaggcttgggaggtgggagacagcctgcagctctcccatgagacagtggggtgaggagagcagggcccgtcaggcagccccgtgtccttggaggtggccgtggcaccaggaccatggtcctcctcggcactgggcagagctggctgagagagggccgacctcactgccggggcccttcagggctgtggagagggcccctggtagcagggcagggagggcgccgctggggcgtgtgctcctgcgagcggcgatctcagctggagcgcgtgggtggcagtggctgtgatgctgagaaggtctcgggccaagctcctgctggtgggaggtgcctccctgccaccccctgcccacctacctccccttctcctcaggccacttccctgcccttcctgggtctggatccagggcctggacctggatgacactggggcttcagggaccccctgctggacgctgacttttgaagacctgagcagcccctcacaggagagctgtactccagctcttggtgtcttattcccctcccccaggtgcgcaggcagcagcgagcaggcggagggaggcgggcggagcccctggaggaggcgctgggcctggctggggtcctgccgccggcagtggggggcccccaggagccggctgagctgcggctgccccgcccccgcatggccacctcacccctctcccaccgcgcctggagcttcacagacgtgatctcatccagccgctgggacccccggggaggtgggccggggtggaggggcggggcaagggggctctcggcctttgccgaagcagcccctccgctttgatttgagcggttgggagaaactgaggccgggtggctgctcaggcagaggatgcagccacccaccctccccctgcctgtggccgtgtttgtcaggaaagcgtagcaggctgagggatctgggtggccgtccactctggccggaggagccgccctctgctgtccctttcctgtgccccgtggtgctggcctggggccgtcccccacgaggcctccactggggcctggagtctggggctgggtctggggtgcagcctggcagctcctcggtgcccctgaccctgcctgggctgtgagtcaggttcccgcagggatgcagccgggcctgtctgcgtccagagcccgtggtcccctctgctctcgcgccaagcgccgttaatggcttctcccagctactgaaccggcagctgcctccagtgctggcggcctccgctcctccgggccgcccccgcccccgcgtcctggccccgcgcactcaggcttgcgtcgctgctggcggcgcggcctcggctcaggtttcccggcgagcgaacggccctccccacgctgcttgtggagggcgcccgggcctgcagaccgccccaatctccctggcggccatccacccccgcggcctcctgcatgcctgcctccgagggggctgctgactgggctggggctggccctcgggtctggtccctttccactgaggagggaaacgggcgcgccctgctacccaggctgtgggtgggtgtgtgtagcctgactgccgcgtgccccttggccggcttgaaggccctcctaggcctggcctgctgcactcagttgtccggtttgggagaggagagaccctggggtcagtgatgaggggcagggaagccagggccctcatgggggtaccctgggctctcggatgaagcagggctgggcagtggctggtaggtgggagtggcctcttcagagccgcgtcctcctgcttgtgggctgcaagggtggtgggggccctggcctgctgtgcccactcggggccagtgtccttggcagctggaacccgggtgggcagcggggggtgctctacagggctcttgagcggaggctttgccctggggctggcagagcagcctgtggagtggagccggggaaggcattggagggcaaggtctgttgggcaggtggtgacggctgcaggctctgggccctctggggaggccggctggggagagctgggtctgggtgtacgtcccaaggccggggctgttctgcaggggacgggagtcccaggtacgtgtgtgtgcacggatcaggactgggggaaaagtctccagaatgagattttggaggtgtccggagttgggggctgagcgggtgtggacctctagagccctgtccccaccccacctggaagttgtagctctgagttgtggggctcagagcaggccgaggaggggtgagcactggtgggtgtcggtggggggtgtttggggtgtcatgccccaagcctgtgccccacccccagcatcctggtttctgggagcccctgcttatgagatgccaggcgttggggtgctctgcctgggaacagctattgtccctgggtcagccccagcagagaccgaggcaggccaggtctggaggaacccctgggtcggtagtggcttctctccagcctgcagacccccaggaggtgacttgctgccctcccagctgtggaggtgcaaggacccctgggtcagtagtggcttctctccagtggtggaggtgccgggagaaggccgagctgtgtgcccagcctctagaagggcagatgcgtggttggcgggagccgggccggagctgagggcgtctgggctggtggctcctcctgcctggggccccaccttgggctgggggttcgctcagctggtttggactttgaggaggaggagactaagcaggacctggctttctcccctctggccccggcgccrgggcccagcacccctgctggaaccttcagtagggtgagatgcagcaggtgagcctcccgccctggccttgccctgagcacttcaacagataaaaccctgaggaagaggaggcggcctcacgtcgcacaggaaggccgtgtggcgctccgagacaggcgggcgttttgtgcaggggagcggcgcgaacgctgaacactacccgcattgtaatcggagaggggctggggaagagagagacggagcgagggcggctgaccccacgctcccgggggacaggtgggagaggcggaacgaggagagagtgaaggattccagaggtgggccggcttcctctctcgcagacagacacgggaggaggcgggcagcgggccagccccatacctgcagttccaatctgtggtcctgacagctgcagccactttggggagggggagggaagggggctcatcgagagcggaaaaatcccagccgacacatcagccggttgcggcctgtgtccggtgcagtctgggctgggggcctgtccttggggctgggcggcccccaggagagccctgatgctgggtctgtgtgtgcccccggccggccggccggggctctccgtgcggggcctgacccggaggggtcacatgtgtttcctggcagcccgcaggtgctgcgctgggcggggcgggtggtgggcgcaggcgaccgtgatgaatcatgtgtcccgccagcagctcgttccccaggccggggacaggagctgacagctgaggcccagcagagcgtttccagcccagctcggctcgcaggggcggctgctggcccaaggtgcaggctggggccccttccgtcccagctgcctctgtggggcacaggcggagggagccctgggtctctgtggaggtgaggccagcactctgggaagggagccaggggctgtggtgggcagggagcacctgccactcgtctgcccggcggctgtgagctacgagtggattcgggtgggctgccgcaggcctgggggtcagcccacgccacccccggtctggtttgaatttctggagcagtggagggtgacggagtgttcctcccccgcccctcccctcttgctggctggcgggccgggccctcggccgctgctaccggtgcagctcagggagcggctgggctggctgcccaggcctgaggctggccaagctgcagccgcggtcggagtcaggcccgcagcggagggcttggctgtgagtgctgcaccccaaccagcagggccctggggatcctttcagctccgaggcctccaggtcgttgttccctgttcactttcttctagcctcgttagacaccccaaactctgaccccagtccacgggggctctgacrtctctttcccctgcactccctcttgaccctgcccagacctccccatgctggcccgcaccttcccacctgctcctgtctggcctcctgcattcccgctctgagctggctctgccctgtccttggtgccggccgccgacgccccgcacctgcccgctcaggccagcagcccctgatgtccctgccctggagactttcactatcttccatcccatttgtccccaacgttgacyggccactgaggttgggggttcatgtggaggtttgcaacccccactaggcccaggtctggaaatgggaggcctggaggtgaggggtaggtgggctatggaccctccctacagaactacacccagtgcccagtggagggagggctggcgtgggcgccgtgggccttagggtgctatgcagagtgcccggcctggccatgctcctgggtccaccctgctcctcactcaccagcgccttggtgcctgggagggtggcggggcgggggtgtgaggaaagctcccaagaagggaaggggctgcgtcagcccctagctgcatgtccgtgtcccccgggccctggcttcccggcgggcggaggcttctgcagtgactgagcttgtcctctcctcccctccctctggccagctgtgggctcctgcaggattagggagaggaaatttggggttgggtttctctctgaacgaaacctgccgttgtgactttttatcctgttatatttctatcagattggactcagcccccctctagcccttaatggctctggctttgagaatttcctccaaaattacaccactgcttcctgctccgccattccctggagcctgtctttgcagaggaggggcagtcctgggccagccctgcaccgatgcccacgtgggccacagcacctggtctccccccgagggtgcgtccctgcctgtgctagcggggaactggggccggccgccgccctgacgcccgcacctggcaccatcagccattgtccacccagccggaagttaggctgtggcctggcagggttggggggaggtggtccacacagcaccgcccttcttctctctgtgcccactgatctcacaccactcaatggtaattgtcacctgcagggttttaatggccagccagctgtgcacagagcactgtgggggctaaacccacctcctgtggtgggcggggtcttcagggggctggatgggccgtggtggtgggaggaggatggccaggggtcctccttcccacgtgggcagtgcttccaggggccaagtggcactggtgcatgaggagatgcccctctctccagtcaaggctcgtggaggcaggacacccactgccctcgctggggctgggagccccccctccgctgggcagcacagctcgctccactccttgtggccacctgcagcgccctcctcaccctcagggcccccgggtgcccgacaggcccgagtcgggggcacccttgccctgctgctgcctctgtccctgccgctgcctccctgtccctgccttacagcgtccctgccttgtgcctcgccctccccatcttctgccacgcagctcctcccccaccctctctcccggcgtggctcccttgtccccaccccacagcttcccgatatgaggctctgtgggtgagctaagcccatcctcaccgcctcagcccagggaggggtggccctgagcctggaaagtgggggcttcccagggagccggggtacttggcccaaggaggatgggaccaccaagggtgggaatggaggctcaggctgggggctgggggtggattctgaacctttcatgaggacagttggcctccatatttggaagatactgttttgtttttaattatacaaaattttcagactttatattatcatatcaaaaacacaagatgccatcacacagtggccggaagaaaagccagcgcagaaagttccagtgggcccgggcaggtgctggggccagcgcagagtcccgctgccggcgcctgtctgtacgtccgtctgtccctcggccccgctcgcagccagggctggcctgggggcatgcttgcggtgggccttgcccagctcaggtccaaggtgggggctgtctgcagtcaccccgggcgtccacctcccccagcagcgtctgcctcctggctgctgccggccacctcctaactgcgaatcgctgtctttctgtcgcggtccttgctctgcagaggggagggaggagtgtcaggccccggcagagcccagcgccagtctgcgcctctctggcctccctgctgggtgccatctcargtggccagcgccaaggcacctccttcccggctctccccagcttccctcaagcgttttggggaggggagcatactgctgcacagccgaaattgtaaaattaaatttcccagatgttcaggccccaggagctcgcgcgtgctgtctggagaggaaatggggattgggaaaagccgtgccgtattttctccctgctcaccctgcttttccggtgccaccaagcacagcaggagctgtaaatcacagctggccagcgtctcctgcaggggccctcacccccagcccccacatctcctgccagcctctgccttcgtgtcccatggcccacgtctcgggcagccctacaggacctggtgtcttggtgtgcggcctaggtgggggacggacagcaggtgcccaagatggcttaagccagtgctgggccgcaggggctaagaacccggggtccttcctctcttgccttgcagcctcttactttctgaactcagctgttttcactccgcctttcaacttactgaaaagggaagcttgcagcggcctggtccagctccccagcctccccgccctgggtgggcccctttggccatccctagctcttacccctcatgcagctccctgcaggggactccacactccactgggagccgagtgtcctagggacgccctsgagaggagccccaggagaaggccccagcccccggcaggcctgtgttacaggtgtgcctgcctgtgccctgttggggagccctgcccgtgtggcctcgcctcctctgcctggcaggtgtgggctgaggggcgcgttggaggcccccctcggcgccccacggcccgtgctcaccaactttctctggttgctgaggcagaaggtgcagatctgtttgggctgggtgttctcgccgtcgcgggcgggaggcggcgggggcggcggcggggggctgccggcgcgcgccgcgtggaagaaggcgggcccggagtggcagggctgtccgtcgccgcaggcctcgcccgccagcagcacgttgcccaggtgcgagatgtagctggaggccaggcgcagcgtctcaatcttggagagcttgcggtcggcgggctcggtggggatcagcgtgcgcagcgccgtgaaggccgtgttcacgctgttggtgcggtctcgctcgcgcgcgttcgccgtgtgccgctgccggggctcacggcctggccggccccctggccccccgcccccggcccgccggccccccgccctgccgccgggcgccctggaggccgcagcgcgccgcgtgcacgcgacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacatgtgcgtcccgggccggacggggccccgactgcgcctttatagcggcgtcccggcccctcccccgcgcacgccccgcccctctcagcccgggaggctcctcgagcagcgcccgccgcgtccctcggccttctgtggccacgctttggcgggggtggggggggcggggctggtctttgggggcatcgttccgtctctggggatgcggaggaactgggaggtcgcttctgggctgtagttactcagggccccaaaactgcagtgccccccgtccccgggagaggggaggaacccaccaccccgttttctcccgtggcacaactgagttaacccagccgccctggccctgctgcctgaccgcaccctgtctgtctttgcctcccatgtgcgccagcgcctgcctgtgccaggccgtgtgcagggggcgggcacaggcgagtatttaggggcctagagctcagtctctccgcctgtctgtcctgcacctgcctctccaggcttggcacagactgtgccttctgctagctggccatgtcccctgttcttgtgctgtgtggacctctcaccccgtcggtctccttgccccttcctccttcccccgttcctctccagggccaccaggcccctcaggaagcacacacatacccccattatccaatttggggatggccccctatctccatggggaggagagggaaggaccctcagcagggggcagggcccaaggggtccctcctgcagcagggggcccggcaggctcccagctgtgctctgtcttgcctgggcccctccccgtggctactgttgcaggaagcagcctcctgggcagcggtccccaggctggaaggagcgagggtggcggctggcaggggctgcaaccaggaatgtacgtccaggaacgtggctgttctgcctggggaggggccgagggcagacggtggggggtcccccacagagaggtcttggcttctgcctctctgtggaatgggtcagttggggtcttccccgagtccccgtcttatagctgcccacttctgcctaaggcccctgccaggggagggagcccgtgggtgatgaggtcatccctgtctgtggctgcccagagccctggccaaggaatccagtgaggggggagctctggggttggcaccacttcagtggaaaatgtgaaggtgcagctccggcgcctccgagggcgggggtgggggcagcgtggccgccatgccacgtcagaccccagggctggggaacaggcgtaggtcagggccagtgacctcagggcacttgaggctgggcctgcactccccctgcaaccccctcacctgctcccctgggcggcccgaagcgggggtgggccttgtaggatcagatgccgacatggtggcccccggctgcaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggtgagggctggtggggtggggccagcagccggggtgggcccgaggggtggggcagggctggcggggtctgactggcggtctccaggcgcaccgtgcaggacccgatgacagggcgggacctgagactgacggatgagcaggtggccctggtgcggcggctgcagagtggccagtttggggatgtgggcttcaacccctatgaggtaggtggcaggggctggcccctgggcggcgggggtcctggaggcaccagcagggcctcagccactctggcccacacgcccacatcttctcccccagccggctgtcgacttcttcagcggggacgtcatgatccacccggtgaccaaccgcccggccgacaagcgcagcttcatcccctccctggtggagaaggagaaggtggggcacacagcccctggggcttggcctgggctgaccgccccgcactgcccgtcctgacccggctgtctatgcaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggaggtgggcctgcatcctgggggccgggaccctgtccccatgcttccctgtgaccctccccacccctgtgtcttggtctccacagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgtgtgggggtggcacaccaggggggtggcacagggggcaaggctgacctggcgctctcctgccccaggtgaatgtagaccctgaggacctcatccccaagctgcctcggccgagggacctgcagcccttccccacgtgccaggccctggtaagtggagactagggggctggggttgcaccctcccagtctgactcctcactgccgccgcctcctcaggtctacaggggccacagtgaccttgtccggtgcctcagtgtctctcctgggggccagtggctggtttcaggtgggtcygagctgggggcagccttgagctggggggcaggtgggatggccaggtgttgagagctgtctctgccgcatccaggctctgacgacggctccctgcggctctgggaggtggccactgcccgctgtgtgaggactgttcccgtggggggcgtggtgaagagtgtggcctggaaccccagccccgctgtctgcctggtggctgcagccgtgtaagtggaggccctgggggctggggagccaggggtggcactgtgcttaggggccgtgtctgggcctggctcacagggaggactcggtgctgctgctgaacccrgctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaaggtacgtggggcgccttgggggtgaggctgcagcgggaggggccyggctcagccactcagccagccttgctctcctgcagccagtgacgcaggtgacctggcacgggcgtggggactacctggccgtggtgctggccacccaaggccacacccaggtgctgattcaccagctgagccgtcgccgcagccagagtccgttccgccrcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgaggggtgggggcggtgcaccctgcaggtgaggggtgggggggnnnnnnnnnnnnnnnnnnnnnnnnnnnnnnnnnnnnnnnnnnnnnnnnnnnnnnnnnnnnnnnnnnnnnnnnnnnnnnnnnnacctgcatcacagcctttggccctaggtgacaacgtcatctgtgggagctacgatagcaagctggtgtggtttgacctggtatctttccaccaagccatacaggatgctgaggtgaggaaagctgggggtggaggcggccagcagagcccctcccttcagcccgagcctgccttcaacctggttccctccccccagacaccacaagaaggctctgcgggctgtggccttccacccgcggtacccactctttgcgtcaggctcggacgacggcagtgtcatcgtctgccatggcatggtgtacaagtgagtgctgaccctgcctggccccctccccagggcagtggtgtctggccgtgccctgagccctcctcgtccccacagtgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctgcctggtgctcccaccttcttgaattggggttgccaacaaagccgcccccaccacagcgccgagccttcccctcactcaattttgcaaaaacagtggggacaacacagccagtccagggcaccctctggcccatcccctaagaggctcagcatcgcaccctgtcagtcactcgctgggagcagatgagtttattgggcacatccctcactgaagggcttgggtttggtccccagcagtgcctgttctggggccaggcccctccagtcgtgtgcccaggctgtggtcctcaggaggccctgtcttggagctcaggcacaggtctgggtgcatactcctcgctgggggtgctggccggagccttaggcgagcttcaccaggcggcccagggcctcagcagccctcgtccgcacctcgggggccgggtccttcagcaggatctggagcgctgggggtagaggaggggggctgcctgcgggctgtgacctcggcatgcccatgcctgcgcgtgggccacgctctcctgacagcctctgctgggaggctcaggagccaacggaaagatcgtttttccttttttagtgttttttaagctctcttggaacagttaagaagtttccgtgaattactagagacgatgaggtcaccagtgacagggaaaaagtcctgaaatccaggaaaatcacttagtccctgcgggtgcctacagggtcagcagggcccagcggaggggccccgtggaggggtgctcacccgcaatgagctggtccaggtccacctgcggctgctgcctgggctccgagtgcagcaccaggaaccctgtgaagtgggggcatcaggcggggctgccgggcggcgtgggggtggggcagggggtggtgcttaccggtgaacaggggtgcagcagctcggacgttctcccagctgctcttgaagtagaacaggcaggtggtcaggagacggcccagcaggtctgggaaatggtgcatctggggagaggcctggtcagtgccgcctggccccgccccacccaccacgccccgcctggccccacccctcaccaggtgcttgcaggtggtgttgaggaactccccgaagtgcagggctcggccctcctgcaggtgtttctggaaagcagctgagagctcctcacatgccagattggggccacacatgcgcagggcaaacctgcaggcctaagggatgcggcactggggccaagtccagttgaggccacccaccccatcccactcaccccctggctactcacgctggccacagtggcctgagggtcctgcaggtgcagcagcaggggcgccagcccgcccaccacctggtccaggaagacgtcctcacagtctccgtggcagaccttgttaaggtgcccaaagaggcggatagatgccgtccggaactccatcttctcctgggaaggacatgcagcatacgtctcctcacaggctgtgcccctgcaggcctgcctgcctagccccctgccattgatgggtgcccttgcctgacccgggccaggaaacaccccgacgggtgggggccttacgggtgggggctgccaggcccagcaaagcagcagccctgcaggtccgcgctctccacggtcacctagccgaggtgggagacagggaggagggtggggctggggctaaagctcagagtaagaggcaggaagggctggggccctcttccctccccctgccccaaccagcctacactgtcgaagaaaggccggatgcggatggccacgtgcagcagccctgagcgcaggtcccaggactccaccaggtgcaccagcctcgcaaggcccagcatggcctccagggccactgggctgtgagggttgtccccgtcgtccagcccgccaatcatggctgtgaggagctgggggccgtgggttcgcacctgaggataccttacactcagcctgggtcccagagtcaccgtctgctaccccacaagacagggtggcctccatgcacagccccccacccatgctgcctgggacccagaggggctggtggccaccccaccttgtcagggcagccggaggccaggttggccaggccgcggagcaccagcctccgcacgctggcgcatgtgtccttctggcgagccgccaggctctccagcagcgagtccaagagcatgaggtcgttggccacgttgctgttcagcagctgcaggcagaggtgctgtgacttccctctccccgctgaccccagggctcaacccaccagcccaggcccagaacaccagaggctgtccccacgccggtgtggcagacagaggtggagcacctactccctgggtctccgatcagtggcgacccctccctgttgtgccactggggcctgctctgacgcccgctgtgctctgctgcacggccttgggcaagattttggcatctttggccacgaaggccaagaccacaccaccaagggcacctggggtcccaggggccagccctgtccagctacaaatgtacccagcaggacttggggagagtacaggctgcagggagcctcggtcctcctctcaccaggcacagagggggtgtccctgggtgggactgagtgagttctggcatgggggaggaggtagctagcatccacataacctccctcacagaccacggtcgagggggccttttaggggtaagaaaagggcatcccgtgcctgtcctgagcaggagccccaccttggtgcccagcatccgtccctggaagggcctacctcggccaggaaggcggtggtggtcaccctctggttctcatacgcactgctgtgtgtgcatgccagcgtcttcagcaccagggggagtcggggccctgcgtgctcagccatggccctgggaaagggggccgctgagggtgcaggggctgttgctgtgctgaaccctacccaggcaccttccaccctgcacagccctggtccgctccaccgccagctgccaggttctgggagttctatgtttcagagatgcctcccagcttgcctcgccaggcctctgcaggggtgcctccctacccctgccccagagagtgaacaggcaggagcccagggcaccattggcctgacacgcatgggcccccgcctgatcctgtcatgttctgggctcgagatccggtggagcccagccagtgctggagctgcagtgggctgggcccgctcacctggccaacctggtggccccctcctcatgccccgccgaggtcctgagcagttcccagcctccctccaggtccatgcgctgtaccacatcctcgctgccgctgcggagtagcatggaccgcagggtgtccactgcagagctgcaggattgccagggtgctcagctggtagggcacacacgcctacctcccttcctgattaactcctcaggtctgcacccaatgcgtgttgcccacctggtggctagccctatccctgccagagccactctccaggaagcaggctctgggccatctgctagaggccccccatttccccacccaaggcaaggacgcagatgttggcttggaggtgagctagtagcaaggtcagcctgtggccacctggccaccagcctgagagctggacacaggcaaagccctctggctgcaccggccttcctttccggacacccagacgctgctgggcacccacaccacaggtgccccccaccccgggcctgttcctgcctggcacctcgggttctcacacctgtaccccaggagactccacagccctctgggaggcgagcaggcccctgatccactcccagtgtcggctgaggctggctggcaagtgagcgggaggatggtgccgagagctggaggggctgctggcgtgctgaagagcaggcgccctgggcgtgcaatgggggccaccttggccaactctctgactccccagacctccaccaggcaagcaccttgccctctggtctccctggcagtggctgggccagaaactggcagggagagtctgatgttgaagcctctacagggcccagcttgagcctggcatcgaccatcggctcagatgagcccttccctgctgaggctgctccactcctggctgccagtgggtggggcgtagtgtgtgacccaacaggcacggtctggggcagaggatgccctgcaccagcgtccccacccagcaggaccctccatttcaactccacagcccctgccatgtggctttccgctgccctcgagcacctcacacttaggcccccgccgcctttggacctctgtccccacaaggcttcgtcctcaggagcacctggcccaaaagcagacaacccccgagcggcatgggccgtgtggtgaccgctggtggtggtgacagtgccactgccctggtcacctcctgccaggtgtcccacagggcccctggtgtgctgcgacgtggagtgggcctagcagggaacaagtggccccgccaagctgggggccaggccctactcgcctggatggtgtgtgaggccctcatgcaggtgggatctaggaggagggtgtggtgggcacaggagcatgagacaagcttgttagagatctggtgatgggccccatgaggcttctggacggttgggtacacagggctggtgatgccggcaggaatgaggcggcctgagagctggacaggggctgtaggagctgagggccacgggggtctcggcagcccaggaaggaggtgctgggggcctgctcccagtataccactgtccccatggggtgtgcctgggtggtctggtgctgaccaacagcagggccagcccctcacacagcccttgatgagtgtccccaggctcctctctctcacgggttccctccccaaggtcggacgtacgagaaggcagctctggaaaagcctggagtcccatggttccagtgttggggcctgatctttgagcccaggtagcctgggtgccaagggggcttccagccctgggaacaggacagccagcactgaccacaggcagaggacagagccacaccagtcactgcagttcctgggagatgcccttgacacatacaggccaggccagccgcaggcggagggaggacccaccgggccacagtcagttcagctgggcctcgtggtctgagccagggcctcatggtctgagccagggcccagcttgagtgcagctctgcctccagctccacaccctgctccaggcctcgagccctgcaaggccccatctggaccaggggctgcgctccaggctgcaaatggcgcaggcacagcaactcacaaccagcatcgacaaatctaacgggaagcgtgtgtttggctcacgaatgtgttagtgatttggatgagggtgcctcccttgtttgtgtgcccaggacatttaagaatgtggcacccacaagggtccgacccactggcgaacggcctgtacaccaggctctgcaatcgtcccagtgaaggggcacctgggggtgggcgtggggcccgcagccctacagctcggggcggaggcactgattcgcagcaggccaggcccaggggctggtggctgccccatcccattcacattttccactcagtttgctaggggcagagcagcgctggcagccggccccactgggctttacgagctggcctgggtctgagcagcctgtggtgctggggcagggggagggggctgaagtgcggctgtccccctggtgtgtcctggccaaggggggcagggggaggggctgaagtgcggctgtccccctggtgtgtcctggccaaggtgcacacccaaacctgggcgcctgggtgggatggaaccatagccctcctgggcaggtggggcatggcagccctgcgttcacatgggcttgtggtcctggggtcaggccacacagccacgcctgcccagggtgtcagcctcctctgtctgtgctatggccccaggcaggtgtgtaggacctggaatgcttcatgtcaggcacctgggcagctcttacgtgtggggctgtgaacacgtgccaaaggccgctctgctggggcagtttcagggacaaagctggtcctgccatggttgaccccagcctataccccaaagactccacacaactccactcccaggagaaggcaccacccggatcctgcctgagctgccacacgaagcccccaccagctgcctgtgttcagcaccaccgtgcagaccgcccgcagaggcgaggagggaggccttcacagccagtgtgagaagggtggccatggatgtcaccactgacagctcagccctgcacctgggtgaggcgccagctccctggaagca

SEQ ID NO: 17834 - DNA, 25458 bp, Homo sapiens
ctagccacatttcaagtgctccatagccacatgtggctagcggctcctgtactggacagggcatccacagaacagtccatcatggtggaaacttccactggacggtgctagactagatggaagaacggaactgtgagccttgggtatttacatttatttttaaagacgtaggctgggcgtggtggctcacgcctgtaatcccagcactttggaaagccgaggtgggtggatcacttgaggtcaggagttcaagaccagcccggccaacatggcaaaaccccgtctctactgaaaatacaaaaattagccgggtgtggtggcacatgcctgtaatctcagatactcaggaagctgaggcagaagaattgctcgaacctgggaggtggaggttgcaatgagccgagatcgcaccactgcactccagcttgggcgaaagggtgagactctgtctcaattaaaaaataaataaataaataaataaagatgtacacaaaacagtttaattgtggggtcactttatagaagcttctttaaagcatcagctttccaactgcacacaactgtttcccctaagcaacttccaaggcacaaacccagtatacattctctcctaagcattatctcagttgtacattcgattgtagaatatctttcttccttaaaaaaaaaaaatctctcacccaaaacttaagagaaaggggtcatttacaggagaaagggcaaatcattatttttagatggaaagacctccctaagtcaacatttaaatattaaaacatgtagcaggtagtaccaaagggtttctccttcatcacacttgtatttctttactgtcgaaattctctgcccaggagtcagctctgtgtgagctgaaagcaagtgttctgtttgctattgcacatccattacaagcacagtgcctgcctgggacaaaacagatgcttaaatttttgtggaatgattgaatgaaacttaagaagaatggtattttgctaaagaacagcaaacatccttttagagcctggttccaattctttatatttggatagcaatccaccctttattttcaaatgcaaacttaaaataacttagcagactgattcatgcaagtatgcatgctacagctcagtatctttaatactcagcaaaaggcatacagcatctatgtcacagtaaaatatgagctaacatttattgcagttaaacaccaggcccaacgctaagtgttttacatatgctattgcatctgcccctcactctgatagtctctctgctaccaggaggaggaaaccaaagctcaggggaaattaagtgactggctcaagccacagggctagagatgtatagtcagaaaagctcccctggtgaagactatggacgatgcccgtcatatagcctgattggacaattcctgctttaatcaggaaggctacgattgtcctcgtctacaaggacctgcctccaaggaggggcatggctctggatctttgcagccccagagcttagttgagcacctgccctgcaggcctcccacatatttttgtggagaaagactcagcagtcctaatggcttaaggctactcagacttggagaaggccccttctacagaagcaggcacagctcagcacaccccgtctccctctaaaccgaggctgcggggaaatcactgtgaccttgccactatacagcagcttcatgctttggccaccgtgttgcagcctctacggccactctgctctagtaactggcctccttctgcaaactgaccagctgcaccagcatcacggggctggcagcacttccattattctttttcttgctattcagaatttcaacctaataactccactgttttaaaaacacagtgctttagcaagaacctgttgtgctccaagtactggtcagacaactgcctttaaggggctcactttcctatttggcccaattccctcagattagggtttccagaagtctgacctataagcattcattttcataaaaaccactactgacaaagcaacaggttctaaacgtatacattaaagagctaattttttgttggatcaatatttgtcaagggcttgccaagcgggggtacaaaagtataataaaggacatcaatccatgtgggggaaaggtaaacaaatattaatcaagtccctagtgattctacataattctctgtaattctttctgcagtcctatagcatagataacatctccatctatggatgataaaaagcactgcttgtaataactcacttcctaagtacctgcaaggcacgaattcagggccaggcacagttaatcctcataactccctcaaggaaaaggtattactacttccttctccagaaagacaggctcggggcgtctgtctgggtccgaggtgcccacgctggctgagagcgctgaagtggagtcagacacacaggcctgcctggctccacagaccatggtgccattaaatgagactgtcctcactctcatggggggacacagagaaagctccccaccccaaccacaggaggaaaagatgactgtgggagaacacatcaccatacagcatcagtgtcccattagcgcggaaggcaagattgacaggaaaaacaaacaaggaaatagtacagtgggatgcgcaggggctgtatgaaggtggttctagaaaatggggtggcctggcacaggggcagccattccagaactaggaaggcagggtaaggtactccacatgtgttggggggggcaggggtggagggagtgagaggggaacaaagaccaaggcaggctaaagtcagaccgtgtagaacccaaagccaggccagggtactcgtactgcctcatgcaggaaagggggaaccagaacactggggcagggattaaagtagtgatgggagattcactgggtgtcactcaaagcttgtctcaagtcacagggctcttctattcccccgacttatctgaacaggagaaatcctcttggctcccagacccgcctgccctggcattctcccgcagggaaacatgctttggttgttcagacgtgacttactggcacttagaggctgttggcatggaaaaaatgaacaggctgacctggccagaaaggagcaggtgatgcagaaacccagcaaaagatgaattcaccctgccaccctgagtaaattacaaagctcatatgaagggccgcagaagaaagaatgggagagatgatttaccagacagagaaggggaagtctcagccctaggcacctcatgagcccaggagagtgccaggcaaaatccctaaggcacttcactgagtcctacaacctcgcatagacatcactgtgctcatctcaggcaggggacacccaggctcactgtggcgaaagcacctggcccagatgagtaagggagagaagccggagcacacatcactggagcacactttattacagtgtctttctgccttcaatcacttgcccagttttgtaacttcataagagagtcatgatgcccagaacctcatggccccggggcaaaactctgcaccagctctgacactctccttaacctgctgtcaccacacgatacacaagaaccattcctctcaaatcacgaaacaaaggttaaacatattccaccaataataccacgatatgcattaattccatcagtgtggaaaactattccttgtgggagagggcgcacagacagacaactggaagagaaaaaaacagagagaaatccaagtcagatgttgtgcctaacttgaggcaggacttttcctgggatttaagtaggtctggaggctgctctggcacatcctggccacccaggccacgccttacatttctatttgcaatgcaccttcccctcctcctccactccccgcacttctccccaagtgccccatcactgaaaaagttcaggggccgcaggggctgagacggggcgcagggcaccgaccctttcaagcggccacggctttgcaacatgttcctgaaattcctacaaaccaaaaagcaattcagaatcgcaggagggaggcttatcctccactccgcaaaccagaccctcaagatcatcttttttatgctgaaaaggcttttcacaaaatattccaaaccatcttcatagattatttttcctttctcttaaaaaactaagcaagactggatgtcatttagaataccgacttctaaaaaagggcatttttgaactgaatgccacatgctgtattttgccattttgcctgcgcttcctgcttggagcctgtgacacagagaagcctcagacactggagctgctccgggccacgcaaactccgctccgcatcttccaggcagccctgtcgcaaataattcatgtccactacgcccctatcacactgaatacaaccacattgtactgctggaaatgggaaacctgattcagatcacaggagaaggtagaaaaacatttggttcaacacaatactgccccccttcttttttttaaagggaggaaacatatttcaaacctaggaatagggaaaggattcaagacccatcgtggaataaaacacagaatttaaaatagcatccgatgtgacccaaaccagcaacaataacgagaaaaccacccagtccttccagagatgcaccttgtttctgctgcagtgttgctaatcaaaatcgatctgcccatccaagcaatttaaagaggaagggcggcatttgtagaaaatggtacatgttgataaagcatgacctgtcccacatggagagcaataaaaggaaaacaagcctgagaacagtatgctgtgctcaccaggagatggaagagaagaaagccagaataagggcagggatgccgggggaagggaggacggggtgtcaaaggcctgcaggatttttgtaaacagcagcccgtaatggccacggtgagagagaagggaaaacagacatggagggaaacgtgtttacaactgcagcgacggcgggaggcggagggagggattccccgactctgcactctgcgctcggcccgcttcgctccggtggggccccggggctgggatgtgttttggctcctccaccctccacccgctttcttagtggggggaacacatcttgtttatggggaaggttactcctcctctgctctggtgatcgcctccctaatactcctgctgcatccttgcgggatgcccacttgactgacagacactccagccagtcgctgcccgggccccgcggaaaggtggaatttcccaacgcagcgattggccggcggggagggtgggccctggtgattggcgtgttattcggagtggaaagtagtaaacaaccttggtccacggcggcggcgcgggcgcggggtgcccgctccctcttccctcgcccggggcggggtggggcgcgcgcgccagacaaaaggagcctcagcccctcggaggggagagcaggaagggcgcacaccacagccggcggagcgggcgtcccccggagcccctgcgccagaactgctgacttgcagcttcacatcatttttgttctgtggaaaaccgcaaaggttttgtttccataattcggctcctcttcttcgtcttaggttttagaaagtctccaaagagaatggcaatttagttcctcctctttcctgccctccaccccaaccctccaccttttaagattaatttttagttctgtctttgcagaagttgttttaaatccctgtactaaaaattgttgctttattcacacaatacgccattaagggcacacgggtgaatcagatgccccgttagtccctttccttgcaagttcctggagctgtgatctcactgggaggggctgagtttgggagcaggcataaaaagaaacatgatgatattaggctcacttgacaagaaataagcagttacaccttgccttttccacacaggatgtagttcacccaggctatcatctgacattgctaagtccccttctggttggtcttgactcacaacccattcctcattctggcctctccatcctcacaggacccccagccaggggaaacttcccagcttccagcgggaagtgcygcttccccaaattgggcagcacctggggatgcctctagatgcataatcacctcagaggtcctgagccagagtccagagattctttctgagattctggcaaggccccggggtactgatggaggactgggaaggtaggagaaggccacggggagggggaggctggacacaggagggatctccacttcatttatgtgctctttggtgcttcgctctgatggtaagtcacgttgtcactcttggccagacagccagactgtccaagctgaaaacgtaaacaaaagctccttgcaggaagcaacagggtgcaaacttgccacctggggggcctctctgccaccccttggccagccctctcctccagcatctggccccaccccggccctgcccgcctggcatgtaaagcaccccctcctctccaagcatccgttcctcagccgctgtgttcctgtcgcaggtccctggatgggccacacacaaaccttcactcagcttattctttctaggccttaccctgcctgcccgggagaggccactgttctccacggcttcccttgccctggccagcccacttcctgcaggagtgctccgaaatcggttttggtagcactgtgttaaggttgcagatggtgttttcaacactgtactccgactctacttgcaggtttctccacctcagtagaccctgagcataccagggcaaggtgttatattctaatttgtgtctccagtggagacacaggtccacaatatgcactcaatcaagtcttgccaaacatttgcagcactcagttctcgtcttgtccaacactcacacctgcttctgctgcccccaagtcaagtacccctacctagtttcttgctaacatgttaacatggtacccccccccaccaagtgccaagcccttgtccatcactcagtgattccctgtacacatgcagttacttgtaacgtatgctgcttcctctgccagttatgcttttctgacttctcttcttggcaaattcctattctgtctaaaaatcacttcttcccttggcaacatgccacaagttccacctgactcctctgtgctcccagagcacctcagagaggcctcgttgcaacctctgccatcttccgaggacatggctacagagccacagctggcatggtttgctggaagaaccaagagctgaaaggcagatttaccaggtggtgccccccccaggtgtctgcagaacccacatattccagtctccagaccatggaagcagtgctgtttccagcttgtctctgccacagggtccttctctgctctctcagcctgaaggcctcctctgtgtctgtgagtggctggctccttctcaaccttcattcaggtctccgctcaaacaccaccctcaccaccatgcccacctgccagctactatcacacagaccttcattttcttcatgaggtgattctgaagagaaaataagcttgggagctatcaccctaacttacttattccctcagtgatggaatttgggggacattttcatcttttgccatttgaaacactacaatgaacaactgcacaactgtcatttcacatgtgtgcaagtctatggggtaaatgccccctctaagattggtgggtcaaagaatacgtgtttataacctgagagatattgccaaattctcctctatagatgtgctattctgccgtcctcccagccatgtggggttgttttccaaagagtgtgttatcaaatattttggattttttccaatatgagaagtgaaaaaatggtatcttggtgtagttttaatttgcatttctcgtatgagtgaaatcaaactttttttctatgcttagctatttgtgtttcttcttctgtgagctatctgttcaatacttcatcccaaatcctattgaactgttagcctcttccttaacaatttctaggagctctgttttactttgtttttttaaacaagggagattagctctttgtgatagaagtttcagatatttttctcagtttggcatctgtctttgcttatggtttttggccatgcagaaagtttttttgtaatttaaattcaatttttatgaatgttttcttttctggcttctggattttgagttgaaactagaaaggctttctctgctccaaggttataaaaaggaactcgctatgtgttcttccaggactttcatagttttgtttacacttttaccttggattcacttggagtctagcctggtacatggtataatgtatgaacctaatttactttcttttccagagaaaagaaacatggcatgattgggccataatttacatgccccaatccagtaaatcaagagtttatcttagtcccaatgatttgtgaagctacctttatcgaataactaaatttccacaggtacttgcatctacatttggactttctattctgttccattggtctgtctcttcatctattggtatctcactattttaattatttaggcactatggaagtttttaatacctggtaaggactccttgctcttgttcagttttttgtttgtttgtttttgttttaatgataacctcagaatctaactaaaagaaaaaaatctgttgtatttggatttatattaaattgaaaaacttacggagaactgacatcttgccatcttgctaatgatgattattcctgtctaataaatgtggtatgtctttccatttattccagttgtcttctgtatcttttaatagtatggttatcttaaggtgttttctctytttattttaattggatgtagaatcttcagtaatatcatctagcaagttatttgcatattgtacagttgtatgatgataaatttgtatgttatttctggcagaagatgttctattctgtgcctttagaaggacacaatgggatgggggggaatcaaagggtgatagtcttaacaataaatagaggttgagatcctaatcaagaatcaaagcaatacattytgagttggcattcacaaatgagtaagtcaaatggtgtggggcataatgctggggtggccatggaagaattctgcccaacagaggatgatgttccttaagcttccaacacagcaggttcagagaggttaggaaaaataagcaaggsaaagaaacaagtactgatctaacaatgacggaagctgactccatgccttaktggatgcttgcggaggatggcactatcttggctgggctgactgtattagcaatgcatgtatctaaatcagctctaaaacccatagagagactggcactttagtgtgaacacgtaaactgtgggtgatggtctgtatttcacataagttgtgatcactgcaaggctctgctggtattttacaagtcaaaaacaagtttcctcttccacagccatatgtttgaaagatatgtccctttaagaataatcaaactctcacccaaaacatgtatttttcaaacctagaggttccaacttgaaatactggaccacagggatactcagctcagatcctctttcagaaaggacttgctgtccagctccagagtgtcactagcagatgccctccagctgctagctcttctagggtccacttcaacttttggcctaggtcacactcttcctaggcagctcctggccagtaactgagcccagcaatggtcccagggcccggttatatccatctaacagggggctctgcaaatgagctcccggagggctggcagagtgtctgtcctatcagagtcctggtcaaaccgctccccacacccatcatcttcctcctctcttcctttcattggtgttatcctcagtaaacctttcacatccctaacttcatctcagtatgtctcctaaaaaactcaaatagcaatgaaaatgtttagcaaattttgggaaagtaaaggggggaataaacattcccacataatgtagatccagacgattctggaactagaagtagaaaggcctcatcacacaagccaactaaaatgcacctcaaaggttaatgtcatcgaatttcaaaagtcctcgaaacttccatggttataaacgagcatttcctgcatgctggactcttcatcgttggtctggattaatcctcacttccattctaggtggtgggtacaaggacttccattttatagacaaggaaaacctgatgtaagtaagtggtagaaagcagattcaaatgcaggcaggactacctggctccaaagccttttcctttccagatggtacactgcccacatctcttagtttatcggcacagggtcaagaaggtggtgagggtatggactgacayggcatctacggagctttccatacttataccaagacgcccccctgtaaagagtggactgtccggtagccgggcaaggtggctcataccttaatcccagcactttgggagtccaaggcagaaggatcacttgaggtcaggagttcgagaccagcctagccaacatggtaaaaccctgtctttactaaaaatgcaaataatagccaggcatggtggtacgygcctgaaatcccagctacttgggaaactgagggatgagaatcacttgaacccaggaggtagaggttgcagtgagccgagatcatgctactgcactctgacctgggtgagggagtgagaatttgtgtccaaaaaaaagaaaaagagtgaactgttccgcctttgtctgatgaaggaatataataattggcagccatacactatattcccgggtcaaggaattcctgggtcattttcagcaagcctaaaacaaggtgttcacacatttatttaaaaatatcccaacaaagtgttgcaaaatttcccttgattgcaatgattctttaagctgttaacattaatcttgggtggatgcaggagytgtccactggctttccaaaaggcatccaatgcctttaaggcagcataagagaaacactgcccctctcgatgaactgggtccctgagtctggcagtactgccctgttctccactgtgtcacctatacagggacccctgagaagaccagtgtgcatgaaccagagactggacagtgcctctgttaccatcaccgtgtggtatcatgaagaggtaaccatcccgaagtcacccaacttgtcagcagaactactgggaaaagagcttaacttttcctgtacttaaattcttccatatgtagttggagttacaggccccaaagtaaagacctattaagcttgcctatattgctcctaaattctctactcgtctgttcattatttccaaatttaataaggccatactgttgtgtcttcatcctggtcaatgcatccaatgataccttgataactttatcagagcagtagctagcagaagcacagaggcacggaggatgttaaaactgctcaacaccacggtacaaatgcattgtcagcttatgtaggagtctgctttttatgcaggcttatgcaactggtgtaattttaaaattttataagccatttgaaagagcaactttgatattaatgaaatggggagaaatgtatatacagtcaaagaaaagtgtctttcctttagctgatgtcagagactccctagaaatgaaaaattattactgtcttttagaaaaacaaaggttaaatggaaatagcactggcaggagtcatatcacaacagcaaaatataacagggccaggcaaaccaaggatattgttgcaaatgcagagccttgatcaggctcatatctcgaaccttttattttgtaaagctgccaattttatagcacaaaaattttagttagggcacctttaagattcactgcatctactatgagaagagagaatgtcttagaagagtttttaaaaatactactttgaaacacttatgggcaaacaagaattggaacactaatcactgtaatttccccaccaggatcactaggtaagacattcagagaactggtggaagcaagtgatgattcagatgcagtagtagaacagaagattgccaatcaactgcaaacaaagtgccgcacaggcccatctcaactgacagcaatggtagagagagaagagagaaagaagagagagaagagaaacgagagaagaggagagaggagggggaggaggaggaaggagggggaggaggaaggaggaggagggaggaggagaaggaaggaggaggagggaggaggagggggcaggagaaggaaggaggggaggaggaggagggaggggaggaagagggagggggaggaggagggaggcgaggaggagggaggggaggaggaggagagagaagaatatgagaagggaagttgggagagacacagcccgactgactcagattccaaattacatatgcacaaagcccctcaaaggttatcatgccctatctgatccagggtaaatgaaaactaaatactgaggcgcaattcacaaggaaagtcagagtgtctacactgttaacaacatacattgaataaagtattagaaacatatttactcttctccctactctcggtgctactgaccgtctactgaatacaaggtacaagaagagtttgctaagttttgggtactgcccaggtcgttccacggctaacaaggcaaaaacactcatgtaaactccttggtgggcctggtatgttgtgtgtggagagggtgcctgatgatgtctttgaacttcactttttggtttctcagctatctcagaggtctggctgtagaattactaatattttaaacaatgcaaatgtaattatagttgaagcatactctttaacagaaggagggaaagattggcatttagaagcttcattcaacttttggccttttcaaggctaaatgaatcttagggaagaaataaaaagttcccattgattcacttaaaaaaagattkcttgcaattaacagatctaaatctatgaaaaagggagcatttatggtaatttccataatctctcactttctctagacatttcaaatcaaattgtaataattataaaatccctccttctctctaaatacacacacacacacacacacacaaatatagttaatcagcaaaactttttctgatctcaaggaaatgtcagttacatttacacaagcctaactagtttaagcaatttatttgtaagtagacatgcctcctagattaggaaaaaagtgtatttagctgtatggcatgacacgccccctaccccaaaccgtaaatagtttttttggcagggagtcagcagaagagctataaaaacatcttcagggtatagaaagatgttcaggacttagaatataccttttctcatggttctcttatcccaacgtataaattgtgacaatttgtttaaaagattgaactaaaytatgatattctctttgtcttccaaatttatttagacttggtatcctgttctttctctggaatttcctttgcttttctttttgtcagtaagctaaattacttctcctcccacatgcataaaagcattaatttataaaacacatagccatatgtcatatctcatgtaattctattttacattccactgccgcccagacttatctaacatgaacaaatagatattatttactgtagtcagaatgagaattatctaatgccacttacatagccataaattgatttttgattaatgtttaagcaaaaagcaaacaagcccatctgctctgaaaacaaacaaacaaaaggaagcagcaaacgcatagttcacaggaatttctgcagtattactatgtttcagcggctggtgaggatggaattttttcattgctatcgtgaaaatatactgcttgacaagaagagaactgcatatatagatgcagcttcttctctagcaactgttaatttaatagactactacttatggtgaaacaaaaaacaatcccactctgaagaaagcactgaagacctataaccagyggtgaatttcttccgtattgctcagtggaaacaaaagaaagctcaaatgggtgagtttttcttctttcagggttgctttctctatggatcaaggtaagaaggaagaaaagctaggtctcctatctatctcacacagcagattttaaaatattttwaaaatattttaaatactttcaattttttaatattttaaaaacttttaaaactaactactgtatcgtgtacctatgaaatttcgttttcagtgcaattcaaaattgctaagacaaaccaataagagaagtagaaacacgaccagaaggccctgtcctgtttattggtatcatctctgaggcttcctcagtatctcgcacagtatctgtcagttgacagctctaatccgtttagagttaatttgttctgcgtctattatgcaggtaagagaaaaaaactgctgcattaggtgggaatttcactaataccaatgaattcccaatattctaactttctggggaaaaaagatgccaaaaagagtgaatgcattttcaacaaaaacagcatgttaggattgtagcacagcaggttgaaggatgaaagaatggtaagagcaatttcacagcaaccaaaatgacacaaggacacacatgccggtgagcaaacaagaggcacaacttaatgacgcaagaggaagcagtttgacttgcaactttcaaaattaaattctaaccgtggtaatataaagacagctttacatcccattcaccacgttacacatattgccatttatttgctaacagcaaaaattcaaatgagtgtacttgagtctctaaatattttctacaaacgctcacccccagactaagatagacactgccaaagtgaacgagtcactgcatggctagatttccatgttgaaaatcttaggctcatagcagaatacttgcacaaatcctactgcatctccttaaaaatcactctacaagttgcatcctaagagttcttgtcaaaattgttctttaaagcattacacacatatgcacactggcctagagaacaaggatctttgtctttctttgccaaaagacagtgtttccccaggcctgttttagccttcgactgatggttctgattttggttcagaaaaataattgcatgactgtcctaaagtggaaagagaaaaacctcaaaaattgttaacacatcaattacatcaaccttttctaattacaactctgcatttcattattctgcaggcaaaatgagtaccttaagtctagagccccaggtaaacaaagcctttccctgtcctcatttcaaaactttgtttttataaacattccccgtcccctaaactgaactacagcagcacaatgatcctgttgtgagcactgccttgacctctataggacaacagattgttgttcacttagcccctcagagttaaatcagttttaatacagaagtttctgtcttatcaaaggaagtaaagaagtaaaaacaaaaaatgaacgtatacaagcacagatttttgagcttcgattgtagagaaatggtagttatgtggcttgccaagaaagtgcatcacctacttctgcttctggggacagaggtgaaggggtctgttctggaactttctaaggaggccatcttcgttattacatcagggaagtttctagtcaaaatgttattcctgtctacagggaaaaacaaaagcaaaacacaaaagaacactgcttctaatggcatcatagcaagsagtttatctagaaagatgatgccagcagtcacctcttttccaggaagacagaaacaaaaaccgttctcctcgagaggccaacagtgtagaagccccttttccagaactttccaaggagtaggtgaacttctttgtaagtgtatcagcacaggggagagtggtgctccatgttccaaggaagaaaagcaacccacagctcctcctgcccgtgcagcagatgaccagaaagacgagaaagggaaacaaactcccaytcatggtgaggctgcttgtttctcaaacacacttttccaatgcctccacaagttgyttgtttctgtattttgaaagcactcaacatgcagagtatttgctaaccacaggcagagtacccagtcaggatgtaccaactcaaactcctccctggggcaggcaaggataaacagggaacaggtaagagaggcctaaaaagccaggtggacagagaccacatgtgaccccaaacagaaacaggctgctggaaactaactctctctctctctagctgatacttattcarcacttactgtatgtcaggtactatyctaaaaactttacgtatagtaactcagttttcacacagatgcaattattttccatactttagagatgagaacattgaggcatagagaggttaagtaatttgaccaaggaagcacagccagtaaatggcaggccaaggatttgaacccaatcagtatttttttttgtagctcatctccatggagttagttggagtctcatcagcacttcctcgtacagggctccattttactgatttctatcaaccacaggacatacttttcttttttcttcgtaccctgaagaagaaatgcactaggtaacttcaatatgatggcagtaagattgtttttcaacacatacacacacactttcaaaaaaaacttagagaccagatgcggtggctcacgcctgtaattccagcacttcgggaggctacaagcgaaaggaagtcaagaccagcctggacggccaggcgcagtgtctcacgcctgtaatcccagcactttgggaggccgaggcgggcggatcacctgaggtcaggagtttgagaccagcctggccaacatggtgaaaccccgtctctactaaaaatacaaaagttagccaggcgtggtggcacgcagctgtaatcccagctagtctactcgggaggttgaggcaggagaattgctggaacctgggagggagaggctgcagtgagctgagattgcaccactgcactccaacctcggtgacagagcaagactccacctcaaaaaaaaaaaaaaaacaaaacaaaaaacaaaaaccccgcctggacaacaaaatgagaccccatctctataaataattagccagttgtggtggcatacacctgtagtccccagccacttgggaggctgaggcaggaggactgcatgaacccaggagttggaggttgcagtgagccacgactgcactactgcgctccagccggggtgacagagtgagactccatcttaacaacttaatggtaaagcaggcctccagtacactttctcctccctgtcttttcttcttttctgaagattactacttactcaccgttccccattggtttagatgataacagaagaaacaggacactataaaaaccttattttgcaccacagaaagcaagatgtgaaggcagtcaggtttgataacagtgcgcactgtttttgcagtatctttcatcacgaggctctcacatcatgtgctctgagctcatgtaacacactctgctggaatgcccccattcaagaggggagagagtccgtgacagtcctccctgcactcactgtgctagcaaagatgtccgggaaggacagaaaagaatgtaatgtgcaattaaaacaagggagagtgattaatgtaggcaaaaattaatcacaagggcagtgtcaaagtttggtgggacaactgcgtgttcagaagacacctgaaaaaagtaatcccatgataaataacatggtaaaaagcttagattgtgccattaagttttcttaatattatggataaaatgacaacaggcaaattattttctttcccaggtgaaatgaagaaccaaggatcatctgagcaaagactcaaggaccatttgaacaaagacatccacatctataccacagatgacttggcatctatggaggagtggaggtgagcaccactctaccatgtagrggaagcagccactgtggaggctgggcttgtggagattccttctggatgccctcagatctgtcattaatggggacaaagcagaatcaagggactgctctatctcatctaccactaccagctccaccatccagggtactgttcttgccactgcatctagaaagaagaggaatgcaatcttgcagttagaaaaggctgtctcgctgaatatttattctcattcctctacccaaaactaatgaaaatgtgaagtctgagtggtgtctgaacctaatattttcgtgtccgaggcacacaaggttgagctgccacttctagccatctgaaccacccagtgtgagcatatatgtggctgggagggtgggtggtgatggtggtggtagggaggtgggggagacttctaatgagaggcagtagagagtagggtctaagagtaggtactctagagtcacactgatttcggttcaaaccccaggtctgccatttactagctgcacttccttggccaaattacttaacctttctgtgcctcaattttttgtctctaaagtggggataaatagttgtatctgtgggacaactgagtatatggcaagtgtttagaatagtacctggcatagagtaagggctgaatgagtgtcagctccagctgtcatctaggtgtaagctcactggcagcaggtgcaagattcttttggatggctaacaagctacagctttggctgacagtgctgtttgtgaaacccagtggcctcttcactccatagtcagccttccagtgctcctgcccttggtggccttggcaggagcctggggttgagtggggactcagacaactgaagctctcccagcaaaagcaggatccccacgtctcccactgacactaaaaaacaaattcttgaatttttcccgggtctgctgagtgatcacaagaggacagctggggctggatgacagagcctcagcagtgacagggaagcctgcttacttccctcatgctcagagtgccttttggccacgggcttatttcagctgtcttktgttccatttctgaggctctaaagggatgctctgggaactgggatctaggaataaatcaagatgagtggggcaaggttaataccctgattagatcagcctggcccaacgccctttgaccttagagtactggaaaagtcttgacaggcaagggcatgaaaaggtcatgtgctccaggggcactgtcttcaaagaggagccttcctggggtaaacaggcgcatctaccttctcaataacaggttcaaaattcaagaaagcaaacagcattccctaactatcaatattccactaagtcctagaatagttttagtttttaacatcccagatagcattttcaattgtaatgcctggaatgagaggcagaggatcttcagggtcacgtgctattttttatgggtttacatgaaggatgcagatgtcattttaatttttatctttctaaacatagtttggccaccatccctgctgaagaccacagtgagtccaaagaacatggttaactgaaatacacagataatcacagaaattacttttaggcaatgatgtcaactttgtcccactgatggaagaaaataaaaaagctgaaattagaaaatctaagttttttctcataaaggtgaaccccaaacctgtccaataatactctactaaataaagtctgttagtaaagaagggatgaaaaaaatcagtacctaaaagactctcaggccgtgaaaatgattttgtaaattctcaaatgggctttgcaagccaacagatccaaatcacaactgtggtcaaggcattctgcagagtctcaatgctaggtgaagaaggcatcttgggaaccagcagactgccactctctcaacattgaaaagatatctccattctttgaaagtcactttcagccacccagaaagttacctggagaaaagtatggtgaatgaaactgtttagagtttgagaaggagcaggtctttcctatgtaaaaattccaatgaataaatgacaataagatagaaaattgccattaaagcatggcagtaataattattgtagataagctccaccaaagcatgacaagatcagtgagtgacaatgtgatgagaaacaggaccttggccagttgtggttgggaggctgaggtgggaggccaggagttcgagaccagactgggcaacatagtgagtttctacaaaaaatttaaaaattggtgaaggccaggcatggtagctcatgcctgtaatcccagcactctgggaggccgaggtgggcggtcaggagatcaagaccaacctggccaacatgtgaaaccccgtctctactaaaaatacaaaaattagctgggtgtggtggtgcctgcctgtaatcccagctacttgggaggaggctgaggcaggagaactgcttgaaccagggagttggaggttgcagtgagccgagattgcgccactgcactccagtctggcgactgagcgagattctgcccaaacaaaaaaacaaacaaacaaaactggtggggcactaattagtgatggtgcacactagctacttgggaaactgagatgggaggattgctcaaacccagaagtctgaggctgcactcccctgcctgggcaacagagcaagactgtctcaaaaaaagaaaaaagaaaagaaatatgaaaaaagagaaacgagacatctgcatactgtgagtatcagccctaagatatcagtaacaatgcgaaaagcagaaaatttacactggagaaacctggcaggcaccacctcaatcaagtgttcaaggctaagagatcatcagtggtaagatgctgacatcacacagatgtgacgcactgagatgcaatgtcaatcttgtagtagtcttccccaaaatgtataaaaatgagtttaatgatgagaaacattagaaccaatttggagcattctatgcaacaacctgtccatactattcaaaaatatcaaggtcatgaaaaacaagcaaagatagacacatttttacagactggagaagactagatatagtaagtaaacacaatgaaggatgttgggactgaaaaaggatattagtgggaaaactggtgaaattcaaatagtccatggttaacagtattgtgtcattgttaatttcttggctgtgagaattggtgtatagattatgtaaaatgctaacgttagggaaaactgggtgatattttacaaactttttttttttttttttttaaagagacagggtcttaatctgtctccaagactgttgtgcagtggcatgatcatagttcactgcagcctggaactcctggctcatgcgatcctcccacctcagcctcccaagtagctgagactacagccacgtgccaccactgctggctacttaatttctttttttttgtagagatagtctcacagcttggtctcaaactcctggctttaagagatttgtcttggtttcccagagcactgggattataggtataagccaccatgcctggatgctttttcaacttttttgtaagtctaaaattatttcaaaataaaaagctgagagagagagaaaaaaaaaaatcagttcagtttctccccggccagtggggtcatcctcactacaaagttgctggtttgggctctagctctgcggattttcctcactggacgaatttcataattgtcgctaccactgatattacacaattgagattctaactgaatggagagtgatggaagaacatgaatgaagaagtcatgctgacattggggaaagagaacttactgaaaatttttaaaatgttaaatattttacattatcttcacaatccctgtacccccaacaccttccacagcaaatctccctcaacaatacttcagtaatctggctagagcccaaaacaaatacttcttattcagaacttggctttgaagaaaatgcagccctaacaaaattttaagtaagttactgaaggatgcagaggcttcattttacaggagttagttccagaggtgattttgggaccagcattattcccagaccccaaccacatctaaagctgccaggagggtctggcttttgattcctctgtgactcctttccagactaaatcaatgtcacttggttccaacaactgcagctcttccctactctttgacctgctgtgcctaaaatttaactttcccaaattgaggagggttcatcctccttgcctgggtcaatccttggggtggacaaaaggtattaagacaactatggaagcctatccactctgtcgagagaaacaattactcctaaagaaaatctctacttaaagccacgattaaagtcactctcctcttcatccctcaacaacttgctttgaaagggtaagaagggaaagaagatgagtgcttccacttcgctggtaggggtgaatggtaggtagtcctatctgcactctttccatctagtcccctacacataatagcaacaagtgtgctagttgtatgctacagttgttgtagcctcttagcagagccttcaaatcctggtgtgtgggtgtaggtctgtgtgggaaggtgtgtgggtgtaggtttgtgtgggaaggtgtgtgggtgtaggggtgggtgtgtgtgggtgtaggggtgggtgtgtgtgggtgtaggggtgtgtgtgtgtgtgtgtgtgtgtgtgtgtagggggggtgttctcttgccctggccacctaaaaagcctaagttactactgacaaaggatcctattccttttcactcaatataagcctataagacatctcaacactcgccatcttacaaacatagagaagcatctgggtgtctgggcgtgccctggacccacaaaaatccctaaccaaaactgttagctctgacaacggtttaagcagaagtaatagcatatacctctgaaggcagaggtttggtttttattgctaggtttactcctgctcgtttataaggatgccctaaatgccatctcccaatgaaaacccttccatgtccaggggcaaaggatgctctggaccctcaatgcttgagcctactgaaccatccaggaccacttcgcttggctcgtctagtgatgcagagctgttacatggttctgcaaaggattctcagagagattcccacctcacagtcactgctttgctttcagatatttctggtaacccccagagttcagtgtctttctagcttgatttgtcccaacagaatggagccttattgaacctatggatcaattctggtgaaatgtcaaataaggcaaaataaaacagaagtaagtgtgaaggcaagagtttttaccagaatctgacccttttgtgagataactcacgtgacggaaagctctgatgatattgctgaagctggagtgtttaatgacctccattttctcaagagcattttccctgtaaacaaagatgacaactgttacagccagagaaagtgacagcttctgaggtttccaccataaacacttgctgaggctccactgatgccaggcaccatggtgatgctggtgatctaaagacaagagtcaggcttaaaagctttgcaaactctttcccaaaaaaggtacagtctaggcaaagttcaagctgtaaacttgtaacttcaacatcagctgttacatgctccagcaatagaatggattaatttcttggggacagaggagaggatattaagggtaaagaaggattttaattaggagatgacatctggcaagtcctcataaacccagcagcacagagctggccacataaatcaaacccttgtattcagggtccatactattactcaacaagggtaattcgagtaattaccagagttatcatgatccaacacataagttcatttgaggaccctgactatgcaagcatgaatatttttttggctgcctctagatagcatgtttatgaaaaacaggttaagttactggctccaaattactttttaataaaaaaagcaaacaataaaagcttaagcttttaagatttttcttttttgtttttaacctggaaaataaatctccctgtcaaaaacatgcaaaatgaatgatttatgtgatataagcttgggtatctgtgttattattacatgacatttcctaacagcttataattgccttaaagattgttttggaaaggttataccttctccctattcccattccctttaaataaacccttgtgtaatctctggaaatttttagactacaactatcaatgggccattcaaaaatggagccattgtcaagtcacccacatgaaatagtgaaggtttacaaccaaaagagaatcgctcacttccacaaaatagctgatggaaatactgtgctccgggggcttacgtggaacaaacattaggaaggtgtctacctgcaaacccgctctaaggctggaccaaaccagggggtccaggtcaatcacaagtactgaatcaaccaggaaagtccacagaatactgagagccatcaatgacaccactttagaatttaactgttccaaaccctttgtttggcagatggggaaaggagaggtagagggagatcagaagagtcaatacaagaatcttggctgattggctggtttttctaatatggttcattcaccacatcatgttattctattgaagttcaggagagggtaccaggggatacctcaacccaaaatgacttcttcacagttttaagtctagggggaaaggcccataatgtagtcctcaccactttttcctaggaatggctagcatcagacatgacctaaatctgtagagctagttcaacattcaggttaccaaacaaagtcatgaaagaatgtaattactatcacagacatagactgtctaggttctaaagcaattaagctggtaacgtactatttacaataaaaaaattggtttcacaaacctgtaacagagaccaggtaaatgtgccagaaattgtataaaccatggcataccttgtatcaatttttatgtagacacagcaagcaaacacagttttggaagataattcctatattccaacttagcataaggtaattaactgtgtcttaaaagaggaaaagaaaggagcctagagctttattaggtgtcccacctaacttaaatttgtttttctagaaaaaaaccatgcactcaagaaaggcaatcaagatctacatacttaattcacattcacagaaacttgtgaatatatctgtaaaaggattatcattaatccttcaagctcctagagtaggaatacaatacccgggcagtggttcaagaaatctaactcgtgagaaggttacacatctcaggggtaatctaataatgtaaacttttacaaactttccttcctggtctcttgccttcagtaggtcattcatttaaaaacataatgagctcctggaatatgctggggaccctgtggggaataaggcacttgtgattcctgcacccaagagtgtagctggggctacaggaatgttttaagacacctcttaactgtttaaccgctagtgttttaagacataattcctgccct

SEQ ID NO: 17835 - DNA, 15042 bp, Homo sapiens
ccagatgtggtaagaagctctttcagccggacttggtaaaatgccttgtttgaatcgaagtctgaattggcggttatttttaaattaataaagtttttctatttggaaggacttctaataacatagagcagtatcctaagaagcccttggggacttttttaatgaattagaataatgtgcaattagaccgacagttgtaactgagtgcttcggagggcttgaaagtagttgttctcaagtagttcacgtagcatcaagttcacagaaaggattctaaggcactgaattgctcgattttacaatgcactgggatataaatgaacaaatgcactccacagtacatattaggcattccctaggcttaaaaaacccaaaaactccaaaataggaaaaaaaaaaaaaaaaaaaccatgctcagcaaatatattaggataaatatgtatcagaaaaatattcgtttcaggattcctttaaatagtaagtccgcctcatgtctgtgtgtcttcacagatcattaatttcttggcaaagaagttggggtgcagacaccctgtggccacagcactggaactgaaggtcagtgggaacgtgatgagaggggttttgaaaagtctgcgctcctctgaaaacattctgactatgccttttctctctccacggtttcccaaggccactactctatcttcctctgtttgaatccaaacagaagtacaaggagtcagatccacaaatgagtcgttttatcttgccctacctctctgtgcagtcaatggccaaccatcctatggatggacagtcacaggggcccaaccaaggtgtcttatacgagcaggcagagggcttgcagtggctttttgtaggtttttggctggagctgaactaactgcaaactaaaaaaaaagttcccaacagcagcccttcctgaagctgacggtctgactgtggaagtttagcccgagtatttagggtgctgggaagacatgagaactaccttatgtcctttgttttcttcctaagcaaactgggcagtcttgttcatgcaaaaccactatggagtgatcactgtaacaggcacgctggaccagagggtgaatgcccccagcgggaatctctccctaaagccttgctttttcacatcacgccacctcccctcttccaaattttggaggcgtactaccaataggaactcactatctgactgattaatcagctttcagtagacaggagcgggacaggtgtgggagaaaacatttctttccaactcccattctccactgcagaataccacaataagaaatcttaggccgggcgcggtggctcatgcctgtaatcccagcactttgggaggccgaggcaggtggatcatgacgtcaggagtttgagaccagcctaaccaacatggtgaaaccccatctctactaaaaatacaaaaattagccgggtgtggtggcgtgcgcatgtaatcccagctactcaggaggctgaggcaggagaatcgcttgaacccggaaggcagaggttgcagtgagctgagattgcgccactgcacttccgattgttaactagcagtttaaatgaccacatttaatcagctaagtgagagttggtttaaaaggccaattacaaaagaagtggtaaatggccttttaaaccaattcatagtatctccaaatgccttggtttaccaagtctgagggtttcctagaactctccttataagcattagaatgaaatctagtcctggctcttttcccatgaccacttcctctttggttcattaagaatataaacattacttaaatagagcaaagctccctgagctaaggggtcttcatggtatacattcaaacggcatgtgaacgaggttacagggcatagtgcagaatccctcctcggattccaaggtggctaaaaatgcctatgtcagtggatttgcctgttttccaagtcatttgctctgaaactcctaaatacaaatatgaaaacaacagcatgagacttcattgtcatgtttatttgttattcattctctgattcggagttggggggcaggggaaggattagacacaattttaagccaaccagcctctaaacagaaatatggtttattctcggtactcaaattcaaatcttagtaacatagcaattacattttaaaataaactatctccttgtgcttgcttctaaggagagtgtttagtgggatatgaaaagagtctaatcctaggcagccgtatggccagaccaattataaaccccgtagacttttcacacgtcacagagagcaaactgctccaggagcagctcttaatactttattgcctattcaggtgcacctgcacttttaagatatacttgtcagcaacaaaatacagcacttccctctgtctttatcacattggttgccagacaactgcacagagctaaagtaggtaatgttacagtaaacagctccctaaaacatttacatatgtcactgataaacaatagaaaatttaaaagagatacaaatgtactcttggaaccttaaatcttcttcccactgaggcctaagaacttaaaatcttcatacacctggctgagaaaaaggaaacaaattccaaaggaagtctagatttatagcctaaatatgtcttcctctagaatatttaatacacttaagctttagtcattctatacactttgaaaatgcccttcaacgataaattacagtcgttgcatttttcattgcagttcacttaaatatcattttgctttcaggaaaacaattataggacagtaaatcacttttacattgcattccaaaaatatttaagttgcaacatggacaatgtgtagaatcacaagaaaaatacagcttatatattctatcattcagtcttctacagcaaacgttaaatccctgaggaaagtcctaccgttagtttggtttttaaatatttagattatttcagcgtatgcacataagtattagtgcaacaaatatttactgaactcccgcaatatgcagtcatccagatttggggtagaaatttgggaatccccctgatttcaagatatcaaccactactaccataattacctgcttcatgggcatttaacatggcaggccccagcctaacaactctacacacacagactataccatttcatccccacaactttcctgagaggtggagatcatcattctgattgaaaagtatggaaaggtcaccaaggccacatggctggtgacactggaggatctgcccaacattcacacccataggggtgatcagtatagcatgccctccatatctgagggctccacacccatggattcaaccaactgcagatcaaaaatattcaggaaaaaaaataggatgcttgtgtattaaacatgtatggacttttctccttgtcattattccctaataatacatgataacaactatttacattgtattaggtgttataagtaatctacagatggtctaacgtagtggtccccaacctttttggcaccagggatcggttccgtagaagacaatttttccacagatgggtgggggagagggatggttttgggatgaaactgttccacctcagatcatcaggcattactgagattccctgcatgttcagttcacaatagggttctcactcctatgagaatctaggacctctgctgatctgacaggaggcggagctcatgcagttaatgctagttggcctgccactcacctcctgctgtgcagcctggttcctaacaggccatggaccgggactggtctgtggcccaggggttggggatccctggtttaaagtatacggaaagatgagcatgggctatacacaaatatcacaccattttataaaagggacttgagcatctgtggattttggtatctgttggggtggtcccagattttggtatctgttgggaggtaccagttttctcagggaaaactgtatatggtgccactaatatggtgccactgtatatggtgccactgtatatggtcttctaagctatgccaagtttgtaaaattaaagaacaaaacaaccgggcatggtggctcatgcctgtaatcccagcactttgggaggtcaaggcaggtggatcacttgaggtcaggagttcgacctgacctcctggccaacatggtgaaactccgattctactaaaaatacaaaaattagccaggtgtgatggcgcgtgcctgtaatcccagctactagggaggctgaggcaggagaatcgcttgaacccggaaggcagaggttgcagtgagccgagattgtgccagtacactccagcatgggtgacagagcgagaatccgtttcaaaaaaaaaaaagaagaagaaaagttaaaaaataaagaacgaaacagcgtaatagatgatcaagtcttaggagagtgactgcagactacaactgcaacagagtgtttaggaaaaaatagatgttagctagtaagtgatgatcaaggaaaaagcatgggaaagaatgccgagcaagtgggagaacacatgagtaacagcagtggggtgggagacaagggcccagccttttggcagaaccttcagaaaaccagcctaatggcccatgcctctggaaagcagcaagaagataagccaaggtgtcctgggggaaagctgagtctaatggttaggacttcacatcacagagaacagggagccaccatggtattttgaacatatgagtaccttacctaaacgagttatttagataagaagaagtctgacaataatttacaggatgtattggagggaaggaaaagctgaaggtgagaccgaaccatgaggctgcaccagagaaaaggcactgggactgaaagagcagaggaaaacataaagggcatttcagaagagtgaaagagatagggaggaaagttcctgagttctgcctaattatgtgagccgttcaatactcaccagcaagtgaggagaggaaccaggtggccgtgcacacagggatgtgcatttgctctcttcgacctggggagaacgggcagccctgtcaatattctccactcctgtataggctgctgtcaaccagtcagccccgagaatgacaatacttccatgttaccctccctagttccgagtgctggctatgcgacaaacatatttttaatgagaaaaactatttttgtttcagttttgtttgaaccacatcattcacaaatgactgagtataagaaacaacacaattccaaaaataatgttgcttaattttaggatgtctagtctttttttccccctctttctctctcagaatatgcctgaaaatagtggttagccaagtttttgtttgtttttgtggtggctgttttgtttatttaaaccagggtgagaaatattttctgggagttttaactactggatcacaaacagaaaatgggggtggcagctatgcaaaaacccctatgatcatgaaaccaagaagttatggttactaagcactgtgaatttaacaggagcttaaaatcatggctctgacacctggaaagatgccactgggctcagaccagccctgtgcagctcacaacttcaactggaatcaaacctgaccatatccccacttctcacttaaaaagaaatggttttggccgtactggtagagcaaaaccagaaaatagactttgaattagtcttcatgctttgcaaaaaggtactaacttgttaagatgcatcctccatgtctaactaagcctggtctaataactgttttgcatctgtcctctagcagtctgctgctgattggtggtgggaggggaagagggaaacagcttaaaccattactcctgttttgtgggcatttgaagtagctgccaggcacatgacaccactgctccaattggttcagagtgacatcacttcatgattcaactttgtttgcatttcggcttcctcctttccaaggggttctcaacttcaccctgccaagtcactttcaaacagaaagagagaggaacagcacatcttatgtagtcatgaagtgtcaaatgtcctttgtgtttcttagcccagtttatgagaggagacctggagaaataaaggtttcaatcaacaccacaatggtgtatgactttcttcacagcatgaggtggggggaacgggaagaaaagcaaaaggtggctgctaagctttgagtaagttaaaactgatggacttcaataaaaatcctcaaagtttgttttcaagtgggaaaactctaaaatagaaaccacatgcaatactatgctggaacctcatttaaatcattcacgcttctaagactcagagaatgtttctaatttagtcaaacactaccctctctttctccaaaataattattcttaatttatttcacctaacttctgttttttacatcttagcaatgtgaccaccaraagctggagcaactgctttctgattcagaaaataaaagtttattctgatttttatttctgtcttccatacagtcagttaccagggaactcacaaaatttggagagttcgagcacgattaattttgtgtgttcagctcaaaggaaaaagcttcctcataggagaaatgcatkaatggatgagcgaatgaataasargctttataacccaaccaaccagaagccgaggggctcactatattaaattataccagctctcaatacaatgggtcaaaatgtattttattttaaattctaagttaggctccaaactttacatcgggaccttgtaagacgagatcttttatcatgctagacttttattatcccctaggaaatgtagtgacattaaccaaacacacaaagccatctcaagcctaaaaatgcctattactccaatcctgtactcacttgctccctgccagagayaacacaaagagatgagtatacacactcaggaaaacttygcccgggccttcgaggtagggcsaggactgtgcaccacacgagatgacttgaaaacctgtaggaaggytgtatctcagtgccacttgctttgaggagactcactgggtaactgtttgagggtggctctaatgctctgcaacagtccctgcagggacaaagagaaatttccatctttctgaaggcctaacatctcttttcttgtaatctcattgacttgccttgcctagactcaccagtcaattattatttatcatttacagagtagctcatattgacaacatacctacaagtattttagcacttcatataccttttatggtataagtacctgtggaagggaaagggaaatgagttggcctggagtgggaattaagaagccatcatgaatatacatgtgcctgtgtgtgtgtgtgcacacatacacccgtgtgtctctccacgtctgaggccagcagctaattcctgctcacctttcaacacttctagtcttggctcctgagccccaggtactctattcctgaagatccttgcagatatcaatcatcccaagaatgggctagtggtttccgggtttcatraataaagctgtcccattctcatcactaatcaaggtaagagagttacatcttatttctctgccttggtttcatcatctatggaagagcagtcatactggatctcgaaacatgcattttagtgcatcatgcacatttaacgcctccctcacgcatcactcaactgactggcaagccaccccttccccttcgactctcttccaaaaatgcttacgaacttgaaatccagcaraaaaggggccacagtgactacgtactcatgattctgttttactcttctaaattcacggtctacttactattaacttatatacacgttaatatttaagttccagatccaagggaggtaagaagcagctaattctagggaggcagggctagagagagtgatggtaaaatcagtttaaaaaggggggggggaggcgtgtttaaaataaaagacaactataaaaaatcaacagaggaagggaaaaaccagaagcgcacaggccatttagcgcaatgtagcgcgtctcacaccagaagttgtttacacactcttggacgcctgagttctccttgayttttgtttttcttcattttatctatcttcgtttatccatcttctagttcatctacttaaccttcttgtaactcagtgctgccaagtggattcggcatcagcatttacataaaaaacacattgcaagcaaactgcattactctagctgttgtacaccaaaaagaaaagacacatttaacatataaatatgtgttcacataccaagtgaagaccaatttatgttgtggtacttccgtgaactggggccttgcgatacttaaagaaaaaattcaattgtgatgtcaaagagaggtgttccgtaattcaaacgtactcaggccttcgaggtcagtttattcacattctgagcagtggtttacttttagcaaaatattacccatgtcattaaattaatatttgggtttgaatctttttgttttatatgcacttaatgtgtaaaatcatttaacttacagttgtaaaagatctgcaagcgtaaaaaattgacacctaggccttataaggctgtaggtatttaagtatctttataccaagtaatttataatgacactgagggtctgtgaatttatcttttgcttttaaaaggtgtctcaattaccttagatgaaaaactgccttgcccacctgggagcatcattatcttatcatagaatgaagttactttcacagtgatgaccctgagtattgasaaaaagttggattatgttcattatattctttttaatgcaagcaatgtaaaacgtcctttakaaatgtttcctttaaaaattatttaaattgtattgcttaaaaaatatgactctttcaactcagttatcacttaaggtttcctggaatattctgctgtttagaacatatttgtaggatatgaaattacctacgtatgtgactcttataagaccagagaaaaaggctagaattatatatatatatatatgaaaatagcrtcagcaattccacaaggccatcaacttggggtatgaactatccgtgaaggactagtgatggctgaacttcaaccacactctgaacagcataaaaatgagaaaactgtactccttgatctttagttctcaaagtgtggtttgtgaacgcgtaaggattctgcagctttttcagggggtctatgagattaaactattttcatacactactaagacactgtttacctttttaactcttattgtctcatgaatgtgtgccgtggaagtttccagaagctgtgtgatattggcagcagaataaacatagaagcaggtatgatcatccaattgccttctgttaagccagagattaaacacataaaacaatgccactctattcatatactggggtgggatatagtttttatccaacataaaagtacgttaacgcatattaagttttgttactgtttctgaatcaataaatctttttaaagttattaattttaattcttcatacagcaagtatcaatggatacaacccacataaacgaaagcttattggcgtttgtcctagcctgtctgggcacctataacaaaacaccttaaactaggtagcttttaaacaacagaaacttattccttacagttctagagtctgggaagtccaagatcaaggcactggcagattcagtgtcttgtgagggctccactttctggttcacggagggcaccttctagcagaagaggcaaagcagctctcttttataaaggcacaatctcattcataaaggtcccccaccctcacgatttaatcccttcctaaaggccccagctcctaatatcatcacatggtgattaggtttcaatgcatagattactggggcaacataaacatgtagacagtggcagggttttccatttttaacagtgtgaaggggtccagagaccactgaatttgaaaacccctggatgatttcatttttctcgacagggaagctacaagtagatgagtgccaaatgtttctctccattcctggcctgtcccctgagccctacactgctgtgttcaactccatcttagcttgccccccctggatgtctgaggcatttctgacctgagagatgcaagacagagctcctgccccatctgccttctccaccacacacttcccaaactacactgctcctccctccccactcctttgcagctcaggaatggaagcctccaccccctgttctgtccaagccaaaatgtctcagaggtatctttcactctcccagtctccattcccttcaggctatattttacaagtcttcaaatattcctaaatctatccactgcaaattgctatgactctggtccagtggttctcaacagggtacaattttggtctccccaccccctaatcccaggttaacatctgtcaatgtctagatacatttttgattgtcatgactagggggcggggtgggtgggcttctggcatctagcaggtagagactagtgaagctgctgaacattttgcaatacacaggacagccccccacaactaattatctcacccaaaatgccaacagtgccaatgctgagaaacctggcactggttcaggactgcacccctaccccccgccctgccactccccaactaattatttcacccaaaacgtcaatactgccaatgctgagaaacccagcactggttcaagccaccaacatctctcatatgcacggtcccagcagcttcctaagcggtctccctgctttttccactattcctccttctccccttctccacccagcagctagactgactgttgtagaaatcagtgtgccactcttgtgcttctcactcatccccaacttccactgtgtattgagtaaattctcactcttgccatggcctacagaccctctctgctctggtcccatctaatactgtgacccatcttataactcgacgctatgaaatcaattgtgtctcatccccggccacctcccacctccaccctgccaattcatatgtaggaaccctaacccctcatgtgactctgttgaaggtagggctgttaaggagacaattaagatcaaatgaggtcataagggtgagaccctgatacaattggattaatgtccttaatcagtgaagagacaccacagcttgctctctcccaccactatatgaggatacagtgagaaggtagctgtttgcaaaccaggaagagagccctcactagaaccagaccttgttgacacctgaccttggactttcagcatccagaaccatgagaatatgcttctccaaccatgacgctggagagaagaggtgaagtaggcagaggcaagactgggaaagtagggctggggtggtcagaaagggcaaatcacgaaatgtctggtgtgaaaggagaaagggatctccccagagcttgagtatggaagactattcaacttcagaaatgaacacagagagggagagggaatgctgcaatgtctattgtttaagccacccaggctacagtaatttgtcaaagcagcctgagctgacaatcactctcagtttccctcatcttccaagttccagccttgctggtcatcagtctgtgcccatgtgacagctttttcttcttatcctttctcctgaacttcccatggctggaccttccaatctcccttagtctaaatgccaccttttcacagaggcctcaatgactacccagcgtaatacagcacccctcaaccacacctggcccccaacccagcactcctgcattgtgatgacagtactgttttgtgttttcttcttagatgctcatcactagcttattattctctttactgtgcatcctaccatccccaccccagtattcttactattattattattattattattattattattattatttttgagacagattctcgctctgctgcccagtctggagtgcagtggcatgatctccactcactgcaacctctgcctcccgggttcaagccattctcctgcttcagactcccgagtagctgggattacaagcatgggccaccacacccagctaattttgtatttttagtagagacggggtttcaccatgttggccaggctgttcttgaactcctgacctcaggtgatccgcctgtcttggcctcccaaagtgctgggattacaggtgtgagccaccacacgcagcattgaagaaatcttttctgtcttgatcactgctggagcagacagagcaccacagctgcctaatgtttgttaaattaataaataagtgaatgaacctggctttgaggatctcagatccatacaaccgggcatttatagccattctctgagtcaggcagctttctggagccacatggttatgagaatgtgccttgccccaagattcatctccctctcccacctccccaaagaaagctgccatgtttgtggcaatctcatattcctctggggaccacatgggacaggaaggagtaattaactgcaatatccacagcgagtagctattcatattcttacactccagggagcatcaagtcttaaggttacattaaaacacaggcacaagggaagtccccagtgtttattatctgcagctacagagtgggtaaggatgagatctggtcacttcaattgaatttacaggcaacttctcaagagcccaactttgaactgcccaaagaaaacacaggcaagtcctactggcacaagagaatggggtgggccgatggggagtgatggccggctagggttgacatttgttttttccaccatattcaacacaggcaagtgctttcgaattactggctccctgaaaagggggatctggacacatatggcaatgcgatgaatgatgattcctggaaagaaaaatgcttaatgaaacaagaaactcacaatttcctgagacctgatatgcacaaggtactgggcagatcttgtagttattgatgggaatttcagagaaaggcctgatgaggcaaagctggctgctggaacctcaaagagacaggaaaacaaggatgagacccatgattagggccactgtgaagactccagaagcttctgaggttcgagagaagaggtgaagtaggcagaggcaagactgggaaagtagggtggctggggtggcctgaaagggcagatcacaaaatggctggtgtcaaaggagaaagggacctccccacagcttgagtatggaagactgttgagcttcagaaatgaacacagggaaggagaaggaatgctgcaaatattttaccatattgacttttaattagttgagaatcaatgtaacaggtctagacctcatccagggtggaggcagcatgtgggcaatggtaccaagaaagcatcagaaagaagaagggcttggaaggcaactacagaacaggctgccccacatcaaacttaggtagaataagactcacttccattgttccttctctagccaaagctagagaagctctgaatttctctgcatttcgaaaacactccaacacacagagtcacacaaaactctcctttggaccagatggaccctatcctacgcactgagagatttggagtgaatgggacaagaggtaagcccagtctctttcctccctccctcatcaccccccacacctaacctcttccaaaaacatcaaatattttcttccataaataattgcaataggatgccatagcttttcccaaacaaacaatagcctgattgtgccctgtttgcatgggcccagcccggcatacacaaaggcctgctttcatgcgccaggcctctccccactgtagaaggatgggcatatttcgccctcctcacttcttcaacaacttcactgaggcaattccattcggaaaggagcaacaggaagaggttgttaccaccaggaataggagcaactcccattaaaaagacagccattgttccccaggttttctgttgcctttcgacctcatccagaaagttctttcaccagaagagagctggtttgccccaagagccaaatgacaacatcttatgctggtgatttcttttaaactttttattaaatttcgaatatgattttaaattgtaatcactgactgaaaatattcctgtttttatgtcatgtatcttcttaacagtatcagaatagagctaaaacaaacgcataaatttttgtactactaattatttttctggtaagaaaaaaagctgaactaaaagattaaactaacaactttataactgctactctgaaaaaatatccttttgtgtttaaaaacatgaagtattaagtttcctttcagaatgtaagtttgattttcccccacagatataaggaagcatcatagcaagtcttcttcctgtttccagtaattcggaatggccattctcccaggtagagccacgcttatatcagatacaatttcttctccccatttttggtcttccattcatttctctttcactcttctaatttaagtgaaatggaattccaaatggccaagacactaataagctctctgaaagccatcttgagagcatatacatttttgtttttaaaaccatataaacaggctgggcacagtggctcacacgtgtaatcccagcactttggaaggccaaggtgggaggatcacttgaggccagaagtctgagactaaccccggcaacacggtgagacccccatctctacaaaaaatttaaaaattagctgggcatagtggcacatacctgtagtagtcccagctactcaggaggttgaggatcgcttaagcccaggagtttgaggttgcagtgagctatgatggtgccactgcactccagcctgggcaacagagcaagaccctgtggctatatccatccatccatccatccatccaaatcatataagggcaccgaaagcagtgctacacagggcattaaaaaaagctttcactgcctggtaagtgttgctccaaagtgatgtatcattcatgccagaaagagtaacttaaattaaaatgtattttaaagttgaatcttggttttgcaacaggatctagtgacgcaagcaacccacgatgatgtgctccatttgctatg

SEQ ID NO: 17836 - DNA, 20026 bp, Homo sapiens
atgccaggctatcccacgtacctttcccaaacaattcccaaacaacatggatgtggtatctgtgtgtcctcacaacttcattactgcacagaaatagtacctcaccaccaaaaaatcatgttcattggaactgttctcagaaaaaactccaatcataaggcaatgttttataatgagagtttatggatcagatattctgactaaattcaccaaaatgatttcagaaggaaaattactattatcttacagctgctattgtttcctctaaacttatactatgtcagacagaaaatccgactgcttgaaagaaggacccataaacggcaaggagacagggtatacactaatgacaacaaagctatgacaaaagtgaagtggcttccacatacacagtgtttcactatggcccaggccctgctgtaaactcctcacagggattagctcatttaaacctcacagcacaacaatccctcactattaatgccatcttacagagagtgaaacagaggcatgagtctcaaaaatggcagcacaaggataaaatcccatctggctgctgagtggatgttttggtccttatcctatctcagagaatgcattcaaacctaaaactatgccaggagtctaaatttaactcaaacaagctgaagaaaaccaaaacgtctcagatatcacaaagcagtgcatttattgcataatgttgcacaacaaggaaagtttctagaaagctgcccgaacttacatggttactaccaacatccaagcaaaagaaagtcccaaaggacaaagaacgtgtcccacatgtacacgatctggttcatctattcatatatccaggatgcagcctgtgctcagcgccctacttacaggaatctgagctttacgattagtatgattttagctgctaaaaatgtgacacctacctctaagtcatttggatttataaaaatcccaccatgctacaatcaagaaagcatttcactgagcaactgtaagccaggtacagggcatgagctgaagaatgtcccaggtgagtgaggccgttctaatttcaacacctaaagaacaggtcacatcagacgttataaattctccaattttcttttcttttttttcttttgagacggggtttcaccatgttgcccaggttggtcttgaactcctgacctcaagtgatctatccacctcggcctcccaacgtgctgggattacaggtgtgagccaccgcgcctgaccaattctccaattttcatgacattaatgatcacgttaggcttagggtcagctgtgccctaaagctctcacatcaatgttttatggatgtatgggcctaacactggtatacagatacccttggctatatccctcttactaatgccagagaacgggtgtttcttgccacagtgccactcctggctgtccagcacatgttcacaaggactaggaaaaagggatctctccctggcagtcagcttctcttttcacagtgttgaaaactctgtgagataatttccttaggcgtcctggtaacacctattagaaagtgtttatttaatatttattcccacaaataccaatgagagagagagtctcctactattcaacagttttttgttttttttttttaatcaagaaatagttgaaaaggatgggagtgaaggcactttaagcccacagatgccagcagaggtgggacatgacaagtgaggctggggggctggccccaaactggtccctcccaagtcagcttggacaccacacagcacttcgtgcgccctcggctggcttagcacatggacaaggcattgccgctggagtcccaccttcttagagactcctgaaaaggagctccacgccaccccccacacctcgccctgtgccactcttccacttgtcctgtccactctggacatagagccttcacggtaaaccagtaataggacgtcaactactttctggaattttgtgagcccaggtgagtgaggccgttctaatttcaacatctacagaagttatcaagtttcaggtttaataacctagcaagttatcagacctgaaagcaaggggcctggcaacaaactctcaacctttcaggcaagtcagacagaagtgtgggcaccccatacctgctactcgcatctgcagcaagggcagactcgtgggactgaaccctcatccctgtggagtctgtgctaactccaggtggtgagtgtcagaactgcactgaattgtaaggcccccagttggtgtctggagagttagagaactggttgttggtatggcaaaaccccacacatttggcgtcagaaatgttatgagtagcaacagttcagagtcctttatgtgcgtttacaaaagcaataatttatggcaaggacttatcagaactactttacgattttattttagtttcttttaaggaccaagattaaagatttaattagttaaacaagacaaccaaaacaaatacttcctcctgaccttgagttatcacagactgccacccaaggggcaactgaaacagaaagggtggcctgcatttcagaagggctggaggggacaacgggcagtgtgctctcaggtgctctgaatcacacacacacacacacaccatacacacacaggcacccttttggaacagacaattatgaaagcacattaaaacgcagcatgccatttggaagtctggtcttgctgctctgcccaaacacagggtacacacttcagggaaaacaatcctagagaaacagtagctctgtgaaaaatgagaaatgtaaaatgtttcggccaaacacaaagaaaaaaaaaatcagcgtgtgggatggggaggagaataagacctatcagaattctttttgcttagctggccaactctggcagcataaagtttaaatggaagtatcttcaaattaaatcgcacctgcatgtatataagactcccctgtaatgctccgataacacctcaagattgaggtcatctaaattcaaaccttaaatataaaaccactcccaaaagagaatgcctttgaatataatggcagtttcaaactttggcaaataattatcctgttcttcttatctgtgagaatctatcatttattttaaaaattctctgcagcggccgggagtggcggctcatgcctgtaatcccagcactttgggaggccaaggcaggaggatcacctgaggtcaggagttcaagaccagcctggccaacatggtgaaaccctgtctctactaaaaattcaaaaaattagccaggcgtggtggtgcacgcctgcagttccagctactcgggaggctgaggcagaattgcttgaactggggatgtggaggttgcagtgagccgagattgcacaattgcactccagcgaaactccatcttaaaaaacaataattatctgcagctccctgtatcttccagtaaacggattagcaggtattttctgagtgtccatgatgacggtcttagcactctccttcctgcctaaggagtcacaatcgcattcacaatcaaatgcaggtgctgtgtgtgcgctgctctcttcctcccatagccccgtttcactttctctggagtgcatccccatcctctcaaagcagaatcaacaagcaaaccactgtccttctttcaaaaaacaaaaacaaaaacaaaaacaaaagtcatgtgtttatttcttcccctctacttgtgcctcctaaattccttgccttagtcccaaatcagtcctccaaacgcgggttacttgtaacgttattcagaagtggaagattaccttgcaaaatggcagataatgccccaactagatatttcatggcattctaaaactacataaaagcaagatttcttaacattcctctaaataaataatagtgtaataaatatatgaaacaggctatgcatttcctcagtgttcttccattccctccagtgaccacacatgtgtactgcatggtgagcccatgactgaggaatagaaatacagtcatgaggcagctaacagcgtttcaaagatgaagtgcatatacgatagtggtcctgtaaggatagaatatagctagaaaattcctattgcctagtgacattgcaaccgtggtaagatgtacatgttcctcatatgtttgtggggatgctggtgcaaacaaacccgtgctgccagctgtataaaagtacagcacgtacaacagtgcacagtacataatatgtgataatgataataagtgactatgttattggtttatgtatttactatactttttatagttatttaagagtgtacaccttctacttattaaaaaagttaactgtggccaggcgccgtggctcatgcctgtaatcccagtgctttgggaggccgaggcgggtggatcacttaaggtcaggagtttgagatcagcctgggcaacatggtgaaacctcatccctactacaaacacaaaaattagtcaggcatggtggtgtgtgcgtctagtcccggctactcaggaggctgaggtaagaggatcgcttgagccttggcggtcgaggctgcagtgagctgtgattgcaccactgcactccagcctgggggacagagcaagaccctatctcataaataaataaataaataaataaataaataaataaataaataaaatgtaatattcactaagtgtagcctaagtgtacagtatttatccaggccttcacaattactcaccactgactcactgactcacccagagcaacttctggtcctgcaagcctgactcctagtaagtgccctatacaggtgtaccatttttttatcttttacactatattttttactgcaccttatctatgcttagattcagaaatacttaccactgtgttaccattgcctacagcgttcagaacagcaacatgctccacgggtttgcagcctacgagcaacaggctataccatggaccctaggtgtgtagtaggctgtatcaactaagtttgtgaaagtacgctgtatgatgctggcataatgataaaatccaattacctaacaatgcatttctcagaacatatccctgtcattaagcaacatatgactgtctattactgagatctgtacatttttaattaccttcatgttactgaatccagctttaaaaaaacagcaggaaaccattttttcactgtgtttcaagtcagctacaatttaaatatcattagttcggtgtcaacctaaaatggaaacaattaccagtagaacattacatattacgtttacttttcatttttggtagcacaattcctatctaggaaaacataataagtttcctgtaggaaaagtaagataaaggaattaagaattcttaggggtctcactcacttaagaccgctaatatatgagaaaaaatatcttgtgctttgagaagtaagcttcaattacctgggaaatcaactcaagcaaaaaactctttcaatgatgctagacaaataaaatgcacaggtagatgtttgcacgtccacagaaattgcagccacaatcagatgcattcttcagatgtgaattcgtgcatacaagcaacccctgtctttcgcagagttaagttcaaatcctgtacacactttgttccacaaaattgctgttggcttgcatctcttttgtcacctttctccatccttaagtcctccaaggttctctcagggccaagactgtagggttcaatgaccttccctggtcagctgtaaaactagggctagcaccttcagaatccgccagccacaccctgctccagctcaccaccatgagttttctctcatcagcctccaaagtccaagccatcgctacatctcagagatgacgtacaacatgtgcctttattttatactctcaagatgctggatatagtagttattatccagaaagaatgacttcacaatcaggatccgagactggctataaacagtgatcgaatcctcaactcattccctctcgcacctacaggaaggtattaacaactgatcctccctttcatttttagagtaacaaacccagcttgtactacccatgcctacaacagcccagatgtggcactcaaggttgaaaaggggccayaacttggtaacgggacacacatgaccccatgcaggagaacagccagggccatgaggaaagggactttggtgcacaatggcaggtacctatgcccttgctgggacatggggcatcagggtcattaccagatgggtttacaaaacaccaaaacacggacagcaaaagtaagatgctcagtccattggcttgcagtgtttcagagtccctgcttgctgctagccacggggatgggggctgggagtcatcctgtttaaaagctgcagtgaaaacccagtgtggtcgtctctgttctcaatgtctaccttggaagagggagttcttaacctctgtggcagagcaacctgaaaacagaattatactccatayacatagctacaatgcctcatgcagaatgctcttcccaaaacygtgctcaaggatacaaacccaggctgtccaatttggggaaatcattgtttgagggtggcacagacaagcagtcggcttggggtttgctccctgtgcacagctcgatcatcaaggaaaggcctcttccgggcctcaaagctccctttgtgaggaatgaggcccactgtcgaggctcacacaggcagctgtaaycaggctgcccctctctctgggtgtttgttttgatagaggttcatttatgccagagacaatgcccgctctctttgttctgcccccagcaggaagcagtgcagggagggggaccagcattgtcacacagcttccaattcaggttttggtggccacaacaatggggcctcaagggccacaaataaagagccgctcacggggagcagggcagagagactggcacatgtggaccccagcacaccccaggtagaagtcacctcctaacaagtgctcaggctcactatcaagggctttgagggctctgaggttggggagagggaggccacctcctcttctcttaagtggtgctgggagggagaagtaagcaaggtccccggggatgacaaagccttcctacctctcctaccatttatcccaactaaaggagcaaacactcaaaaaagcaagcaaaaagaatgcacacacatgcttcgtgttctaacttaccaacagttgcacaaggaagaaaaaaagtctaatctgaattgccaaaaatgaacaatatcctttaaaatgaagcctgggctagatggctgcaagtgaatgaaatgtattacccaactgctgctgtaacacaagccctctcctcccccttctgggcctcattcataaaaagcctgcttcgccccagcagctgcaggaactgggactggatttgtgttttgtgccggtgttttccaagacagagggaaacaattgaaacagacaatcgctcagataccaacaccaagttcgcctccccttgagaagtttgctgcagtctcctggtctaatccaaataggcggagggagggctgggagggcatcctgcagagctgttcagtggcggttctaacgctaacacccagcgtgttattaaaggaattcccatctgctgagtcacactccgtatctttcactccctgacattttatttttttttaatcaaaggttgttctttgttggtaaaacgggggttgccaagttaattaaagattgccaaattggggtagagatagcaacacaactcccaaagaggtaattttttcattgtccacttttaaatggatattaccatctacagactttatgcagcctgctagaaatcttatgagataaggaacaacttcaattcttaatatatttttctaatttatgaataaaccaacaaccaacatgcttcatccaggcaggatgaagcactgtctccctcgcccacacccttttccacagctgccctcccagcccagcatcttttatcacctagaagggccaaggaggctggtttgtgcaactcaacaagctctgtaaaacaccaagtccctagaaatctcagaaatcaccatgagaaacgagaggctaccaaactttttagactcagcagccttcttcaaagcagggcccaaatacaagagcatgttctaatttaccaggaatggttttaatacaagaattacataagaacagagtgcaggaaaggaagggagaaataaaaccattcttgttgccctaataccagagcagtcttccggtgaattgatacataaattctctccagagacaagataatccaagctattaactgttcccctctcaactcttgcaaaacacaaggcttcgaaaccttgaaggggggcaggtggaggggaaagcctgctatatatttctagaaaataccaaatttaacaccacgatcccagcctgctcatcactgctggggatcagccattctgggaaggtaacagcagccctcagcactcccctccgctaagtaaacactcctttctaccacactcggtcccccatgccggccgcctcccacctctgcctgtggactgacagccgaggaaacaagaaaacaagctggagataccaaatgaatcttgcgaaatacatggtctgtgattaaatcacaataactctaacctcctcaaaggcaaacatatcaagatagcaagctgagagcaaaataagcaagtcttaacagaaattatgccaagctttataaagggattacccacacctcctagaggctgtgcagcctggaatccagggtggtttgggttttttttttttaaacttactgcagcccttctagctatccaatgaaagctcttacaaagaaaccttcaggtctgcagttctctgtgggttttctatgaatatgaacgtactttacgggtggagaaaacatatccatgatcatgtttgaggggctcacgaaagggggaggcacatgaattataccatgaatacagatataatgaatacagatttagtgagattttaatacctcaatattctctggtcccactcttaaacatcgcccttcaaccatcaaaacatcttaaatcctggggtaggggcatagttacccaaagttgtggtaccttccctaaagaaaactgaaatacataccaggacacacataattctgtcaagtttgtccctaactgtgtgatcttggacaagttagctaacctctctgtgcctcagtttcttcatttataacatggctctaatagcagaacgaacccttgagaggctgttgcaacagctggtacacagtaagtgctcaataaatattcgttgctgttattaacattgtccctatgccatctcaccccccatataagctctctgctaactttccaacacagagaacaaaatccaaattcttcaccatggctccagggcccatgtgatctaatagccctctctgcctgtcactcaccaggctccagccacccaacctcatctcatcctcctcactggacatcccacgtgcatcctgtgtgcaccagacagtcttgctggtgcttccagactctgactacttctctccactgaccatctccaccatcctggtctaaggttcatcttctctgccctacactggggcaacagcctactcctactggtctctctacttctgtccttgcccttacagtctctcttaacgcagctgccagcatggtcctgttaacgtacacaccagctccaaactctgccatctcctttcagagtcaaagccgaagtcctcaccgtggcctccagggccctacataactgactcagtttaccccatcccccaccaagatgcaccaagctctccaagctcctcgcctttcccytccctttcctttaggtcttcgtccaaatgtcacctctctagagaccttctctgaataccctacgtaaaaaggtacccggatacctgcctggcaccacgtaccctgtaccccacacctaacatgtgacccagccctcccatccccttccctactttaataaaagctccacagaggcagaggcctcattttgtccacttctataaccctgacaccaggaacagtgcctggcacacagcaggtgctcaataatatttgtggagcgaataatcgatgccatcatggagatctttccctcgctggggcctaccacctcatgttcctctccacgtcttctcatggctgattcacagtggcagggcaaatgtcccctcttcagaaaggccttctatgagaatccaacttaaaagtctccatcacaatcagtgagtctgtatttttttcatagcacttaccactgtctgacattattttctgtctacttgtttgttgtctgtttctaccactagaatgtttccatttgttttccatttggagaatggagttggctttgtctctgtaaccccaagtagctacgtcagcacaacagaatgctcagtccgtatttgttgaataaatggcaatgtatatactgacattctttaaaaactaaaagcacacatccagaagaggaaccgggagggctctgtcttaccccagatgacacataccctgcaggtgcatgtgcatggaatgccttgggcacctgaaaacaccaccccgctcccccaaccccaaatgaagagctctccatctgacctgggagaagcactcagaacctagacatggctccgacgcaaagaaaaacaatttgaagttactaaataacagcccaacatctgtcaccacatatgaacaactctatgcacaggtaacggtccactcgccatgctcactgtccaaacacccgggcatcaggtttaccttccccctgagtgggctttcgagcagtcatcacagctgcctgggagacacagctctaaaacggggctcgggctgcagcccaggggccaacactgagctcccaaagctttggatgcatttcctactcagcatggacatcaggtgacttccttaagaggaaaaatcaccccgcaagactgctgagaaagcaggtgtggcatttatcagtgctgctgtcatccatagagaagccaggaacaacgaaatgtaactctgtgtacacagaactctgccaccccacacagrgcagatggggcagccatcagaaatgcggggcatggacccaaacgccagcatagcaccacacccccaaatgaggggggaacaggctcagcaccccaagacatccaagcaccatggcttttacagctagatgcactctccacaagccaacaggagtcgcgagtgagagccttcgaacacatccagtgtgaacatgcattcagcaaacatttcctgagccctgctttgtgccaggctgttctcagtgctcaggatacacaaggaagaaataaataaaarataaggtttctgtccttgtaaagcttatattcgtgtccgtgtgtgcatgcctgtgtgtatgtataagaatacattcaatagacacaattattaagtaaattaagtcatatgttagaaaataagtgctgtggcaaaatccagattaaaatcaccaatcactagtcaggagaccccatcagctacgsaaagaccatacaggtagtgtgcagagacaccagagaggtcaccctgtttgatcgacaaaagtatgctcattagaaggtaaaccacaggactatggggtctttatctcttttytccctgcaggattctcagctcaagaagagcacctggcacaggtcagggactcagaagcatttgttgaagaaatggaagtgctcacccactgagttcttgcttctgcagcattcctggcaggtmaccctctcgagttggctgaaatctttccaagaatgaaaagctgggcttttacaacaaactaacaagcaaaccccaaccaaccacccccacacacccccaggcgcctttactgtattactttctggaccctctgagacacacacagtctactactaacgccagcacatgctgtgatgggattcccccagcagtgcccacacgatgctgggcccacacagcctgtgacacctgctggccacttcgctcccayggagaagcctctttcacgttcatatgtgctggggatctgtgtctgctgagagctgagctgcctgcctgggatcagccagatggagcaggcagagayggcacggaccacactccagaggaacacgccatggatggctrtaytgttgatgtttcagatatccaaaaagtaaattataaatcttagcggtgatttagctatcctatttgccaaaggtagtttacacgggtgtttcaaattacttggtaagaaggcacaggtgacacgaagggaccacccacaaatatctggcatgttccagtcgcatgcatggcatgtcgcatgtggtgcgacagttctcaggaaacagcatttgtaaaaacatgcttattaaaaaattagagagattttctataagaaacacataataggcgcagtggctcatgactgtaatcccagcacgttgggaggccgagacaggtggatcacgaggtcaggagatcaagaccatcctggctaacacagtgaaaccctgtctctactaaaaatacaaaaaaaattagccaggggtggttgcgggtgcctgcagtcccagctgctcgggaggctgaggcaggagaatggcatgaacccaggaggcggagcttgcagtgagccgagatcatgccactgcactccagcctgggcaacagagtgagactccatctcaaaacaaaacaaaacaaaacaaaacaaaaaacaagaaagaaacacataataatgctaatctaatcatttgtgtatttttaagtttttaacttactgatacatgtcaatgtgttaagaccaaaaaaatacatgaatttaatttaagtctagacggcaaagtcaaattaatgtagtatacaattttcttaataaacttttcctttcctaccctctttcgccccattttgaactttaaagaaaaatttgcctttttgctgcttcctaaacaatctatgactgctacaatagtcaatctttattttcccacttagtttgcttatggatgtgagggttaaatgttatgaacataatttagtgcttacaacatcagcaaatctggcttcttccttgagctgatacacagtgaggttaaggtcagggaaacatccgtgccttctggtccaagctgagagcattgctaaggtaagcaatcaaagctgggaaggctggggttggggaggtgtcaaggatgacacaatacaaatgctaaagtctacaaaacaaggttgaagactcaagtccacagcagcagtggttaaggggcgggggattcttgcttgaagacgacaccaggcacattttccagttggagagcttgtagtgaattcagatcacttggtatttcaagtgtttcccaaactactgtagatgaagggctctgaaattattccattttgaaactcattactgattttgttacaaccaaatagcagcaaacatttgtacagcagtttccagtagttgtacataaaaatgctttggaacacattacttgggaaatggaactttacacagacaaatcagaatgccacttacctaatggagacagtttgcttactaattaattctcaagtccattttgtaaataaaaacagaaatggggccatcctggagaatcatgatgctgttaactgagctacatggaaggcgcagttttcctcctcttatcactggtcttttccttctcacactaagcaatctgagcaccacggggggcaacacctgctctctaatacagaagagatgggtgtatacctccattctaatacagaatgtctccatatacccagccatttctagggaaaatcatctctgacagctggcatgaaatcaatgtccacctgaaaagtacctttgagggccatctaataaaggccaaaactatggccacgaatccaaaactgcggaagtctagactggcgtttctaaataagctagagaaaaatactcaatgtgcgacatcttgtaaactcacagctgctgaagaacagtgtctttcagtcacatagctgaactgaatgcagaggacactgccatttgtgaccaacatttcctttctagggaggaatacccaggacacttgttacggctgctacctaagtgctaagatagggcgcttcgccactgtgccccctgcttcatctcaaaaactaaaattttccatcaaaaattgccctcattttgtgcctttttgcaaaagtgaagctatctaaattctagcaaaggaacgaacacaggtatttcagaataccccacctttaagggtctcaaagattccagggtgttccctcttaggatggagttttatcttggctgaaataaaagggtcttaataaagtctttttcctgcagacctctgggtataaattatagattcatgtcaaaacagtgaaagggatttgaggcaaaagatatttctttcataaaatattatgcatcagagtatacgttctatgctataaatatttagcaagggataatgtgacatatttactaatatttctgtcaaaataacaacatctaaactgtcacttcaacaaggaagcttctcttcctgttttagtatagagaagcactaggatatcgtctcttttccttttaaagaaaaatgtattctgactgctggtaaaatcaggagtaacttgagtctgtgacttaaagggcagaactaagccctatactacagtgataacagtaacaggaacatctgattacagataagctggctcctcataaaccctgatacaacctaaggcctccattttcattacacaccttcaaagatgcttttaaaatggacttgtttattgacaacacaagattttttttaagtacttgttttccttttctaaaggggagacttcttgctatttgctaattttcacatctgtcaatgctgacaacaactggatctgttgaataaacatttattccttttgacaaagaaccttcacataaaattgaactcaatggaactttatgatcggggcaagagaatttggagcaacttcacagattagtaatatctaacagtggccaggccctggaggttctcttgcagtgaccctggggaatggaccagtctttgtatcagcagaggacagaccagagcttttcaggaggaagaaaaaaaacaacccaacaaatcaatacagcaatatacaatggtagacaaagctacacgcgtttacagagtttcagcgcatagaaacatccagttcagaagcctgttaaacttacatctgtatttggaatctcatgggaggcaacccctggcaaaatatcaactcttattgaaccaaaacaaaatctgtgtaggcacagagtatcagtacaaaatatccaaaaacaaaagctcacttttccaaaagaaaaacgctaagttcaaggaagcagccaataagtaagagaagtttgggcttttgaccttcccaccctcccatgccacctaggaatattcatttttaaaagactgaagttaaaatatataatacatatatgaaaagatcccctaatttgggccagccataatcatcttaaaatggtaacctgggtaacaactacctatcataatttatcctttgaagataaccacagattcatggttttgattttaaaagcttctttccaaacaaataaataggtatcaaatcaaaaggcacactttaaaaataggaagattttgctaatttgtcttcatttgcaaagatgaatcttactctgaaacctcatttgagagtgctctagtctctcaggatgcatagaaatgccttataaatgctaagtcatataataatggttatgtatttgggtgttagtcatctgctcttcttgctgagataaatagctaccatctgaaggtgaacacttcaccttccctacatttacaatactctaccatcaaactttcatttagattagcaaataaatgggagttgataagagagctgtcaggcatacctaacaaacctgaaacctaagtgttaggaaagttattctgactcaagtattctacatacaatgaatttggggaccttatagggtaatagggaaggaaaaaagatttttctcttaactagctgctgggccccacaaacagggagaattgtctaaacctgagccaccattctgatcctcaaaccctgccaggtgaggacctatagctagattgtgtactggaggatattagagcagattgctcctctgccaacttctctccttccttcttctatttcttccctttcaaaccagaccactgaaactctcagtctgtatttatgtgaaataacaggaacgttaaacatgctaccttctatttgtacagaattgccatgcaacacaaagaatgattatgcattagctacgtcacatttacctgtgaaatttatctcattgtagcactataactctatttactaaaatatgttcatccttcgatcacatagtattttcaccaacttaaaattttaaacggaatcagaaaatatacagcctttcctaatggcctccttaggttttcaagcttctccccaccttctactttttttcagatggtataaggacttttcatctgtgataccaatgggtacttttggttggaaaatcttcctctgacacagtccacaagtcacacattacacacctaagtggtcacaaacaggattttaatctatgtgaacagatcaccaatcttggtttcatccttttatgagtaaaatgtcataaaaaaataaactccttaatacatgtaataagttacaagtgaagtaaaaactaaatattagaggaaaagatacaaataagttagttgttgcttttttaagtttttcaagatacagaatatcattacagctgttgcatttgaaagatgatgcaacagacaagggcaaccacacccccaagatctttgcagctccacaagaataggatttagacccttaaagaatatgtcttaacatttatcagtcaataatgtattaggcatttttaagtaatttctaaccaacaacccatcatcatcactgaatcatctgagcatgaactaagctatgcaaacttctttaaagaaagtctgggacaagcttcaatctaatgaaggcttaggaacagctttactttgtgaacaactacagcttgctggagaagaggcatctcacaatagcacaaaagaacacaaaaaagaaagtgatctttttgattaaccaacgtcactttctgctttgttttaggcattataaggtaaatgaactaaaggtaatcaaatgatgaagttcttcctgccctaaatgaatgtgtgtttagtccatttacctactgagtcaacatggaaagaaaaataagaaagaaaactaaattttgtaagacagtagaagttttaatacatactcagttctaatgccgttaattttgttttccttccgatttccttaagggaagactctggttgagtctttctctgctttccacatagcccctcgaggcacagagacagaagggtctgctgtgggaagagaccatggagcaggtgcagtggcccctctgaggataaaaacaacacgcccagaggctacaaagccagctagtgacccagccttcaccgctcccagactccatctcccctgctcccccgctataccacaggacctttgcaagtgcaaactgcatttgagataagcttccccagacatgctttcatgaggagcttatggcgttttctgtgctcacaagcagggtctggcactgccctaccaagggaatgatcacttgtaagaagagggaggacaaaactatccctgatggctctttcacatgtttcttttaaataaaaagagtgatgatctttctaggcaaggacacaagttgcccaggccaccccctttcccttcaaacacccatacccacctcatatggcacatatagtaccccaaaatgccagataagctgggccacctcacacactgcaatgaccaagcccatctcctccattgtcctcatccttccttcgaaatcacctgtcccggcctctttccaaacccaagtggaacagagccacttgaacagagcttccttcacagaaatcctccggaggcaaaatcctagagcacaaactacatagaaactgaacagttaatgtacatttcctttggctaagtcacagacactaaatgttggcagacagagtacatctgaagcaaatcagggccattttcagggcagagacttgcttttattctctgagctccagcaacccgcctctctgacttcttcctcccatggtgcttttccacccagataactcgcccccaaagctgaggaccctcccaaggccatgaaaggggcctgggttcacctccactgtcacagagtttaagaacacatgccctgtatagcctattttgtttgcttgtttctttattaaactataagagcatcatccaatttgaaatgcccctcctccaaagaaaaagctgcgtggcccaatgttaaaggtctacatcagaagtcactgttgcacatcattataattaagaaatggcatatcaccttctttgtaaggtataacattttcaatgttgcaatataagctgaccacctcctctaaggcgaggactcggcgtcaggggcagggaagtggtgagcaaagaaagggcaaaaacaagaccttgatcacagaagcaagaatctgacattggattatttttgaaacatactacatacataaggaaaatgatgatgctataaattaaagttgtggttttctacattttaaaaaaaggctagccagccgaccttatcatccctgtcattccaatgggaaaaagcgtcatcagcacaattgtagaagcctagaacaatgtgtccctgtcaactcagtgagggttttcttctttcaaagataaatcaagatgccataacctaggaataatataactacttacacacagagaacaaagttggcaatcacgatctgagttaagtttaaggtatgtttgtctttccattttacaagaaggtaaatgaacaggaaagtgagctggaacaagtaaactgagccataagcctacgtgtgcttttttgtagaagcacagtctaaatacacacacgcaagccactgcaaaatgactttctaagttaaaagtcagagaaatcaatgtttgactgactatggagcatacaaattcttcatttgctttcatcagctgaaaaaaaaatgctagaaataactacggagaaatggtaaagaaaaaaatgtaatgtacacagttttgctgaaaaccatgaagataccagcagaagaaaaaagaaaatgaagacgacaaatgtatttcacacaaagatgaccggggctgtttctgcacagcctccacctggagctgaatcaccggccagaacagggattaggacaggcctcactggcctcccagagctgtcagacctcagcagggcgggcgcatccttgggtagcccaatcaaggctgagcagtatagaccgtttgcaaacttgcgcaaactgtgaagttatttacatgcattcagggaaaagactcccccaaacagggaagcttctaccaaacaaatgccttaaaaattattttatgaaagagatgtctgttatgtgtaaacagacactaattgttgctgcaccttgggtaagtgacagggctcagagaacaggaaggaagcctgtgacttagcagacaacaggacagttcttccctttgaccttccactggtcccagattatgactcagagactgtctcccactctttacccaaggggagatccctgcacctcctcctccaacatcctacatctttaaaatgctcctctgaatcccagaactacagaaaccacagcactcgtgctggtgagcagattcctaattgcagaagatgcatacaacttgatgctttcagattagagtctacccattcctaccatgcatttgttcctacacaatagcatacgggcatgtgtaggaggtcaccccacattctttattaactt

SEQ ID NO: 17837 - DNA, 15357 bp, Homo sapiens
tcagtgacattaattatattcaccatgttgtgcagccattatcactatccattaaaggaaccattttttttttctttttgacatggagtctcgcactgttgcccgggcttgagtgcaatggcaaggtcttggctcactgcaatctctacctcccggattcacatgattctcctgcctcagcctcccaagtagctgagattacagcagcccaccaccacacctggctaattttttgtatttttagtagagacggggtttcactatgctggccagactggtctcgaactcctaaccttgtgatctgcccgcctcggcctcccaaagtgctgggattacaggcgtgagccactgtgcccagcctaaaggaactatttttacatgataaaaaacaatggtatggagtcagcaaggaaaaccacaataacacaaatgctgactttcctctcttccactacttctactctccttgcaacttagtagcctcattttgagaggacataattttaagaaacagttggcttgtagttaaggcaaagaggagtggggatgttctatgtaaaggttgataagatagggtaacctgttttcaatgtaacagggattgcagtgagcacaccagatagcatctcccggcagggggtagtgagagaatggtcaaattgtggaggcctagcttgcaatggcatgagactgtgggcagaaattaattttaacattttagaattaatttttgttggggatttccctgcagggctgctgcacgtggtgagggctcaacccctcaggcactcctgtgaggcccctggtcacccaggggcacctttaggctgggaggggcaaaagccctttgtcttcagagctgaaaaactcagtctctcatttagctttgaaaacaacagttcagttcctcagaatcaagataaattttaggagaaaaagcaatagagaattccctttagaatgcatctctgaattagaattaggatccttaaacaacaatttcctaggagaaaaccagctcagaataaatcaaggactgtcaaacaaagggaggtctggggctcaggaggacttacccgttccaccgggggagaagcttgaactcagtgggacttcaacgggccgctgctggtaccttagctctggtttcgggcaactctttcagggtcctgagtcttctctgaggcctcatgtatttgggcaccaaaatattgtcaacaaaaagagtcaaactctataaaatatttgaagatttattctgagctaaatatgagtgaccatggcccacgacgcagccctcaggaggtcctgggaacatgtgcccaaggtggtcggggcacagcttagttttatatatttcagggagtcatgacacatcaatcaaacacacttaagaaatgcattggtttcgctcagaaaggtgggacaactcaaagcaagggcttccaggctaaaggtaaatttaaatcttttctggctgacaattggttgagtttgtctgacccgtattaatttcctagtgctgccctgacaaagtaccataaacttggtggctaaagccagcggaaatgtatggtctgacagttctggaggcccaaagtcaaagtgttggcagggatggttccttctgggggagaatctactcagtccactaatttaaatactaatctctagtggaaacacctgaacagacacacgcagaagtaatacttaaccagatatatggatatttcatggccctgttaagctgacacataaaattaatcatcacagaagctcacctatgattaattgatttttttgagggtgcaaaaagctactcagtgatgagtataataaaatattagaaagagtgtttttggttgactcagaattttggctaaaatctaaagctgagaacaataggtgttaagaaatcctatattccaaagagagttcttagcttaccctacaggactttccaaactggtctaaggacaattaccaacagcccatatcaggaaaagatagagactgattgaaaccacctttgcgaaattatgacagtaagagaaaactgacatagttgactccattttgcttctaagctacaagatgtcttcggtgattcctcagtgtaggccaaactaacttcaggaggcacttaatttatactttaaccttagagcaaagatgataatagccctctcctaaaactaaaccacctctgtaaaactaatgaaaggccacaggttaggattaggaattatgagaggggcctgaattctgctaaaatgtaggcaaagtgaaacgataaccagccattgttctggaggtcacaagatttgtaacttccccaattactcctgtagatgacatcaactgttatagaacccaagattggccttttgagatttttttcagactgttaacgtttctcatgaccagctgactcgggccagacctgcaactcatgagtcaatcagtcctgtagccctacccagaggccaattcagtgcatgaagactattttccacactcctatgattttaccccaatcaatcaatattccccattctctagccctctgaccaccaactatcctttaaaacccccaaaactttgagccttcagggagactgatttgagtgatatttctggttctactacatgagttagcctcctgtcaatcaaactctttctttactgctatgccgtagtctcagtgaattgattttgcctgtgcagagggcaggaagaaactgccggtgattacatgattgcagagacaaattccttgaaagaatttgtgaatcaaaagattgctggggtctgggtgtagtggcttacatttgtaaccacagcactttgggaggccaaggagggaagatcgcttgagcttaggagttcaagactggcctggggaacgtagaaagtcatcatctctaacaaaaataaaaaaataaaagaattagctgggcaaggtggtttatatctgtagtcccagctactagggaggctgaggtgagaggatcacttgagcctgggtgatagaggctacaatgggctacaatcataccactgcactccagctagggtgacagaatgagactctttaaaaaaaaaaaaggggattactggggtatttcccctcccaccctgattccaagtgagaggggaaacaagagggcactttggggaaattgggcactgcttgctgaaggcagacagagtcttactccttggctctatgcttgctcagctatgggagcttgtaaatttgagacagcatggagaataaaaaagtgtttggaagaacctgacctatgtcccttactgaagaggacaaagacacttttgtgtgactattgtttagagaggcccagtggtgagaagttagcagaagttgctcctgatgacagggtaaggtggggtggcttcaaggctcagcttcactatttggtgagtgggtatatgagctcccctcatcccagaagtagcagatgtgggtttgcgtcctctacaaagggctttatccaagaggactccctatcggtgggagatcctacaagaaagaagccatgttggatgcttcactagaagttgagagctaaggtaaagtcacaggaggcctcccagagagcatctcacctgtatcagggaatgatgcagtgcagaaattcctcagggatgtatctctgtgtaggatctcctaaaaatccattgaagaaccccatgagagacaattggtatttgtgtattgtatcagtcaggtttcaaccacagaagcagaaccagtagaagagatacatacagtcatgcacagcataatgatgtttcggttaacaatagatcacacatatgccgtaattatatccataagattatagcgaagctgaaaaattcctagtgacatcctatctctagggacatcatagctgtcataacatcacagcacaacacattactcattactcacgtgttcgtggtgatgctggtgtaaatgaacctacttcactgccagtcatgtaaaaaccatagcacatacggttatgtatgatacataatacctgatgataatatgtgcctctgttattgatttatgtacttaatataccatactttttttttttcttttgagatggagtttcactcttgtcacccaggctggagtgcaatggtgtgatctcggctcgctgcaacctccgcctccccggttccagcgattcttccgccacagcctcccgagtagctgggatttacaggcatgcgccaccatgcccggctaattttttgtatttttagtagagacgggtttcatcatgttggccaggctggtctcaaactcctgaccacagatgatccgcccgcctcggcctcccaaagtgttgggattacaggcgtgaggcaccgtgcctggccattatactttttactgttattttagagtacattctttatacttatccattaaaaaatttgttaattgtaaaacggtcttgggcaggcccttcaggaggttttccagaacaaggcattgttatcacaggagaggacagcttcatgcgtgttactgcccctgaagaactcccagtgggacaagataaggaagtagaacagtgatattgatgatcctgaccctgtgtaggccttggctaatgtatgtttttgtgtcttagtttttaacaaagctatttaaaaagtaaaaaaaaaattaaatagaaaaaaacttatataataaggatataaagaaagaaaatatttttgtatagctgtacaatacatttgtgtggtaagctgtgcgttcatacaaaaaagtgtagtttggagatttctcgaagaacttaagacagaactaccttggaaccaacccaaatgtccatcgatgatagactggataaagaaaatgtggcacatatacaccatggaatactatacagccataaaaaaggatgagttcatgtcctttgcagggacatggatgaagctggaaaccatcattctcagcaaaccatcacaataacagaaaaccaaacaccacatgttctcactcataagtgggagtcgaacaatgagaacacatggacacagggaggggaacatcacacaccagggcctgtcagggggtagggagctagggggagggatagcattaggagaaatacctaatgcaggtgacgggttgatgggtgcagcaaacaaccatggcacatgtatacctatgtaacaaaactgcacgttctgcacgtgtactccagaacttaaagtaaaaaaaaaaaaaaaagacagaactaccattcaactcagcaatctcatcactgagtatatacccaaaggaatataaattgttctaccaaaaaggcacatgcacgtgcatgttccttgcagcactattcacaatggcagagacatggaatcaacctagatgcccatcaacagtggactggataaagaaaatgtggtacatctacaccatgaaatactacacagccataaaaaataaaatcatattctttgcagcaacatggatggagctggaggccattatcctaagtgaaccaatgtaggaacagacaaccaaataccacatgttctcacttataagtaggaggtaaacatttagtatgcagggaggcagagtggaacaaaagacactgagggctacttgagagtggagattgggagagagtgaggatggaaaaactgtctattgggtactgtgctcatacctgggtaacgaaatcatttgtacacccaacccagtgacatgcaatttacccatgtaacaaacctgcacatgtacccactgaacctaaaataaaagttaacacaaaaaggaaaaagtttattaagtaaaaaaattagaagaagctaaggttaatttattattgaagaaagagatttcacttcacggcagctgtggcctgactgtgaggcggctgaccagcctcagctgagagtggagtggtggccgtggccctccttaggagatcaccatatcacctcttactgtggccttaccatggcgacctatgggcagacctgcatgtggccagtgtggatttcttcatcatatgttaaccttggcaaagctgccagagatatttttaacaaaggatttggtttggggttggtaaaactggatgtragaacaaagtcacgcagtgctgtgggattttcaacatctggttcatttaatgcagacactggaaaagcttttgaagtcttggagaccaaatataaacggtgtgagtatggtgtgactttcccagaaaaatgagacactgttaatactctgggaacagaaatcacaattggaccacctttgtcaaggtttgaaactaatatttgatactaccttcttagcaatcacaggaaacaaaagtggtaaaatcaagtcctcttgcaagagggactgcataaaccttgcttgtgatgttaattttgattttgctggacctgcaatctatgcttcagctgtctttggttacgagggctggcttgctgggtaccagatgaccactgacagtgccaagtcaaagctgacaaggaataactgtagtgggctaccggatgggggacttcgagcttcacactaataacaataatggggcagaatttggaggctcagtttatcagagggtatgtgacaatcttgatacttcagtaaaccttgctcggacatcaagtgccaactgcactcattttgtcttgccactaaatatcagttgcatttcactgcttctatgtttgcaaaagtcaacaactctagtttaattggagtggaaggaaagagacttcatttacactcagactctgagcctgctgtgaagcttgcactttctgctctgctagataaaaagtgcattaatggaggaggccaaagacttgggtttgtcctggagttggagacttaatccagctgaaagaaatggcaatggatatcagaagatttggctttaatatactttcattgtgatcagcaggctcttcccacaaagaaggtgatcaaaacaaaggctctaaacaagagctatattttaaatatttaaacagctactcgttagctggtttctagttgaattggttatgtatytagttaccaatatgctgcaaccgtgcagtcacctacacattatttaagtatatttaactgttamatgcactacccaccaatcatgaaataaactttatgaaaaaaattttttaaaatgaatttactatagcttgagtatacagtgtgtataaagtctacagtaatgtacaataatgtcctaggctttcacattcrctcaccactcactgactcacccagagcaacttccagtcctgcaaaccccattcgtggtaagagccctatcgaggtgtaccatttttaatgttttatactgttttttgatggtaccttttctatgtttagatacatttagatacacaaatatgtgccattttgttataattgcctacagtaacatgcagtccaggtttgtagcctaggagcaattggctacaccatataggccaggtgtgtggtaggctcttccatctaggtttgtgtaaatacaatctatgacctttgcacaaaaacaaagttgcttagggttacgtttatcagaacatatccctgtaattcagtgatacctgtgttaaaagatgtactgcagtggctcatgcttgtaatcccagtgctttgggaggccaagacaggaggattgcttgaggccaggagtttgagaccagcctgggcagcacagtgggaacccccaatccttacaaaaaataaaaaattggctgggtgtggtggtgcttgcctatagtcctacctattcaggaggctgaggctggagactcgcttgagctcaggagttcaagatggcaataagctgtgattgtgccacagcactccagcctgggcaactgagcaagaccctgcaaggaattggctcatggctaggcaattccaaaatccataaggcaggctgccaggaagggcaggctgggactctctagcagaagccgaagctgctgaagctgctgtctataggtagaaattcatgtttatcagggaagccttaattccactcttaagacctttcaactgatattgaatcaatttcacctagattatctaggatactttcccttacttaaaatcaactggttacggactttaacgaaatctacaaaataccttcaataaatatctagattagtgttggattgagtaacaggggactattgcctagcaaagttgacacatgaaaaaaccatcccaggtaacttccacacaaaatcatggccagagaacaatagtaccagagcaagacttttccctcttctttgaattccccatctttgaggctggagggctgcatcactcccccactgctggtttgtgagagctgtatgtagaggaaaacaaaaattagccgggcgtggtggcaggcacctgtaatcccasctactcgggaggctgagacaggaraatcgcttgattctccacccaggaggtggaggctgcagtgagcagagatcgtgggctgcactccagcctgggcaacaaagtgagactctgtctcaaaaaaaaaaaaaaaaattgaaacaaaaaatgaattggttataagaataacattttgatttagattggattaaactttctcagtcaaatgagactgttagagtagcttaaatttattagaagagctaaatgatttgtctgataagttgtccaagggtatggaggctctggttggagaataaagctctttcctgattgcaatatatgaattctgttcattcaataagttggtcatatgtataaagtagacgattgctaaatataacattagttatcaccttcaaagcttatctcttcgcctccgcgtctattctctttgtcctctctcatttgttgtttttgatggctactctatgcttttactgagaatagaagaatgagaaaaccagcttagattgcgtatgtgaaatactagaaagtgagattgtattttccttctctgatgactttacaaatagaatgattaaaaagtatttttytctaataatttgtgtacacagaaacttaggattgacaaaacgatcttatttgttcttgacatatgtataattttatgcttttttaaaaaacttttttttctgttcatggccttttcctctgtttcttcttcctcatgacaccactttaacaactgatgtcttactacacattattctcattatctcattataggatttaactgccctctttcggtcaatgccagtaattgcaccattaatgacagttgctaaagcagtcagtccagtgacttttcagagggtgctgagattacagattctcttccaggattctttgtttgtttagtagccaatcaagggtaaagtctcttctattcaatcactagaggaaaaaccattttctcactaccttgattctagaaaaatttgtgcattcttttgataatactcagacacaaatagttctttagtggccattcaattattccctttgttactgtacatttccaagatagattatttgattagcaaaaatgcctgcgcaatgcattcaggttattgccaggtatggacactactagaatgacagtgagtaagagagaaaaaagaaatgatacctttcagtaagaaggaaaatggaactatcaataatagaaggctaattagtaaagaaaaagtcaagagaagataagactgagaaaaacttcagattcttaataaaaagaaggcactcaattataggaaagtaaactttctgaaaagtaggagagaagtaggatagtggtaaatttgctaccattttgaaatggtccataatcatgaatatataatttcagtatatggcacagactcattacagaatcacacagtgctaagttcctaggccttgtctgtcctcgaacaatagtatataatttaacttctctcgcctcatcttgacagataaataccatgctatccatttttctgtttaagcgccttctgtgttgggctatccaagtcaggaaatctttccttagtattctgtaggacccattaggttgaaatcaggaggtttttcaccatttgatggtttggatctataagaaggacactttcatattgttcaacccaaatatttattgtcctgtcatgaaatagcaatgatatatttggaatgtcagctagcttttctgtccagtgcctccctcccatcttcatctcagatattaaattttactaaaacttacttttatttagaatgtaattcttctgaatcactttcagactttctgtttttatatgtggttgtgtggtctgtgacatcacaggacattttctgaaagggtgcctcactattgtctctggggttgttttccaaactattgaaaactattctgcagatcttcatgctcaaaatgttttgatcttacaagaacttatcactgaaagatttcaaacaacaactagaattcagattcctttttcaactgcttattaaacggttcattgattgaaacattgagagattgtagttgttcaatgggaatgtcaatgggaagacaactaagtttatgcatgaagagggaaaggcaagtgaatcacgaccactgcccacctgacagcagctgtgcaaaatgctgtgacagactgtttccaaagatgcacatcactgcgtatcttccaacagacatgccctttaaaaacaactttattgccaggcgtggtggatcatacctgtaatcttagcactttgggaggctgaggcgggtggatcacctgaggccaggagttcaagaccagcctggccaacatggtgaaaccctgtctctactaaaaatacacaattagccaggtgagatggctcatgcctgtaatcccagctacttgggaggctgaggcaggagaatcactcgaacctgggaggcagaggttgcagtaagctgagatcgcgcctctgcagtccagcctggcgaaagcgtgaaactccatctcaaaaacaaacaaacaaaaaaacaaaacaaaaaacttggttgatatgtaattgatgcactataaactgcacctgtttgacatgcgtattttgatgagccacaggattttttgccatgtgtccttgatactgcttctccaagaatttgagtctatttttactattcttgaatccagtccagccctgtgactcacttgaccagcagagtgctgtggagctggtgttgtgtgtcttggagagctaggttatagaagcctggcaacttctactgtctcttggcacatttgcacttgggacccctgacctgccttgtaacaagtgtatctacttgctggagagaccaggtagagaggacctaagtctatttggagagtgagaggtcaagttatcccagcatcctaatcaaatcttcaggtaattccagctctagctatcatctaactgcttgaggtaccccatgcgagaccactcaccttaccccagtcaaccatagaaccatgagaaataagaaaatgataattactttaaactgctaagttttggagtggtttgcgtgcagcaatttatcaccaaaacagagactggtactatgaaaggctgatgattttacaaaaatctaaaatatgtggcattggtttggggaccaggtgatgagaagaatctggaagggactctaagaaattctttgtaaaggctggaaggacaaggaacacattttttattgggagctagaaaaaaggtcgcttgtgtaatgtagtggcaaaaagtttagcaatgcttcagcttgtgataaggtggctaaggaagtatctacctaggatgttgaatataccagctcgtttcttttagctgcatgtgataaggtaaagatggagatgaactaaagaagtaactgctcagttttcaactagaatctagaggcaacacatttctttgccagattttttaggattgaaaacaaaactgtttctcatctccattctcttccagtaaaagattattaaagtaataaattacaacagagcaaaagatcaaattcagggcactgccactaaaagtatggcctcagggtcaagatttcaagattacagctgtagacctttgtgtagacctcagaaagatttaaaataatgcctcctgaaccctctcagctaggcaaaaagtctactaaaaatcccaaggacgtgtttcttagaccttttctgttaaaggcttcttagaaacttaagagcattgttacccagcacttttcttctcagtcaaaggtagagagggacctgtcttatgatttatcagtgtggcttttgtttactggaatggttatagattgatagaaaagaagtccatacagcttttaaaagaattctgctgccttgtactgaaagggagagacagttgaaaataaaaaaataaaaagaggcctctgagtcttcaaacttttatagtcaggaagcagtttgatattgaccagcaaatatgggcaatgtcttatagaaaaggaaagataacttaaaaggaagatcttagaacccagaaagcagagggaagaggaatggagaagcactttgatgattgcaggactgggccctcatggaggaatggcgatgtgttcccagccagaattgctatgatgagtgattgctatgtgcttcctgttctctcaatttttttgaataggaatatttatgcccttatcctttctttgtctcaccatcttttttgggtttgtgtgcatggcagatatctttttttttttttttttgagatggagtcttgctctgttgcccaggctggagtgcagtggtgcactcttggctcactgcaacttctgcctcccagattcaagcaattctccctgcctcagcctcccaagtaactgggattacaggtgcccaccaccacgccggttaatttttgtatttttttagtagagatggggtttcaccatgttggccaggctagtcttgaactcctgacctcaggtgatccacttgccttgggctcccaaagtgttgggattacaggcataagccaccacatccggctgatatcttgtttcttaagttcaaatgtcttcgggttgagatatcttgtctcctgtgctcaaggagtagtacctaaggaagttcacccaaaggactccattcacatctgatttaggtgatgaaatcttagacttatgcttaagaagatgaggcttttgaggaagaggctaagtgcattttgtatgtgggagagagatgaaatttgtggccaaatggcagctcataacaatgtgtgtttccaaaggtggccacaataatatctccaaccacatgctcttttgtaatgtgatcttgctactcctccctcaagaggtgaaatctgtttcactcttcttgaatcctagctgaccttatgatgtacttgactaatcaaatgtaatggaagtaatacatgacttctgcggccaattcaaagaaatcttgcagcttcttcctatagtttttgaagctcttgttcttgggagctctgaaatgccatgtaacaagccaagctactctgttggagagaccataaaatgaagtcctgagactacatgcagggagagagagaacaagcagtctctcagaatcccagtggagtctccacgtgactccaatcccagctgccatctggctgcaatttcatgagagactcttggcaagaccatgagaaaaatcatccaggtaagccatgtcaacccatgaaactgtgaaatatatgaaattgttgttttaagcaaattagattttggggtggttttttatacagtaacagataaatgaagcagatattaatttattgtaatatgtgtcccaatttcaaggatcttaaaatgtaaacaaagtacaacttagaattgatgaaatagaaaaaaagaaacgcatgcaaattatatgaataggtaatttgtagaaaaagaaatcccaatggctagtatgaagagacgctttactcctctagtaatcaaagaaggaaaagtttaaacaatcaaaaaataagaatttttactcaaaaaaagtacaaacaggcttggcgtggtggctcacacctgtaattccaacactttgggaggccgagacaggtggatcacttgaggtcaggagtttgccaccagcctgaccaacatggtgagaaaccctgtctctactaaaaatacaaaaatgagccaggcgtggtggcgtgcacctatagtcccagctacctgggaggctgaggcaggagaactgcttgaacccaggaggcagaggttgcagtgagccgagatcaccctattgcactccagcctgggcaacagagtgagattccatttcaaaaaacaaaaaaaaaaccccaaacaattagaaacctagatagtggtaaatattggcaagaacacaggggaaatgagacctccttgtatactactagagggagtatagatttgtgtagcattctggttgaatagtaaatttaagttagtatatatcattttattcaacaattcttatcctggctttataacccagagtaattatcacataggctgataaattgacatgtattaggatattcagagcattgctgtatacagtagaagtatcataaatatctgtcactaaaggagtgaataaaattttggtggctgcaaattattttagtggaatactatacagaagttagaagcatgacacaaaacatgcaaatagcaacacagaaagaggctgaaaagtattgaaggacttctggtttctggcatgacttataaagagcttggaagtcaccactgccaccctcacaacaaggaaaaaaaactgaaatactgaaaatcaacaacttttcttagatccatcaaagaattgaggtaacgggcaaaccatcactcagaaaactgagagagagaaccacagttttgcgagagaagataccacagctgtcatcggacctgtgaggcttagatcctatttaagaagtctttagagaagcccaaagacaaaaatgacgacagaggaaattttagcctctaataaagacacagagagagtaaacacagccgaactcctagatagataaacataaaacctcatgataacttacttcagtttcttttacccaatatataataatctagatttctacaaaaaattacacagcactttaaaaggcaaaaaacacattttgaagaggccaagcaagtacaacaagatgaagatatgacagtgattttggaattaacaggctggaaatttaaaataatgattattatgctaagggatctaatagaaaaagtggacaacatgcaagaagagatgggaaatatcagcagagagactgaaactctaagaaagagaaagaaagaaatgctagga

SEQ ID NO: 17838 - DNA, 14867 bp, Homo sapiens
ggcctcccaaagtgctgggattacaggtgggagccaccgcgcccagcccgttcttgatttttaaaaaattctattatggatacttcgttaacatgataaaatgtatttagctcaaccgtaaagctcatactcaatggggaaatagtaaaggagtcctattaaaaccaggacaaaacaatgctatccattatcatcacttttattgaatattgttctagaaaaactactaaatggagttagacaatagaaaaaaaaattccagaggaataaactttgaaaaagaggaattaaattattagtagcaaatattaagattttgtacctagaaaatgcaagaaatcaactaagaactgttaggtacaataagaagttccagtaaagtcttctatgcaccaattttgaactcactttactggaatgtcttattgtttgtaagaagtttgaagaggacttctatgtaccaattggtaccacagcctgaaatcttcaggctgggcacagtggctcatgcctgtaatcccagcactttgggaggcctaggcgggtggatcacttgaggtcaggagttcaagaccatgaaaacctgtctctactaaaaataaaaaatagccaggtgtggtggtgtgtgccagtaatcccagctactcagaggctgaggcaggagaatcacttgaacctgggaggtggaggtggcagtgagcagagatcgtgccactacactccagcctgggcgacagagcgactctgtctcaaaaaaagaaaaagaaaaagaaatcaagtctttaatgacacaaataacacttaagcagtgtgatggtataaaaaaatcccatcttcaatacaaatgaaaagcaaactacccaggagttgatttaacaagttatttataagatgttttaacaagttatgtgtaagacataagacaaaccatgaggaaaggcaaactgtgttcttagatgagaaaatgccagtgcttcctaatctgtgaatttaacataattcaataaaaacattagagtatgacaaaaaaaaacagcataaacaaagtataaaacacaaattatacatgggagaaatatttgcaatgcatataacagagaaaaggctaatgtccctgatatataaagtgtctacatatcaataagaaaaaacaactcagtagaaaattgacacaaggtatgaacaaacagttctcaaaaacagaaatataagctgagcatgatggcacacacctatgttcccggcttctccagaggttgagacaggagaattacttgcacccaggagttcgagaccagtctgggcaacacggcaagacttcctctttacaaagcataaaaaattttggctgggcacggtggctcatgcctgtaatcccagcactttgaaggggcggagatgggcagatcatctgaggtcaggagttcgaggccagcctggccaacctggtgaaaccccatttctactaaaaatacaaaaattagccgggcgtggtggtgggcacctgtaatcccagctacttgggaggctaagacagcagaacctcttgaaccctggaggaggaaaatctcttgaacctgggaggtggaggttgcagtgagccgagatcctgccactgcactccagcctaggcaacacagtgagactctatctcaaaataataataataataattcagctgggtgtggtggtgcacatctgtggttccagttactcgggagactgaggcgggaggatcctttgagcccaagaggttgaggctgcaatgagctgagatggcaccactgcactccaggctgagcaacagagtgagaccttgtctcaaaaaataaataaataaaaataaaataaaaatgtgcagatgaggaacaaaaagagactgacattcttccatattccctttcctatcttttgaaagttgtgctatttgtattaattacaaacaaaaacaaaaacaaggccgggcgcggtggctcaagcctgtaatcccagcactttgggagggggagacgtgcggatcacgaggtcaggagatccagaccatcctggctaacatggtgaaaccccgtctctactaaaaatacaaaaaaattagccgggcgcggtggcgggtgcctgtagtcccagctactcgggaggctgaggcaggagaatggcgtgaacccggaaggcggagcttgcagtgagccgagattgtgccactgcactccagcctgggcgacagagcgagactccatctcaagaaaaaaaacaaaaaacaaaacaaaacaaaaccaaaaaaattcagtttcaacaccagaggacaaaaaagaaaaaggaaacaaaataaaaagaaaaaaagaaaagaaaaaagaaaaaaaagaaacaatgttaacacacaatttaaaaaatttaaacatttaaaaaattactaacagtataagagactcctactatttattggtcacctagtgtgtaccaagagggtgtgctaggcaccctgtagacatctcaattaatacaaacactgcaagaaaaatacattattcccattttataggtggaaacgtattgtattgaagaatgtggaaaacctgccagtggctgggtgtggtagctcacacctgtaatcctagcactttgggaagccaaggcaggagaatggcttgaagccaagagttcaagaccaacttggccaacatagtgagacccccgtctcagaaaaaaaaatttaaaaatatgacagggcgcggtggctcatgcttgcaatcccagaagtttgggaggccgaggtgggcagatcacctgaggtcaggagtttgggaccagactggccaacatggtgaaacccccgtctctactaaaaatacaaaaaaattagccaggcatggtggcgggtgcctgtaatcccagctactcgggaggctgaggcaggagaatctcttgaacccaggaggcggaggttgcagtaagccaagatcacaccattgcactccaggctgggcaacaagagcgaaactccatctcaaaaaataaataaataaataaataagaataatattaaaaaattaatttgaaaaagtaaaagaaaacctgccagaggccacacagctagtaaatgtgagtggcatagcaaggtttgaactcactcttgccaagaagggtgtcatgttggacccccaagcaggcaagctgggagggcaccaccttggagagaccaaagaaaagacccagagacagcaggcaagacatgagctttattcaagggacttacgcacagggggaagtccaggagcggcaggctggacaggagcaaccgctgccatttgtgaaaagtgtgcaggtcatgtagaaaccttcacattgcaacatttgtttgtttggttggctttttttgagacagggtctcactctgtcgcccaggctggagcgcagtggtgcaatctcggctcactgcaacctctgcctcacaggttcaagcgcatctcctgtctcagcctcctgactagctgggactacaggcgtctgccaccaagcccaggtaatttttgtatttttagtagagtcgaggttttgccatgttggccaggctaggctccaattcctgacctcaagtgatccgcccaccttggcctcccagagtgctgggattataggcgtgagccaccacgcccagcccaaaaccacattgcaacttccatctagcaacctctacttagcagcctccacctacctcaaaacaatggacctctgttccttgtacagcctgtgttccaagtaacaggccaggggcctgacattcttcatagttaaacataattaaacatccaggttggccgttcccacggtccatagcctggaacactgaacaaacatcaccaagggacaaagggtccttcccaggccatgcttgagttgttgctgtctggcaagatgtgcccaccacacaaaggtgctggatgaactgaaacgggtccctattcctggtttgtttcccaccctcctcagcccagacagagccccagggaaggacccctgatgatgccagagtctgagctactttgggagaacaggaagtgcccacacagggggtgcctggaaccaccaaggagccacatgggcccccaggcctggggtcagggaggttgatggtgtgggttggggcagcccaggacacctggactggccttggggcatttcctgagcactctcagaagtatctgcccctgcccaggaagggggcaaaagccaccctggagaccctagatgctgggctctgacttagaagccactccactcctggactcttagctttgctgacgtcagagcccaggcctgagtccagctcatccccatccatggaggccccaggatgacctctgacccccatgttttcccatggctctcacttggcaacctggcctctggttggggtcacatcctggcccaccaggggcaggagggtgttcgagggcaaagggccccactcctcatccaccctcctacctgggccccctccccctctccccagcatggccagaccactgccctccagtgcccttagctctgggccgagggccaggtccaaatgtgctctgagtcagggtagggatcactcattcccttgccccgctctcctcccttagatagaagatctggttctggggccactttaccatctcaagcccaatctgggcagacccaggtggggatggttggggaagccaggctccgtcttctgcatgacaaagggtggggctgccctccctcctggcaacacttcagaccattgtaaacagtctcccaatccacatttgttttatttttcgttgtcagatctagcaaataaaaatataggactctggtgaaatttgaatgtcaggtagacaatgaataatttttttggtataattatgtcccaaatagtgccttgtattttatctggtagccctacccctggctgatcacccaaatgttttatttccccagcaaaactcttcaaccagcttacaaatccacattcaggataggggtcctctgtcttgggggattgtccccctgccccagcctagacctgatcacctggattgagaccacctggctccctttagggcatagatcaaaactaggctgtaaataatttgagtgtgccaagaactttgtgaattgcaagacctgactttatatggacattgatcattaactttgtgagcttcgggaagttgacacctctgagcctcggttttttttcagctcaaaaattgggagaggttgccgtgagccgagactgcgccattgtactccagcctgggcaacaagaatgaaactctgtctcaaaagaaaaaaaaattgggggagaaggtagcctggatattcctttcaactctaaactctaattctgtgaacagcagggatgagggagaggatgaggctccttccttattggacaaaaccccgttggaactaaatgctcctaggctcccttgcctaggaaggtccccccagaacagtgggaaatctggtttcacaactggggaccaccagctcaggatctcatgaggccccgggaccctctgagcacgggcccggatgctcatccctgcagactggattggcccttagagccctggcgttgcctgagccattctggttcctgtcagttgtttggttgcagcaaggaacaagactctaggtccacttaccagcagctgggggaactgagcctcttgcagagaacgagagccccacctctactctaggaaatgagctttttaatttaactggtcaggcctcaacccacattaggggttcatgaccattgtatagacagctgtagccagctgttcacagcccagacagacttgccctatctagacagccccctcctcccagctcagggactcgtctggctgtgagcttccaggaggtctcaggggtgtgacctccctccctccttccctccccactccctacctcctccctccaccccaggctataaagctgcccaggcttggctctcagcacatccagctgcctgagaccctcctgcagccttctcaagggacagccccactctgcctcttgctcctccarggcagcaccatgcagcccctgtggctctgctgggcactctgggtgttgcccctggccagccccggggccgccctgaccggggagcagctcctgggcagcctgctgcrgcagctgcagctcaaagaggtgcccaccctggacagggccgacatggaggagctggtcatccccacccacrtgagggcccagtacrtggccctgctgcagcgcagccacggggaccgctcccgcggaaagaggttcagccagagcttccgaggtgaggccctccctccctgctgcccctggtcccatggggcaggtcagatgtgcccactccggtggtgtcaaagggctcctggccttgcagaggtctgtgggaggctgagtgagggccacggtctaaggggcagtgaggtggggccgggcctgtgaggatggcggggcctcagcatgcagcggtgcatgcagtcaggactccgggggtctgttttcgtactgccactctggtctgagttctacttggagcatattgctttaaaatcatctcacaaccatttgctcacatggaactggggtataactatgtcttgcccatcttccagcattgtgaacatcaaaatgagtcattgtaaatagaagcgtgtttgggtaactgaaaaatactgcacttgagtagacaacctgggttatacctggctgtcaggggtgcagcgggcctgaatcctcctgcagccggcctgaatcctcctgcagcctctcgcctccctagctcctcagtgcccagagctagacccaatgccaggcacctgggtgaggattctgctcccagcatctcagctgaggcaaacttgctagccagggtcccacaggcgcccctgcctgctggatggaaattgttactaaacaaggcccagatccaaggaagatttgtaaactgggtttgccccagaaatagaacagggccggtgtctcctggcctggctgccagctcagtggccctgccatcctcagagctcccctggagtcgggggaggccctgctgaccctgctcttgtccccagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggtgggggtcgcgggggcgcgcagggtagggggagggcgctgctaggcccggcttgggggcggggacgcggggggcggtgcggggtcctcggggcccgtcccagtccccgccctcaagcggcgctgggtctctgtgtcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatgggtaggtgctgagggtcaaactggtaagccggaataaagagacaggcaattacatttattttgaaatggacaacttttcagagtgctgtgggaatgaatgagacaatgtatacarttcttcctctgactcttaggagatcctcagtaaatatcggttattaattttcaagttatttctagctgtccatcctatatcacaaacatccagctttttgaagttgagaggtggatcataaatctccatcccagacgccctctgacctcagccctcccagctgaccgctgaccctgctctctttgcccacacagagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccrgcagcccccggaggccctggccttcaagtggccgtttctggggcctcgacagtgcatcgcctcggagactgmctcgctgcccatgatcgtcagcatcaaggagggaggcaggaccaggccccaggtggtcagcctgcccaacatgagggtgcagaagtgcagctgtgcctcggatggtgcgctcgtgccaaggaggctscagccataggcgcctagtgtagccatcgagggacttgacttgtgtgtgtttctgaagtgttckagggtaccaggagagctggcgatgactgaactgctratggacaaatgctctrtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctataattttgtaattttctattttattttaattaattaattatttttgagacagagtctcactctgtcacccaggcgggagtgcagtggcccaatctcggctcactgcagcctctgccttccaggttcaagcgattctcatgcctcagcatcttgagtaactgggattacaggcatgtaccaccacgccaagctaattttttgtatttttattattattattattgagacagctctgtcgcccaggctggagtacagatggcgctatgttggctcactgcaagctctgcctcccgggttcacaccattctcctgcctcagcctcccgagtagctgggactacaggtgcctgccaccatgcctggctaattttttgtattttttagtagagacagggtttcactgtgttaaccaggatggtctcaacctcctgacctcgtgatccgcctgcctcggcctcccaaagtgctgggattacaggcgtgagccactgcacctggcctaattttttgtatttttagtagagatggggttttgccatgttgcccaggctggtctggaactcctgacctcaagtcattcggcagcctcagtctcccaaagggctgggattacaggcacaagccactgtgcccggctgtaattttccattttaatcaaagctctgcaaattgaggaaggagcagaaagttctacagcgattaggtcaacctgattgtaaaactaaggaaggagcttgagttggccaagacttggtaaagatcttggttaggtaatacatgaaactaggattaaaatgctttcagggccagcacgatggctcacttctgtaatcccagcactttgggaggccgaggtgggcggatcacttgaggccaggagttcaagaccagcctggccaacatggtgagagtgcatttctactaaaaatacaaaaattagctgggcatggtggtgtgcgcctgtaattccagccactcgggaggctgaggcatgagaatcgcttaaacccaagaggcggaggttgcagtaagctgagatcacactactgcactccagcctgggcaatagagtgagattctgtctcaaaaataaaataaataaaaataaaatgcattctgattctagaatctatggtacctgccctcccagaattgatacagaaatttctttttttttttttttgagacggagtcgcccaggctggagtacagtggcaggagtgcagtggcgcgatctccgcttactgcaagctccgcctcatgggttcacgccattctcctgccttagcctcccgagtagctgggactacaggtgcccgccaccacgcccggctaatttttttgtatttttagtagagatggggtttcaccatgttagccaggatggtctctatctcctgaccttgtgatccgcccacctcggcctcccaaagtgctgggattacaggcatgagccaccgcgcccggccaatactgaaatttttttgttcttgacactttgactttcctgggcatagtgactgggctttattccaatcctacttgcatcaaaataaaatctgtgatcaaaattatcatctatacttagagaagaaaataaagcttcagaggatctggaatttatagctgtaagagctgtgcagctgggcgcggtggctcacgtctataatcctgaggatcacctgaggttgggagtttgagaccagcctgaccaacatagagaaaccccgtctctactaaaagtacaaaattagccgggtgtggtggcacatgcctataatcccagctacttgggaggctgaggcaggagaatcgcttgaagccaggaggtggaggttgcagtgagctgagatcacaccactgtactacagcctgggcgacagagtgagactgtgtctcaataagtaaataattaattaaaaattaaaaaataaaatagtgattttacaagcacttcacacaactgacataacaaaggctgtggctatctcaactcacatatcgatccatcaaggccttctcttgattttgaaataaccttaacctactcaagaacaaatttagaaatcctttctctctctgaaatctttgtcagtggctccagcattctaattaccaagaccggaaccttgcacttgcctggacccatggcacagaccagacaggtgggggcaccattcattgaggaaggaaggaggacaggcaggtgcgggagtggggagtggaagaaagattggacagggacagtctaaggagccaacggggagtccaggggccacacccaggactctgcagaccgtcagatgtggaggtaagagagcagggaggggggatggccaggcgcagctatggagggacaagggcagagatgatactggcggggggcatagaggaaaaaccctggaaaataactagtggctagagctttggggagagaaggggaaagacagatgggacagaaaagaactgagagaggcaggaagagaccctccccaccccactcctggacagccacagactggcgctagaatcagggacagggaggtaaggaggaatttttttttttttttttttttttttgagacagagtttcgctcttgttgcccaggctggagttcaatggtgaaatctcagctcaccgcaacctccgcctcccaggttcaagcgattctcctgcctcagactccctagtagctgggattacaggcatgtgccaccacacccggctaattttgtatttttagtagagacggggtttctccatgcgggtcaggctggtctcgaactccagacctaaggtgatccgcccacctcggcctcccaaagtgctggtattacaggcatgagccaccgcgcccggccataaggaggatatttttatgccgttacagaaaaagatgaaagctcagaaatggaagggaggtcggagaacctgcaaaggcatgcatgtggggtgaggactgctcagagctcagagaggggtgctggaagggacctgagaggaagctttggtccaaccactcatttcacagatagggaaacaggggcctgcggacgggttggtttgctccttgattcccagggcgcgcggtcctccccgaacccagcctcgcttcccgcgcagcgcccagcagtccctggcgcggcgggccggccctgccctcgcgagcttgcggtccggttgtggaggccaccggctccctggaaacatttggctcccggccgggaggcatgccgcgctctcggacctgggctggagtaggtgcccttggcggccctggctcgagcagtaatggactagccccagggggcgttggaaatgctgcgacccgcccccacatttttgcccgaacggagaccctccgggctttcacggtccggccttctacagcggcgggggagccgtggcctcttgcagggcgctccgcgcggttcccgactacccggagccgaggtgcgggctgaatcctgctgagctccccatgctaccacccccgcaaccccactctcccggggcgggtctaagagctcttcggggaaattcaaagcactacagggaccaacgtttgcagatgctctccctgcgccgcgaccaccctgtgcttggcccagttctcccggaggcgtccagagactgggctcgtgccgggggacggaagagggtgcgccccggcggatcccttcttggagcctggacgtgagctggccggtccggggcttgcagacctccgggaggagctgcggggctgagcggcgaccaggaggccaggccggggcagaggaccgccgagggccaccgcgggaggcgcagtcagctgcgtacaggcttgcgccgccgcgggccaagactccaaattgggaaaggggtggccgcagctctgcgcatgtgcaggaggcgccggagtttcactttgtaacttttaagtggtcggaacacgccccgcgctgctgggtcccgccagacacgccgccgccgcaggtacaggggacagggggcgtgaggaggggcaatgcaccctccgcctttcccgggacgtgcgcgccaggtgtccggttccggaacggctcccagcctacgcagaccccagagcccccgaccccaagcagggggtgacgacgcgggattgggtgggaggagagggtccgggcagcgcctccattccagccctgcgctccttgggaattcctggcggcttttcaggactttcctctccggcttttcgctttcagggctggtatctccttcttccccacccctctctttgggatttgtcggcggagtccgacctcccacctaactaggagtgcagctatgggctcctcggaccctatacgaggccgggctgggaaagggccaagcgtccgactctcctgacgccaggaaggcagaggccacccctcgggctgttcctgggtgaccacttcctgcagccttggcggagtcctgaggagggaggctggggactcggggactggggggaagggcgggggcggaaagggtgaggcgagctctgctaagaaaccaaatccgcaaaggttccagcacctgataagactagctacctgaggccctggaggggccttggtcattcagccccaggcaggtggtgtcctcttcaagggcaggggtggacagcgtggcggacccactgaccctcccttgacacctctcaggtcatcctcaagtctgctgtgccttcaagggggatatgaacggaagccgaggctccttttcccttcacacgcccctctcctttgtttagtgtgggggcaaaggtctctcctagctgttcgttgggctctaacagagaagacgtcaggtgggatcctgcccttgtgtttcccattagctggaggggcgacttaaaataaaggcagacagcttctaattgcttgctagggccgggtcctgggctaagtgctttacaggtgttgtttgggatctgtgcctcccaacagctccgtgagagaaagtcatcactcgcatttcctggcgaaggaagccaaggcacagagtggttaggctgcttgtctgaactgcgtggtgctgagaccttaactccagagcctgctcacataatccctgagccacactgcctctggtttcagccaggggctgtgtcatttcctttgtgctccagggtagaggtaaacagttgtccaggttactgggtcctgtttggtgttgccataaggagaagtttgtactttactttgcaaccttattctgcatctgaaagaccagagttagctcctgaggcagaaggcctggagctgcttgtagtttcgctattgtcatcacaggattgaaagatttggtgatgataaaattaccctgaatttgtacgggccttcttgcaagaacgaacaatatccatatacttcctgcaacattctgctggtatttctagagcttgtcaagttgaccaccaggccagtccttgctgccaatggagactggcagtggattagcataggtagtttactttggcaaatttagaccagctgttggatttagccctctcccactggccacaatcagacgcttgcctgcacatgggttgaactttgggttgggagcgtgaagtcacctgctgcccactctggctcttgggcctcagcagtaattcttggctttcctaccctcggcatattgagtaggaataaggggatgaatggagaatttctggaaggcacaggtaagtgctaggcattcacatacatctaggatgactgaatattgccaggggttctcagccaggcagtgccacttcaaccacagtgcctagctgctggtttggcctcctctatacagctgccagctgggtgctcccctccccctgccttctcctcagcctggcagcactgtcccatggtgtctgtgttcccagctgcctgctcagagcgtgcctgtttgtgaaaatgcagaggagctgtcccatggagagccagagggacggagctgtttcagggggatctggactttatgtgtctaatgggcag

SEQ ID NO: 17839 - DNA, 398287 bp, Homo sapiens
  misc_feature (1)...(398287): n = A,T,C or G, or insertion/deletion polymorphism (see Tables 1-2)
tttttattttaatctaacctacatggcagtttccttttttttcaaagtgtaaatcctgccaagaactattcaatatcaattgcatatttgatttttacaaatttcataggtaatcttacaagatagtactgtctactggaagcatgttgtgttatttttattgatcccttggtcagttctgaattatatagtcgttttatttcttagactttacaacccaaatatatggttagaatcttttagagaagtcatattctccatacttgggaacaatttcatttaaagcaaaataaaatcattgtaatatgcaataatcttgtgatttgaaaatcccacagaagagatcagaacagttttaatgaggtgataatgatgtacaaatattttggaaactgagcctttctctaaatatggatgtttctaggtcagtagtcatccaagagtatctcagtgtcaattttaagcttagtgttagatttttggaaaataaagctacatcgcataataaacgactatttatttatgcatctaaatgcttcacttggccttggtccaactctcctttgggtaagcatgtggtagtctatcatttggtatgttgctggccttgcttaatttttgaggctcttgagatgagttcaaaaagcaataacaaaatatgtacgctttgcataaattacattatagtacactgcactcacagacatgtaatttattataagaaaatgattccagctacacaaaataatgtcagactagatcgttagattctagaacaaagtgtaatttaaaaaaatccatagactttggtttctttccctttaaagctacaacaggccaactttgcattcctcataaaaatgatatctcgtttttctttaaaaaaatgatacatttaagcttcttttacaattttaattcatatcaattccatttcatttcacattaatatgtttatttctatttttggtatcatcagatatgaatttcatgtcctttgaggacgcagctaggtattgcttttaactgtccacatgctgtttctgtattcacaaaataaatatttagattagcttttatggtttttggtcaaaattcaatattgaaagtaaaagcatcttgtcattttgcatatacacatataaccttggtgtccatagctttcctttaaaagtaacttggtataaggaaacaaacacttggcttgtagtccagagaattatcagaggcaaaggctgaagacctcgatgtgcagtccgggttatcccacggaatctggatctaattgatgcccaaactgacatcttgacctctctgtgaaatatccatgttcaccaaataattgttaacccatcattgtgtctgggattgctgtgctcagagaattccatgccaaagagcaacttaaatgtaacagtgttttgttcaattaaaaaaagtaataacaggattcagatacaagattttccagactgtttatttcatcttgtctatatatatttttagaaatctaaaatgttacaatttgtttgaaaattttttcttctaataatgccaaaaagcctttctaaagtatgtgatccatccatgcatttagaatctaataaaaaaatactagttaagtgattataacttcgtagtatcatttacttaaggagagtctaagacatgcaacatttccagatgtaatcacgatgttgagtaccgtccagggacaagaatgagaatgctaccagctcaagatctgccttctgatggatggggataagcacttgttcattattgatccaactgagaaatttaatggtgtgcaaacaatgtaagggattgtgatacattttcaaactttatttgaaacaatgcgttaaagtaatggtaataaattactatgctggatgaacatggattatggctgtttaagaacctatgaaaaatgtactagtaacttcagagcaaatttatcattgaattatttccaaaagctgatgactgcatacacaaattaaatattacgatgttcttaaaatgcattctgttataatgtaaattttgtataaaatgggactattgtggacctcaccaagaaggtttattactagaactagattgaaaatggaaataaagtcacagaaatctcctgtttaattgtagacaaacatggatgcttatttatttactttaatagttaattcaccaaggctaatgctatggaatagagctacttcaaaataatatggaacagagcctacttcgaaataatagattatgaataaattattctgaagtaagatcagcaacatgccaatttgagttcaggtgcaacttgtaggtggaggatttgcagacagaaaaccacaactagagtcctgctagaggggctaatctgttgaaagaaaaatgagcttctgtagaaacaaataaatgcctcatacttgtctttaaaagtgtaacatgcaccactacaaaactgaaaactaatggttatagcagctgttgtttcaacctcagaagctgtgacagcaatgaaaacattataccaatgtctggtccaataaaactcttggtttcctgtgttttgtgtgggtggacaaagtaataatagcaaagaaagagaagttgtatcactttagcctaaacacactgtgtaaatttgttgttgtttatttgtagagataagatattagtaacttaaaaatgacctaaaggaatcccgaagagttctacagttcattactcatggcaagtaaaactaaatactcaaccttatgaacttttaaagctgaaaatccaagatacttgtagaatgggaaatggacagagatgatggtttaaattttcagtggcatgtccaagccatgagtgtaggtagaaagccatgctgaatcattatcaatttattggggtagaaatgacacctttaatgttaattttatagctaacatcacaaaataagactgatcatagatatctttgaatctgaatgtgagcctgaggactattttagagaagtatattctacctctatgatggagtttgtgtgaaatattataagactcaaaagtaaacttaaacttttatcctcaaatacagatatttattttaaagagacctttaagaaaattgaatatcaacattcaagactgaagtcaacaaagcattctgtgatacttacaaatgtgaaataagtagttataattaaacttttaattaaaaagctgcctcgtcactatcaaaacattatgcatatcggtaagaaaacagtggtatgaataacatgtccttttacgctacaattatgtgtaaaattacctactgaaattgctctcccattactttgccttctccataaagaagttaagtctagagaccttttagtttgttctggtcttttctctcccttcaggaacttccattagtacacaaccagctaggtatcttcctgttagaaatgaaagtgtgatgggcagtctttagtaccagcttagccagttttccctagtcttaaaatttgattcaggcttagtttgggcttaatttcacagctgcacccaatgattcacatacacacatgaataacttaattctttgaatagttcttagaatgtccatcacgaaaacttaaaaatacattgagaaaacccctaaaacaatatagaatatactttgtactttttgtttatcctctaaccttgtgaccacatggttaatactaatcatggtattattggttgcaaaggaaatgaaaataacagcccacaatattctatataatttatgaaaggttaaggtatcatatatgaaaactgagaactcccccaccccaaacacattttggattttttgcatgtcagtaatgaagttcacttttcaccacctttccagttggaacatataaaatgtatgacctctaatgcctaatacattaatgatctattgaactaagttaacccttataaagttcatagaagtgaaaatgtggtctagaacaacactgtttgatagaactttctgtgatggaaatgttgcgtatctacactgtgcaacagagtggccactaggcacatgtagccatcaagcctttcaaatgcggcttgtgtgactaaggaactgaattttaaattgtatttaattttaattaaagttaaatagccgcatgtattggattagcagtctaatagacccttcaaacattcaagtaagtgttggaaatggaaggtccattataggaaatctaggaatcttaaattctcaccatcgggtttaaaactctatcattccttcagtatgaacttttccagaagtttcagattttcaaaagataaaactcaaaccaaccaaatcctttagggtgcttttctgtatgaatcatctttctgcaaagaggtgtaagactgtctttattgccaactctgccccctcttctacagacagaactcagtgattagattctgcatttatttaggttattcgcctaaaaaacctggtttccatactgcaaataaatgacaggaacttttccactagattatcccagacagcacaaatgttctttccaaaagtggagcctggaaccacagccccctcacattgcctgttacatctgtttatgcttatagaagtgacatccacttcgtagacagagaatgccaatttcttgggaaaggacccagaatttggtgatgcttaaaggaaaaaaaagcccttgctgcttaaaattaaaaaatacatagaactgagtattgagtagttacaaaatccttctgaaatgaaaagattttgctcccagagtatatagaatttgtgtacggacttgcctgggttcatattcagccataatcatttactattaatagccaataaagaagcgggtaagttacaaaacctaaaccttagtttttccatcagtgaaatggggctaaaaatagttatgttgggaaaacttgtgaaagactttgaaatgagcaaaagattactgtttgtcctttcaatggaatgctggatgttatctacaggactccggagtgttgtgaaatttacagtcgtctgcaccttacttagactgactttcactaggctattttactactcagtaagctgtagaaacgtttggtaatgtaaatgagttttatctacagaatgcaaatttgttactttacagatacaactggttaccgccctgtaaagcagataataataaacattacatttcagtgctctatagaatagtaagcagatttgcctcttcttgcctctatgtctactcttcacagtctcacgtgaatgggttgcagtatcttgctggggttcccttcctaattaaaagagttataaaaattttgaccaatgttcattttatatttctaccattgtcatgtttttaccttcttgaaaaattattttttaagagttcctgctccctaggctttttggaaggattggtttaaacatctgtattgacagtcatgatcagttttatatcttgcaggaaggtggtaacacttccggtacttgggggtgtaagagggagtactgagcctttagaaaagggcggggttcgggggggagtgagctgaaaaactctccctagacaggaaaggtagaagacctcctcatccctttctctttggcagtgagatcttaaggtcaaggtgagtagtaggccaggcgcagtggcttaggtgaaggccacaccagacttgggcctacgtcttggccttccaggtcagcagagtggcctgggacttggatgccttggggtcacggagttaactgcagactcagactaagtggggccccagcagcggtcagccccagaaccaagttccggagccaacacccgaacaggaaggggccttgccccaggccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaatcccatcagccgaggtgaggcacctgttaccccggccttcctcacccccgcggcctctcctccattacaccgcggccgccgaaacggcccggcgtggcgaccgcacgtgggccaaaccccttccccggccggcacccctggccccaggccggcccgagcgtgcgggcgcgtcgctgctcgggccgccgcccgcccgcaatggcgttggggagcgcagcgcgcctcccggggccgcccgccgcgggcagggagcgcctgggggccgacgcgcgagtggaagcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcgggtaagggggaggctgagcgcggggcgaggagttggggagggtggagaggaggaaaaaatcggcttgtacaaaggctgagttgcaggctgggggtgggggtgggttgtggtggaggagcaataggttgaagatcggaggcattatcagtgggatctattgtttcctggcacattgggaggaaaaacaaagggatttattttcattaccctgtaattttttttcttttctatttttttaaatgtggccagggagctcgtctctctccgtgtcacagtgggatccgcctggcagccgccgggagctgcagccaatgtgttaggacttcaggtgcttcttggcacaaagctagactgcgacctcctaccatagcgcttggcgtcacctgctctcccggtcctgccccagggccgagggattgcgtcccgaaccgggcttgggaatcggctgcctctcaagttggtgttatttatgtttgtcttttgtgagggcaggttttgaatcccccggcggccccatctcccccgcccccgcctccttgggttggaattggcgggggagggaatggggggtgtgtgtaggggagaggggagggtgtttgtggctttaaaaagaatggtcagggtaaaaggagattgtcgatgctttacaaaaaamgaaaaaaacaggcaccacactccaaagcctttcttgtttgtctgcatgggccatgcatgcgtgctgggccaggagccgagtttggagacggtttaagtgaaagtgtgtgcctcctcagctgattgtgcgtgagggtgatgtggctcggtctaatatcaaaacaaaacaaaaataaaatgaaaaatctttagaactgcctgcattgtctgctcctcagcatatcttgaagtatttgattgctggcttattgatataaaatcctgctgtgggcttaaagagaccagcaagcatgcattgcgttgcgtgttgaactgtagtaagttagaggcaagaaagaataaacaaatcagggctgtgaaaaggggtgtcacagtatatttgctttctgattgtcacattcttacgcatttattcccttggtagtctgcatcccactccataattaataataaccactgttaggaaacttccaaatacttgttataactgaacttagtgaaacttattgctattcaggaactttttttctccttgttttgatctgaaattgcattagtattgctttggggatgctgtagatgagaacattggaccaaaaaaagtaaaatatgccgctgtaggcatgttttggagtttgtaaacatagattccaaacttaattgtacttagaaagaataagttctacctaattgtggagaatcctaaatgaagttgattttctggacagtttgatgatttcttaaagatcgatgaactgctggtttctttttaaagggcattcacaaaagygaccaaaacttgggctaaagtattgctttcaaatatacttakgtgtagcttgtatttgtgagtgtgtgtatgtgtttgtgtgtgtgtgagattttgataggtatctccaaattgtgtttggaacttttttttttttttttttaccaaagaccaatcagaatgataacttyttgacttttaacttcccatttcaatgagtartctcttctgtttgccacgtggctaagccatttggaaaaaaaaatgtatgttatttgactagacataaattcaaataagtaaatgaattcagaaattcattcttttctattgcagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaaccyaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagaraaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcartgccaaagtccgaaatcccttcaccacaaagccaactgttagaagatgctgaagctaatttggttggaagggaggcagcaaagcaacagaggaaagaacttgcaggtggtratttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggtaagtgtgttttctccattttgttttctaaatttgtttttagtactagggcctaattgtatgtagaatagacttgacaactagtaggagtttttgtaagggattcaagattgttgatacctttaaaatcacctgttgtcaggtgattttaaaagttcagagtttgagagatatcaattacatttcttaaatgtgctttataatggcatacatcaatagtgagtaatattaaagctgaagaagttcgggaattgtgagatacgttccaatgaactggagtatgagtattgtgagtactgaaaaccaggagtgttagtttgaaatgtaattactttagttttacctaaaattattcataaataatattttctgaatgtacacactttaaggtatgaagtataatgtacaatgggagagttttggtaatctgggaataatattcgatttactttcttaaaaaaatctgagttattaagtgtaagtggattgtgaggaattttgttggaactttttttggggggtactgctagttggtggtgaaaatttaatttatggaaatatattagctgacttaaatactttgaaaagctttgactgtaaacagtctgagttcaaaatttgttacatagctttaaaatgaattttttgaaagaaataacattgatttgccattcatggatttatttttacctcttaaaaactggataaatgccaatggaattcacatgctctaatgacttcacttagttaacatttggtatggaagaatagcacaaagtacatcagcagtgggtggtagaatgttattagtggataatggcaataggggcaggaggtggttggttgagtaccagaatctcctggggtgctttttcaaagtgtacttgcccacagctcagtcctgagatgctggcatgctctccttggggaatctggaaggttatggtggcagaatgtgtagttttagaccacattctaggggcttctagcttacacagtgtgtatatatgatagacttggaatttgatatattcctgtaaattttctcctcaaaatctaaaatcactgtctgttattttcattttgggaccttccatataaggctctaaaatataaatttacatagaaatatttaaagagaaatctgacattgttctgattatgaaatactattctgaaataaagtaataatctatgaaattatttacagatgttagcaggcagactttcattttattagtgtaaggcagaagttctgggtcagaatgggtcatgttaagttaaactgtagtttaaaataaactacagatgtcaattcagtttgaaagtaagtttctttgcagtgctttaccaccttcctttgtgattatctcctcctgccttcctattcctccccaacccccactgccctactctagatggtctttaaaggtgcctttcccccaagcctatccagtgagctcctaaactttgccattcgcatcccccttgaacatcatctttctaccctttaggaagaaagcaataagattaaatcgtttcacattgagaaaggcaggaataactgaaatgaactcttcaaggagttgttaaacccagtgactaactttttaatacaagggatagcagcttatgaaaatttatcaagtagaccactacccagtcaaccaagtgggacaccagcctgtatttgggtcctgtgctgcacaaaacataactgtgcactagttggtttaatggattttaaaggatttatcattgaaatgtgtctgtttatatgtgaacaaaccagctttttgggaatgatattttgaagttcaactaatttgtgctatgattgcttataacaataagtattttgcctcttaattttcatataatgacaattttatctagcaaataatgaaacattacctacatttaatgcatttcatcaagaataagatttctaaaacaaattagatcaagcataagacttgtgaaacaaagataatgtattgcatttgattgggcagttaacaggacttcttggagtggattaagtttgcaaacagaagattcattcttagccctttgtaatgaataacacaattactctttcttgctgcttccattgttaaatatgcaagtggattcacttggaaaatttgagagctgctttctactggtcatggtrgtggccatagtgtttaggttattctccaattaagattttttttgctgcagagggtggtaataccttattagatccaattaaagtatttattgaaggcttatcatgtgtgttctctcatgctgttagctgaagaagacacaaaaatctgtaaggttacccctttcctctgtgagtttgtagagtcaattcttaaacacattgtatttaaaatccataaaaaacagtataaaaaactatgccaaaatttttaatgtcctgtgagtcctttagtggcacttggttgtactaaatgcatatagtgaaagggatttgatagattatttggaaaggaatacatgcaaccattttctatctgtgtttctttattcttttcataaaactttatttatggaatgggaagttgcaattcctaacctcagtcttttcctttgaagcttaaacatacttcctcttaaagaagcaacagggaatgtattctttaaataaatgatttttagaacttttacattcttttcctggctgtcactttattctgtactaggttaaaaattcctagcacctttagttttttgttatagatcttatttatcatctttgtatgtgtaatattgtcctcagtgactacttcagttctttttatagatgttttacatagatatttccataagatgtcttaaatctggacttagaaaaacatcagaataatagttgatctttcctgtgtagcatataccttgtacttgtacatataccttgatttttaaaaatggtcagactgtattgccagccatcagttagtatgactttcctatctttcacagacagttatttcttattagatagattgttatgtttcatagggtcatgaaatattagaatgggattaataatagcaaattaaaatccaactttgagatatggcatgggagaatgttatggaccatgctaattcgagatggaattatgccttcattttcaggaatttttcaaaatgaaaggattgaattaaagtaaatttgtcttagatgaatcaaaacaagagagggtgacatgtcatttttttctactaattcagaacatttatggagcccctaatatgtgtcagggacaatgcaaatataacaaatacaacaaatacataaaatgaggagctgatgaagtaaggagctgctggtcggtgggacgtgtacagcccattaaggaagctctcaggctgttcccaactctgtgctttgatgatctttctaaggttgctgcagcctcattaaggaagtcacaacctttctctgtttcttatgtcctttggattggtatttttttttcccctcaaatactattgtgttacaatggattgttattcttgaaacagcatatctgaaaaagatttttctaactcacagtaagaaggatattgcagagttaatattgaggtacattgtgctatattttgtgttttctcaaatcatatggagctttacaggattagaattcaaataatcagcaagggcaccagagcttcttcaaaccttacatgatagttgttgaaaatggatcttcttgtattctctccctttttgggggctccgagtcatagttagggcattcatggatatatgaagtttttttgttcaggatggttttcagggaatagttctgttgagatccarctttttgtctttgcggaggcttcctttataacagttttgtcagtgcttcttaaactttaatatgcatatgaatcacttgggagatcttgttagcatcaagattctgattcagtaggtattctatgggaaattaccttgatacaatggttgagctacaagtacaccagcaggcaagctatctcagaggttatggaatagaagactcagaaaacaaattaaaatgcttgaatcacatgatttaccaaaccagttaaacacaaatccagaagcaagaggaaagctatggagtaagttaacacacttcargttcaaaccaggttggaaggaccacgctacctgtcctggataaacaatgttcctatgtcccatctttctttcacataacccttccccattaatgatgtggttatgaggaccagagctgatgtttgagccaagactccatagactaatgatttcctgggtcgatgatacacacttgttctgttgaagagatgtgacaaatacacttaggtacagccgtagctttgctagtttgcctgctgatgagccatgggaccatccttggtgtcttcagtagatgactgatatggaagtaatgtagctatcagtccaggcataatggtgacttggtatttccactgctttttgtctataagtaaatctcattcattttatcataatttctatttattttattgttgtcatgtcttactcccagcttacctatttattacgcatctgctgactgccttcatttcaccagcttgcattctcattatcaatacttggcccagcctgagtgttgcctctgtctcataagttgttagtttatttaccatctatgattatcacttcttaagtgtttcatccatcccattagttttgtttacctctataatagaatttcatattctgaaataatacaggaaaaccacgttaacagtatgtctggaggggaaccttagattttacatttctaacaagctctcaagtggtgccgatgccgctgatcaagagatcactctttggaatatgaatttgaagtacaatcttctggcttctgaaagtggctggccatagcatgttagggaagcaacatgtaataaatttcctttccagatgggctgctatatctggttgggtggaataatattctctgaagatgaaataaggtataatcttgtaaagtgcatgaayactctgtttctggatcccaaagtggattattatccttaactcaaggcatttgggtcattaaaaagtcacatcctaggctctttgtgtggtttaagtttttagttataaaaagttgggaggaagaagtttttaatggaatcagaaatttcatttctttcattcttttgcaagtgtaaattaataaacttagtataagaatggtcatatgatttaacttgcttttcttggataactttgatggtacaactttttttttgtttgttttttgttttttgttttttgagagggagctttgctctgtcacccaggttggagtgcagtggcacgatctcagctcactgaaacctccacctcctgggttcaagagattctcaggcctcagccctctgagtagctgggacaacaggcatgcacaactattccagactaatttttatatttttagtagagacagggtttttaccatgttggccaggctagtctcgaactcctgacctcaagtgatctgaccgcgttggcctcccaaagtgctgagattataggcgtgaaccactgtgcccagccgatggtataacatttaaattggatttccttttaaatttttatgttttatgacctrtgcttcataaccaggtaaatgaaatatgtcaaatattttaatatactttgtaaaatcaaataatgaagatttgttgaatgaaccccttttctaaaatccagaggtatagctatacttttaaactgaacagtgatcatttagtgtttaaaaagggattcttttgacagcagattatttcagatgtttactggtatttatttgtaatagaaatatttaaagtttcttgttttttgttaatttaattaattttttttgagacaakgtcttgctctgtcaccctggctgtagtgcagtgatgcagtcatggctcactgcagccctgacctctggggctcaagtaattctcctgcctcagcctcccatgcagctaggactacaggcaagcgccaccatgcctgttattattttttttttttttgtagagatgaagtctcactatgttgtctaggcttgtcttgaactcctgggttcaagcgaccctcctgccttggcctcccgaagtgctgagattaaaggcatgagccactgtgcccagcagttgcttgctttttggatcatacatactttgtgttccctctaaactttctcacaaatgacactaattgttgggttcatgtacttgaaagataagatgccaaatttggaggaaaatcactttgtgttatgttatccatgtgtcgtttaccttgttaacccagttaatatgcccattacaagtaatttgattgaaatctcatctgcattagatttttttctaacactttctctaccacttgaaaacaagtttaggaattttcatagagaaatatagttagatgtgggataaattctgtataaacaaaacaaacattactatagattgttgctttttatgctgttatctaatttacctgatatttttcttgattttctatgctctcatttggacctattttctttttgttcttttgcttcattatattctatagctatggttttgaaaaggaagaaaacttttcaagttatgctttatagtttttcttctggtcacttttacagttttctcctggttctcatctctttagtttgtgacatagacatttagagatgaaatatacttgaaggtaatctagcgtcatttcccagtcacttcaggaagcccttcagtagcatactcctgacagatgatgtttcagcttctgcttgaataattctaccgatggagrgtttattactttggaaggtaaaaggaaagttagaaggaggggcatgctggtgtgtgtagggaggtggtgcactcactcttctttttatttaattttaatttgcaattttttattaagataaaattcaggtaacaaagttcaccactttgaagtgcacaattcagtggtttttagtatattcacagtgttgtgcagccatcacttttatctgattctagaactttttcatcatcctagaaagagaccctgtgtctgtgaattgtcattcccaattccccttccttcttcatcctctggaaagcagtaattgacttgctttttctgtagacttacttctggacatttcttacaaatgcttttaaaaaagaatataggagacttgaagaagaatataggagtatggcttggaatatattaaatttaagatatcaaaaggatagcacactacaggaaagtctagagagcaatggcataaagaattttcttctggttggtgatatggtctaaaagttaagtggcatgatgtgggagcaacaaatgctatctgccattttatgtgtttcatagagaggaagaacacatgaagctgaggagacagtaggattcaagaagaatgaaatgtataactgaggaagaataggtttatgtggctgagaggatggctgaacaactcccttgcgtgggacaccgcacttctcttaatgtaatctaaaattgctacacatgaagcatgagtgtttgattcagcatagggtttctttatttccttttagagacagggtcttgccctgttgctcaggctggagttcagtggcacgatcaaagctcactgcagccttgaactcctgcgcacaagggatcttcctgccccagcctcccaagtagctgggactacaggtgtgtgccacagtgcctggataattacwttttttttttttttttttgtagattcagggtcttgctatattgtctaggctggtcttgaactcctgggctcaagtgaccctcttgcctcaccctcccaaaatgctgggattgtaggtgtgagccaccatgtcctgccaacatagggtttctttaaaggtacaagtggcattgatgctgagtttcatctttacattggtctttttatagcgtgaaggaatcctgttccttttctaataatctgatgcttatttctatcctacttctcttatattgtcactttccttattcttttactttgattggaattgttcacggacagcttcactactttaaaattttttctcatccttcaatatttcgatatagatttcctgtgcctacatgctattatctgtactgtaaccatctataagatgagtgatttgaagcagatatttatttagtttactatgtattgtctgttggagcatattactatatagtctatattactawtaaatatcattaactagtaataataatggtaacatcgagaggtacttgatattctgtcaggttggacaagtgtgcctcttgaagccttgaatttcttacctgtaattgaggctgtcttacttgtaatttatcactaagattgtttctcggctttaccatcctgtaattctctgtgtcttaaacatatttgtactataccataatcataaatatttgtgctatgatttcaaagagaaaattctggacatcttttgttgaaatatcaaaatgaaaaatttatgttaaattgttcttgagaacaataattctatagattatagtagaaaccttaaaatgagtaaaatattaagtccatgggagcacaattttatagagtggatttttagagcaacttgacttttgaaagtatgggtttaactatatgttaaaacaccctgctgaggaaactaagaataaagaaagaaatgttttgtaatatagttgctgacatattaattgcttcactcacttttgctctggaaatagcttcatagcacagttcaacatgattgaaatattgataatttttttttttttacagttcccggttttcagcctaacttactctttctcatgcacatatccttacaaagaagacagcgaaatacagtatgaagatatcaggaaattttatattttaggaggaaagttttgttctttgcttacttaatctatttcattggtatttttaaaaagtatttgtggagttaaaactgttcaccaagtatttatggataatggtaaatgaaactgctcacagatctgttagtctcctgccctcttttataagtcagatgagttttgtgccggggaaagctaatcttccaagttgttttccatgccagttgaaatatatagggctagattcggacatagagtggttggcaagggtcaaaaaggtgaatagagtcatgaccatgaaggtttctttacaggaataagcagtgagaatcttgcggattaggtctttggtatttctgtcttgatgcctttgaactggcatgaccctatgaaactgagtgacctgcatgttgagtctgttgctgtatagtaagatggtcttttctcttttattcacctcggatttctcctccaaaaatttctttttactcctcctcttttaaaaatatgtaagtatacagcctcatggaggctacattcatatcagaaaattgtctaatcttcaatataacaatcttaaatagtactcacagtcagaggtaccttttcaggcttgtgaagagttttcttttcatggttagggtccacagaggagagggaaaagcaggtttattggttagtttttaagatctgtttttgaggccgggcgcggtggctcacgcctgtaattccaacactttgggaggctgtggcgggcggatcacgaggtcaggaaatcgagaccatcctggcgaacactgtgaaaacccctctctactaaaaatacaaaaaaattagctgggcgtggttgcgggcgcctgtagtcccagctactcgggaggctgaggcaggagaatggcgtgaacccgggaggcggaagttgcagtgagctgagagggcgccactgcactccagcctgggcgacagagctagactccggctcaaaaaaaaaaaaaaagatctgtttttgagtagtgttattttgatggattcctttacgaagtacttgttttgggtaaaattgatgtgcaaaattgttttgtaaaggaagagaaagacataaatttgcacttttcattgttaattgatattatatatgtataaaattattatttttttaaataacccatttctcagggggaaaggcaaaacttattgtaggatgtttgaatgacaccttatctaccattacctagaatgtgtttatttttagaagtttattctgtaggtggaataataaaatacagtaatttaaattatacaccaggtgttatataatattctatgtccagagcatctatttccttttagaaatcttatcattgagcactgagcactaaaacaaacaaacctgtaagtaagtcttttgaaaaataaaggctggctggaagattgaggctgcagtgagctgtgattgagccaccacactccagcctgggcaacagagyaagaccctgtttcaaaaaagaaaaagaagggctgggccygaaatctatgattttcatatctgtattatatacagtttcttgcttagcgtctagaattacctattatttaggatagattcctaaaaawatataattttattaatttataatattatttataattttattaaattatatttaaattaattaaaaataaaattattttaaagccctttatatataattcagaaagggtgaattatattgttattgccggaattgttattcagaaagggtgtattagtttataatcagcactgcattggaatagttttctcacaatccctgcgccagtacttagttttatttatatgctttgtagttttcagtttggtaggtgaaaataactgttataatttctacttgatatattgttgagattgaagattttttatgtgcttataggcttttttgatatgacttctgagtggtttttattactttctaaatcagtgtttgttagtaaagactacatcaatgtgttatttaaatgagttggtaaaagttaaagcaactcacatatccagtaatagggatatggttaaattcattacgataaatgcatatagtataataggataaagctgtattactcatgttttctaagattacttaaagatgtaaatacttcatagtaaaaagtctggttaaatgctgaatatgcatttctgtcatatttttactttaaaaatatgtgtatttgcacctaggacaaagattaaaaacacatacatcaaaatgtcaactctggtaatttctggattgagagaacagtgataatgttaaatgaatgtatacttttctgaatttacttaattttctacaataagcatgtattacttctttaattacattaaaagatagtggtgggacacaattggaatgatcagcaataacaacataaggaagttaacaaaaacactttttaaaatgctgccccaaattctaataattagtcttttaatgtacttttatttggaggacaacatgtcacagaaaaaaaatttggtttaatagtgtaaatttatgtaacactgaagaaggtgttactttaagaaaatggatgaacttttgacagttgaattcattaagtgcatatttcttaaaccttggtaaaattgatcccacatttgtggctaaccttgtaagtattatggggaaggagaccctccaattcattttaaattgtgattatayrgcatttgcataggcctgagatgttttccttaagttcgactattgtgtatatgatattctaatgtgttacttaaaatatgctttcaaacactgggtataatgaatttgaagtgaaacatattttaatgagtagtcttactaaaaataataaacatgtacttaaaggaaacttaaccattttcccatgtggcataatgtctttctgatgtcttagattattgagcctcaacaggcttgctctctgtgaaggtgagacagtggagatgtcaagttcattatcttgcttatatataatcctttgaaaaaactcatgtacacacccagttaaaaataggattttgagttctaggcctccacagaatccatttgaatatgtttcctgtcctaaaacaccagccaatatgtggtttcctgttgttcctcttaaaaaacatattagttgaaaagagattcatttgatgtatggttagactatatggtagtatgttatatttttagttagagtcaaagggtcagttcctctcatctattgggtaattttccacctttgaaaagctttggtagataatgttgtagtatataaatgatgacaaacatatttttgttgggtggcagagttttctgaaattggaagtttaaattattgctttttgtttaatgagatgagcagattactctgatcttacagttttaagcagttctgggattttataagttctggtgaagtcctaattaaattgccttacaatataatctggtgtttggattatcactttttgttaagtattcttaaaccttactacaatatggttgataaattctgttaatattttattgtatactgggtttctagtagtgatatatagatgattgtatataattataagaactatttaaagaaaaagaggcaacattaacagacaaaccatgtaaaattttgactcttttctataaaatggttacactggaaaaagaaaattggagttcaagaaaaaaataatttcactggttgtgattttgcatatttatgtaaatttgtgaatgatttgaggcagtgatatctttttttagttaatcatgtacccaatcaagtttgagacgaggcttatgtttttccatagagactatgacacttgtggaatttttatcttgctggctccttctctgtataacgagttctgtgagtagtagcattagtgaactggagctccctcaggagattgtcccatttgcagatgtggcaatcagaagagttttagtttgagttactgggttttgactcttattacctaatacaattctttatttatttagttttgagatggagtctaactctgactgcattattagcatttttttgagacggagtcttgctctgttgcccaggctggagtgctgtggtgtgatctcagcttactgcaacttccgtctcccgagttcaagcgattctcccacctcagcctcctgagtagctggaattacaggcacgcaccaccatgcctggcttaatttttctttttttmgtagagacggggtttcaccatgttggccaggctggtctcaaactcctgacctcaggtgatctacccacctcggcctcccaaagtgctgggattacaggagtgtgccactgcgtctggcctaccaaacgaaattcttactcttaatctagaatgagaactattgagagttcatccattagaacccttgaagcctgtccctcagatggttgaaagtctgtagctggaggacggttgaaataaacagaatattgatatgaaatatttctgaaggtatcctttttccatatcctatatttaacttagctggcatattagagttgtccagagaaacagaaccaataggatgtgtatatatacagagaaaaatgtaaggagttggctcacaggattatggagactggcaagtcaaaaagctgcagggtgggttggcaggctagagattcagggaagagctgacattgcagttcaagtataaaagccttttgctggaaaattttttttttgcttgtgggggagtcagtctgttgtcctattcaggccttcaactgtttcaatgaggcccacccacattatggaaagaaatgagctttcctcaaattatatttaaaaacacccccacagaaacatctagaataatgtttgattagatatctgcgcaccatggcccagccaagttgacttataaaattaaccatcacggtcaagctttcttgttttgattgccccttctgaagctgtttcagggaggaaactcatttttccccccacatgtcttagtgggggagttggttcctctctccctctcattcttagaaaatttgctgaagggattccctctgttgggcagtgtgttgtaggagaggattatatgtttggaatcagacagacctgtattcagatcctgcagacacctgatcttttaagaaagtttgtttaaattttgagggcagggaatttgttttatggttgtgtctctaggattgtcacaccgcttggcacattgtaggtacacagttggtgttaataacctgttatgttcatcatctctgccctttctccttcctcttctccccctccccccacctgaaggtccaagttgggatgatattaatattattatttttattatatttcgagacaaggtcttactctgttgcctaggctggagtgcagtgacatgatcacagctcactacagcctcgacctctgggctcaagggattctcctgccttaggctcttgagtagctgggattacaggcgtgcgctgccatgcccagctaattttttttccatttttgtagagacagagtctcactgtgtttctcaggctagtctggaactcctgggctcaagcgatcctcccacctcagcctctaaagtgctgggattacaggtgtgggccactgctgggctaacatttttatatgtataatgcttgtatgatttatttataggtaaaatccttcaggttagcagttacaaatgaaagctgggtgattccattacagattaaaatctttcctggccactgctctggcttgctgaagctgttgtgctctctttcgtttgggaaatctcaatctattgccctgtaaggtaatgacagttcataagtaaccacagtcattaaaatatggttgtttgagatataactatggaagctgaaggggagagtactcattttgccttaactttatatttactttgatcaccaaagcttgtaattagttgcaagaaaatctaaaaattgagattccatcagaaagttgtaaagctacttatttagaggttgcagtaacttgcctcacctttggtaacttgagtatgtgagtgtatctatattctgaaaatgaaagttatcaaaaatttaattaactaaaaaatttgaattatttcttttactatttagtctttttgtcttccttttatttcctgacttgtttactaaaatgtggtttcttttgttttttttcagtggttagagaggaattacttttttggggtcatttctgtccccctactcccttaatattgattttagaaatgtgcttggttttaattccatagctaagttataattttgtaattatttttgtagtcggttgtctcattctctaatcaagcttttgctgactgtgaatttgtttatccagaaaacagtttttcattttcttggtgacttgtaattagtaataaattgcatgggaccaaataatccaaggtcttgaaatcgtattttttgcctggatgtttcctccgtgaattacattatctggaaaatgtctgacagttgttattaagctgaaatatgaaatagctttgcttgttcatgcaaatttgtttatgtagaaacaagtttttcctaggcagaaatagcttttgatagcatcctaaggaagagaatggttaagctgttttctgcattttctttttaaatgtacaataattttttgggggggttatgtatgtttttgcagatacgtaaaaaccatgttttgtaaaatgcattgtagacattgaagtagaagaatcttagtattttcagggcccttgataatatcctctttatttaaaaatgtaactataaaagttattgtttttccatttctaaaatgaatttaataaaagcaccttttagcaggatgttggtaagaatatatgacttaatatgaaggttcattatattatttgaatgaattgagctactatgtcagatgtgattttgttactgctgtttttcatcttgagattaatattataacattttataattactatataggcattagtcaaggctgataaatcgcctattattcaagtgtttataaataagtggttatgctacagctatttagagaagcattgtcttctgagttgattgataaaagtcaacaaacattgaatatgtttaaaatgtgttgatttcgagctctgctgtgtagatattgagataaataagacaaaccttttctccttgagactatagactttgaaggagatagagaagtaaacatttgtaggatagtgtgataagtgctgtgatagaggtatatacatagggtgaccatatataatttattgtccaaactgttgagaaattcagtgttctgattattattactgtctttaaaaataagggcacagaccattgtttagtcctctttggatcatgcaatgtctagggtgaccattgggatttattgtcaaaattgggacactttttgagaatgaaaggggatgttatgaatacttacactggggcagcagacataatctggaactgacccagggaagccagtacacatgtcaactttgatatagcagcttgctgtggtgctcctaagcaggggagtctacctttatcaggaggagaggaatcattagggaggacttctcagaggaagtgatgcttgagttgaagctttaaagatgaataagaattaattaggtagagaagtgaaaaatcctaagctgagggaaaagtgtgtttgagaaaagagtaaaccagaacagttggaggaacatgaagggggtgtgtgtgtgtgtagtgtaagaatgtaggcaggtggtagttcaaggagggacttgtatacataggagttggaaatgaaatgcaaactatggggagtcattgaataatttaaagggatagatgacatcatcactttgctatatatacctctcctatttgttggtggttatggaagggtggagaagatccattggtcccccattttttctctctgttctttcagtaaacatttatcctagaagctttcaaccaacttctgtttattcagctttctggattaactgatgtcttccatttgctggataggacatgctgactgatgacctcacagactgttcttatgccctcactactcacctcaccacctacagtcataggctgactaggagttggttgtgtacattcctaaacctttttgccctctttatttgtctttctaagtgtgtattcagtactatgtaaattgataaaacatgagtgtgaaaatatttttttttgctataaaaatgtaaattgaattctttggggaagagctgataaaatatgtcacttaaagatcttgttaaattagatgagggagatatagatgacagaaactctttcaacaaatatctaaaaagatgtgccactccaattattttgtgagtgtcttcaagtttttgtcccactttaaagaaaaccaaactggccatcatagccaatgaattatgcaggaaagatactgtggatcattaatttgcagacctaagctcaaagtaaaggtgttggcctgatgtcaaaagattggtaaatgaatatacttctaggtgtcttacattaatatagacctattaaaatatacatcagtttttatgatttctaactttaactgccattttcaattatcggacaaattcttagtctaaattgcttcttctaagagagcatctttttgtaaaaagtgtctgctttaagctaggcagtatgctaatcacctgaattacatattagaatacatctcccaaggagcttgaattcgcttgggagagacggacacgtaagtcacaatgtactgagagttgcattgcaatagaggtgtgcacaggatgctgtgagtgcggagaggggacacttgggttctggaggcaagttccaggaaactcctgggagaagccaaactctatctgagtttcgaaggtttaataagtgttggtagaaaaagggacaagtgtgcaacctaacagcgaggcacagaaaagagaaaaaaatgctgtcttttgcagatctcagagtatgatttatttataggcaaaatattgttggtacatggtaaggcatgtaccacaaagtttaatattgttggtacatgttaaggcaagggcagattaagaagcttcctttgtgctagacttagtttgcacacttttctgaaaacatactagttggagggggttttgagcatggaaaggcatttttagatttgtatattagaaaaccactctaatagagagtggagatagatagaaaggctaggtgtggggtgggaatgcagcagtcacagtgaacacggatgagactgatgaatgtttgtcagaatggaggctgaaacaggcaaagggtaaactgggcaagctggattaggcagaagatgataagaggtgctattttgtgtgaaattaacttttaagtgcaaaaatcatatgtgactattttttatttatccatgtatttttcctactctccccacaaaggatcttgcctagtgcttggttgataacagatgctcagcaaatgagagctaatgtaggaattaactagacataaacagggaattgattgtctttgatccaatagttgcaaaatacgagggatgaactcataggggccttagagccaaggctgtggatctgagtgttagatccaggtatatatgtcattgggatactgtgaggagaggaaacatgagaataaggggtaagacagcaggagagtgttgggaggcagcatgatgggggagccccacattttggagaaatagagtttgagaaatagcgcttcagagaaagtttggagaaaaagattagaaagattttaagaagcataaaggttgctaaacattttctttctttttttgagatggagtctcactctgtcaccccagctggagtacagtggtgcaatctgagctcactgcaacctctgcctcccaggttcaagcgattctcctgcctcagcctcccaagtagctggcattacaggtgcccccaaacaatgcctggctaatttttgtatttttagtagagacggcgtttcactgtgttggtcaggccagtctccaactcctgacctcaagtgattttgcccgcctcggcctcctaaagtgctgggattacaggcgtgaaccaccatgcccagccctatctttatacttttatagagatgggttggtaggtgaagtaagtaactctgaggaaagccaatggtatatgtggattgagactggggaaagagtactgcacatcaggaaggggaaaggagttacagagatacaaagatagagacttgcatttatttctggtaaagtaggttaacattacctatttagccatttaaaatkagccatttaaaatatgtaatagtaacttagagctgtgcacaaggtcatggcagatttggaatcagagatgaggtcctgaaagaaccagtgctrggcttagctgtcagttttgcaggttaagctagactgttagcgtatccgtacaaaatagttatgaagattaatgttgccttctgtagaatgattttgcctggtcagctggaagtttttctttttttcctttgcagatttttccagctgttgttttgccctctgaagtactgggtctataatgatcttaaagtcttcagagaaatatacatgaatattattcttcatcagcagtagaatgaagtaatttctctttcaatattaatttacactgaaaaaagaagtgctcaccagtaagaggttttatgttcttttctgacggcaggtgaacttcagataatgttctggtaactcctaagttacaggaacgctattgacccaattgacccagttgatttcaagtaatagacttgacagctcattgtaaattaaaatccctttcctattggcccagtgtcgtacagtggtattttgtttccggaaacagatatcatattataaaaatactacaattagtcatgaaaatgaataaagagaacttacagtgtatatttatgcaaatactaggtatactaaccaacatgataataatgtaaatgctccttttagggattttttttctgcatgaattagactgactggattctttcttatttttatttttttgagaaggagttttgctcttgttgcccaggctggagtacaatggtgcaacctcggctcaccgcaacctccacctcccaggtttaagtgattctcctgcctcagcctcctgagtagctgggattataagcatgcgccactacatccggctaatttcgtatttttagtagagacagggtttctccatgttggtcaggctggtctcgaactgccgacctcaggtcatctgccaggcttggcctcccaaagtgctgggattacaggtgtgagccaccgtgcccgactgactgtggattcttaaaatacagtttctatgtgtgtctcagagtgtttggatggtaaatgcaggggagtggctgtttccatggctatttcttcttcagtgaatttttgttgctgagtcttcagtgacctggctctgggtattagcttcacttgaagtaggtaggtgatggaagagtcattagccagttttaaagacaagtttagttttctctgctgttatatagataaattggcaagtggttgtgattgagcctttccaccttaggggtggtcagaaatccattaacttagtattgcccttcttagaaataatggattatgatgatgatgatttttcaaaacagatgagtacttaccagccaaaaggcttttgtgtcattatattttgctttatgattttgtaaattgtgtcaaaaagattgaattggtgccagctccatgtttgaattctctaaaaaataagtgctggtttagatgatctatctagataaaacatttcaaacatttattattgaattcttcttaatatgctacataaatagtcagaccccttgtttttgtgaatgttattttgaggtatgtattcagtgtttgctaagtttgttagaattgaggcagagttttggagacccttggagtagagctaattctggaagttaaatttttacctatcttaaaattgagagagtatgtattcatggcatttgaccttgaaattatatgtaggagtggtggagaagggaaaggggtggtggaactcaacatcacgacagttcatgaattaaattaactacctgctctaccaataataagtatgatacatctttttcatatgcctctcttcatttacaaagatggtgctgggcattccaatctacctgaagcattttttttttttttttttggtcaggagaggtaacagggtttgaacccatcttcattccactatgcattctcccgtgtgactgctgtcacatacctgagagacagatggttgggagtgcagtaaatatatgtggaacagagtgaaccagcacaatgtgactaaagatgtgactatatgataaaaagtcaggaatgaattaactttgtctataaataagcacacacagatatagattttctctgacaatttaggcatacacacatctctgcatatatatatwcacatatttagtgtcatatatatgtatatatatgacatatatatacacagcatatttagcgtcctatcatcatgtaggaagatttcagtgctgtaattattaagaacagttacattattgaactacaaagctgaaagaaattctttgggaatgtagtttgccatgattccacttgaaatgtgcaaatttacgaagagattaaggaagataaatgtattatggtttagtttttaaataaggcctgctacttctctggaaagtcagaaatacaaccaaggtgaaattaacatattctgaactatttgcagaaatgctgctgaaacatgtaaagtatcaaagtgcttcttaagtcatgactgaatttaggtagacaggcagagagatcagaatagaatgtgaagtgggaggcattctcctccctctctcaactgtattggagacacagctccagtgtgattaacactgtgaaaaggaggtatactcaattacatgcttctagtgctaaggacgaatggcatctttttacctcagaagaaacaaagcttttgttttgttccaaaatgataatgggacattatcattttgatgatgataataaaatagataacattcaccataccaggcaccaagtaaagggctttatttatgctaattaacttggtccttacaatagctgatcactttttagcagtggaaacccaggcaccaagaacttaagcatggagtccacagcttatgaacagacccagcatgcagcctaggtagtctggcctgagcctgtgtttactgatgtaagagtcaggttttagaataggcccttcatgataagctatcttcttgctctatttttatcccatttggaaaatccctttaatgcttttaattgaatttgaagcagactgccattgaataacgtgatcaaagtaaagacgtatgttctcaatttgggacaaataaaactctaacatttttagtttttttgttaatgttattttatttactagtctttgaaaacttttgtgaaatagttcatatttaacagatgaggaaccagaggcagagtcttaaatccacaaaatgagggtaaagtaagaggtgacccaggaattatttgaatgtagaattttgtttgggcaatattttggcctttttactgtataaaatgcatatgagcagaggagagcactagatcaggggtcagttaatgtgtcttccctgtatcagactcacactgacagttcagaaagtaattgagtcacaacagcacacctgtaacaatttagacatcaaacacttgctttgaacattttgtcctttgtttcatctcctttaatgtgacctttcaagatctctaacatgtggtatgaatttgagagcttctcaacctttattgttgagatctatcctgagttttatcacccaagtattatccctcatgtttatagaacattttttttttttgtcaaaaagatctggcctttgaattcagatcagattcagtgtagttaagaaaatatgtcaaaacaaatatagtcagaaattcacagtacctttgtgttctgtttaggctattagctgagcctttatttaccatttttggtgcttttgttatcgatgttatgttttaaaaatatatacatgtttctggaactayatatatgtctgtgtgtgtatacgtatatgtacacatatatacgtctatatacatatatatgtgtatatatttgatgttaaaagcttttatcaaattgtgtgtgtgtatgtatatacacacatacatgtatatgtacgtatacatacacacacacacacacayatatattttaagagatgtgttgcccaggctggagtacagtggttattcacaggtgtggtcataattcactgaagcttcaaactcctgggctcaagtgatcctactgcaccaagccttcctagtagcttggastacagttgcgctccactgcacccagcttataattttttgattaacarcaattctaagagaatattatgtaatgaagtgtgagaataattagtgcagtggtttgaactttaagacatacgaattttatgttcatgaataatgtacattgtgttttcatacattgtctatggagagtcattttcactgcctgaaattggtcaccttcaattccttctcatctctccgccaaagtatgaaaagaagattgcagggctaagctactacttaaatattattccttttcataacccttcatatagcaccagtgaaccaaggactttgtacagtctagagccaaatgatgacaacatgtggcctatgccaaagataggttttagtagatattagggagcattgtgaaaaaaatggttctgtggttgaatatgtttgggaaacttcataccatgcccccttcttagaaaatcataaagctattaacgtatgcagggcccctgaaagaccacattgttacattttttaaaaagttctcttcttgccttgttttaaatgtgatattatttaacattctgtggcttctggaacacagttggataaaaattattgttgtacagttttaaaaacagaattattcttttgaattgcgtttcataagttcagttcttattgcctttcccacctcaatgattatcccagaaatctgaamattttataataatgaatgtaggcttatgataaagtggtttcaattaacaaaagtattgctgtgataaagtagtttcacctttgagtaaaacttgttgattgcactaagtrgaccatttttgccatttcattctggaaaccagagattgcggattttaaattttcttttaatctcctgaatcagcctggattataacatgctgtattttctgtctcatgataaccatattgctgtaaaatatgagaaaattataaacattgttttgtttaaataattgatagtagtaaagtaaatattttaggctatgtttacatttgtaaaagaagatttgagcagtaatttcatcccttagagaaagcccatttgggtaatcaagtctaaattaaagtaattttcctcaataattaggtttaagtgttgatgtctgggtaccagagaagacaatggacttggagtgtggatacttttagactttcctgtctgtgttttcttagtggtaattatttgttatgggtgatctttttcctctgggcgccagtttcctcttctctaaattgaaaaggttctattagatgatctaagatctgtttgagctcctaaaatcagtcttctttaattctgtatctaaacaataattctagttcttatttctgttttgcccaggaaagcttttaacattaaatcaggcttctgccagtagtagtctttgctctttagcaatactggaggtccagggataaaggacatctctgttttcatcttaccatttactatcttatgtcatgttctgtattccgtattctaaagggacttgagtattgtaaacaggaaaacctgagcaaagattgcatgaaagaaccttttaaggtactttgccttcaagtaatgttaaagttgtttaaacagtgtactaataaaacctttcactaagtatggggagactgtgtagggggtgtgtgtgtgtgtgtgtgtgtgtgtktttgtgtatatattttttccctccaaaagtgatctaacaacttaaataattaagaattctaaacatactggtgggaaatgttaccaaatggtaaaacattaattctgtaatatgttttgtttagtaaatgaccagtccctggtcattaattgcttccttgactttgggcaagtaatttctctagttgttaaaagactctttagctcttgtatatacttagggtattctgaataaatttatacatattaaagcaaaaataggaggaattttttttgttttatccctctggcttttttcaattggtagtatgacagttgacaggcatgtaagaccattccatgtccatgtattagcatttttaatagctcygtagtataaatgtgccctaacttattattcatcctttctttattgatggatattagattatttccgatgtttttgcttctatgaataatgctgcatcttgatatattttgtgtacatgtctgagtgttgtgggataggctcctagaagtagtgctgctcagagccctttcttgtcctccaagctctccctctcctaagctccctgcaaatccttctagcatgtaatgaaccatattttattgaaagtatgaggctgttcccttcactggaagttcctaggggacacagattgtcatttattcattgttatatcctyagcactgagcacacggtagttaaaaataaatttgaactgaacttgaaacttgaaaatcaatatccaatgttttaattttaaagtcttggcctgtcttttacagacttcttcaatgttgcaataatttttttccctagtataattggatcataacatagatctcctgatggccacagctatcaacatataggtaactcagttctttgcaacttacatttcagaagcttgtcatgacccaattacacaggcgtagtttcttacagaataaatgttttccaagtctcttgagataattctcctaattagaaatcaggggtgagaacctttatgtaatcagcattgtggtagattgaaaagaatacaggttttggagttgatgtttgaaagcatcttctctgtggtattctatagccatttacttaggctgagtttactggtttatgggagatccagttttttcctctgtaaaatgaagatagtattctatattaagatagggcactggaaaggctaatggaggtcttgaatgtgaaatgtttaatgtgggacttggtacaggtacgtacttgtgaaatattagttcccttcccaggtaccatcagagttttcaatcttgaggggagctgggctgacaacatattcactatagttttctatatcagtggggtactctggtagagtagaacaggggtcctcagaccctgggccgtggtctggtaccagtctgtggcctgttagatactgggctgcatagcaggaggtgagtggtgggtgagtgagcattactgcctgagctccttctcttgtcagatgagtggctgcatttgattcttaaaggtgcatgaaccctattgtgaactctgcatgtggagggatctaggttgcaggttccttatgagacctgaaactatcacctgcccctgaattttttgtggaaaaattgtcttccatgaaaccggtcccttatgccaaaaaggttggggagtgctggagtagaaggtcataactgataagtacttcagagattttggacaattactgttcaattttttgccattcagacatacctgatgctttcagaaggttttcttttttttttcttagtatgagtatgttgactgtggcactgctattactaggaaaaaagtgttcctaatttaccagtgttaatcatttcatgttttcattgctagctcttatcttttttttctgtcatcttccttaatgtggtttatttaaaaaatttctttgactggtcctgtttcaaattgaatgattatgctgtwgaaaagatcagaaatggtcctggctctcatctttcttgggcaagccaatttttaaactaatctgtaaatttcattaaaccatgtgaacaaacagtaaaactgctttcaaaagcataagctatcagagatagaatcagttggttctcctctaagttcctttttggggggtagaaactgaaatatgccatgctgtacgtagttstgaggattgaaagagttcttgcagtattttctcatataatcttagacacgtatcgtgatgtggatacgctattcctgtgtttttaaagggagagataaatggtgttttttccctcaaattgtggaagaggatgaatttttataagcaaatatattagtattatttgtttactggtatagagatgctcagccaggaattcattactgtgtgatgaaatgaatctcagtggaggcactgagaaggatgatggatttggaacaagaagatctgggtttgagactcagctctggtgcttactagttgtatgactttgtgtaaatgtcttcccagcctcatttcttcatctaggaaaagggataataatactttttcacagtgttgttttgggaattaaattaatatgtcaagacactttctaaacttaaaagcattattatttacattggcagatacctatattgttgatagatattattatggcagcacttacagcagtgctggtagaaagtgagtctacaataactacttgctgaataaatgaaacagagtaacactgaactggaggaatttgcttcttagcagaagcattcagattacccctttttattttctttcttctgtatgtttcaattcaagaaaataaatattaatccaatatagatttttcatagaggcaaggttttgataataataatgagttgctgagtattccagtggactttatatagtgctttagtcagcaaaacagactaagcatacaaattattcatatcattgaacagtttatgtaacaaatattttttgaacatacactatgtacttagcacttagtgacttaggtgaacattgactgggaggataccatgtgtcccatcccagaagattgtataatgttatgacagggacaagattatatatatatatatatgtatatatatgtatacatacatgtatatatgtgtacacacacacacacacacacacacacacgtcccaggagattgtatagtgttatgacccaaacttatagacacctaaacacactatctcttcattccttaccttgacctgtgctaatcactgattgcatgctctacaagtaggaggttttatgtcattcacttctatgaccagcacttggtaggcccctaggacataataactgctcagttaatatttgttgagtcatgaatagatgaaagttctgatttagcagtatttctatggaaaagaatttgaaccataataatcatgatggctattattaattaaacccctataatgtgtcatgctctaggctaagtaactttcggacagtaactaatccttttataacatcttgaggaggctgctgttactattcacatttgacatttgaagaattggagtctcagagaggttagataatttgccagtgtcatataaccatctctcatattttttttccatttagcaggatcaagtataatgtagggtgtcctttttctttttcttttaatttttttttaastacagctcattggaacttagcctatttcatccagatgtgtaacatcctccttaatactatttttcttcttattcccagttactctgagaattctttccctttcttcactagatctgtgagccaaagatgatgctaatcatagctcataaacatgagtttggtattaatattatatgtttgtataataaaagaaaaggaaaacatttagccttaaagtaaaataagttggctctgttagcctctagagttcttaaaaataattataagtctcttcrgaatccctctaaatgtcttcatctcctttattgtctttatctgcttaaaactgcttctcttgaaagaccagaatgcaagatcaaaaaatcaaatattatatataatattgatttctggtagattcatagaatttcaaagctggaaacaatcttattttattttttagaataggaaaaatcttttgtaaattagaacacttaaaaaataagttaggacactggaagtcttagggaattaattctgccaaaatacaccttgcccarctcccatctttctgtaagctataaggagttgttcataatgaagaaacagacccctttaggcaacaacaaaatcagagaagagctgaagatttggggaatacattatgcacagttactgtgtgtcttcattttgcagaaagaaaagtatactctacttggtttgatattgtctgtgaaagactaatattttttaaaattcagaagtcgcaggacagacagtaatatagaagagatgaaaataaaatgggagtagagaggggaagaagttaaaagaaaaagcagtggcatttagaagctgttgcagagatcaaacaggacaaacaaggcttagagttagtaacaaatggacaaagcagagatcagttttgccttcaaggggtgctgtgatgagagtatgtgtaagtggtaagacaattgcctaaacctcagtaagatatggaattgtatctttacatgcatctttatccctagtaattacaagattggaattgtatctttatatgcatctttatccctggtaagtggtatctgtacttctgcatatgtgatggtatgattcattgataatttgaacctcttcattgtactctttttaagaagggaagaaagtgtgtttgcatactttagaaaggagtttatctaaatgctcttaaagtatagtttgatatggaaaggtttcaactctcaattaatcagcaactattttttttttttggcctaggctgacccgtttctcaaaattaaaagccactcatatttgggrtctgataaataagtgtttgtgggctggcaagtgtgggaacctaatgtccatttaaatcttgatttttgtataattaagttgtaaattatatatgtcttacaaatgatcttttatgatttgatgatgaaagttggagtcctatttttgaaatagacaagagaatgaaaaaaaaatcattgaatttttagagaaacaatgtagttaatggaaagagcaattggctatgtttttgcatctttgtgaccttaagccaaagtttcttttttggtccttagtttccttacctgaaaagtggaataatttctggcacatatggtttggtacatcacatgaaatatatatatgaagkgcccggttttgtgtctaatatatagtgctgactcagaattttataattcttaatgaggttaggaaaaaaaagaaaagaaatttaatgattaaatatctaaatatcatttctcccacttctctcttctcagtcagaatatatttctccaattcttagtcacttggcctgtcactcagaagccataatagcactaaagtcaattttgctaggctctagagaatttaacctgagcttcaaattagttctccttttgtattctgcagcaggaaacaaccacttcctagacttgggtgggagaataaatattatgaacttgtctaggaataagtcaaccctatcaatgaaaagatcatgattttaactgagtaatttaggacagaggttggcaaactatggcccctaggccaaatctagacctctgtttgcttttgtaaataaagktttattgaatacagccatactcatgcctgtaagtattgtctatggctgctttcctactgtaaaggcagagcaagtagttgtctgccttcccagcactttgggaggctgaggcgggtggatcacctgaagtcaggagttcgaggcaagcctggccaacataatgaaaacctgtctcaactaaaaatacaaaaaattagctgggcatggtggcgggcacctgtaatcccagctactcaggaggctgaggcaggggaatcacttgaacctgggaggcagaggttgcagtgagccaagatcgcaccactgcactccagcctgggtgacagagcaagactgtctctcaataaataaataaataaataaataaataaataaataaataaataaataaaagtttgccaactgctgatttagaaaattgtgatcatttctttaggtgaatattcctgacaaactggtttaaaatcatgtttaaatatctgcaaattttctcattaaaaaatcaatctcataactttcaagtgtttgctacaatgattctgggtgagctaaaagatggtctggaattcatagatctcatttcatcattcatggactatttagttattttgggtagaacatgtactgtttactgttcttcatatgttttcttaaaatttcagaagttgtttcaaggttactaaaattgagtaaactgctgattaaaataatttcataagtatttttatttatattatgtagacatctgttttcatctctctgggataaactataggccattaaatatctccccagaggggtatagctttctgtcattattaaagctgagctttctaaatctctcctaaaagattgttggcacatcagttagaatgtaaacaaaggctttctgaaatttcttcctgtaaacaaatgctttatattttcacatggagatttcctagcttgtgccatttaagctctgtagaaatgtttatcagtgaatgaatgagttcaggttcttaggcaataaaatgggggaaaaagtaaggtaatatttactgaaataagtcaactttgattaggtctgttactcagagattttgctttgccttcccaggcaaattttatagctgtctaaaaggagaggtcttgaggaagtcaagcttatgattgcctctaagtcatctactgacatgctttgaactatcaaggttcaaggcagtgtggtagaccttgggagatgggatggagatattatttattatgtttcagatacaaaactaggtctttgttcataatgatatttaaaacaaataaccctcatttctatgcatggaaaatagtgatagcttatgaaagagtttagaaatggatttcttgcagtggagagtgatgttgagaaaatcagtgaaggacaaattgtgacctacattttagcaaaagtaggttatttgttttaaaaatatagtcagttttctaattactgagtttgttattccctttgtttgtaaagtacttacctcatgccatctgtgtgagtgtcctaccaaacttccaagtccatttcttttttaaaattgatatataatagttgtatacattttgggggtatatgtgatattttgatacatgtatacaatccctagtgatcaaatcagggtaactgagatatccatcacgttatactttcatctttccttgtgttgggaacattccaattcttctcttctagctattttgaaatatacaataaattattgtttactatagttttccaagcttatgtctgatgacacttcctcattgaatttttcctgccttccctgcccttctactctaacacatatcccctttgatcacctgttctttcagacacctcctatgatatttacataaaataatgctggagtttatcaccagtagtgcttagcaccatgccccttacacactcactaaacatttagcgaagtagtttgtgactatagtagaaatatccacccccccaccccccgattaaaaaaaaaggtcattactatctatgcctgggaagtgagtcatcgttctttagatttgctaatttttacttaagggggaagagggcacctcgtttcttataaaactgtagagttaaactgactaaaagcagagtgatgacctagtgatcagaaccgtttctttgacagatttgttcatttgtggaaatcccaaacccttttcagagcagtttttgtaatcactttttgtggtgtttgttggattctcagaatctttttctcaaaatagtagatgcctggatttgctattccaggtacttctgaaaagaagattttgagagatactgtagaattttaattgcattggaggtaatgcttttcagatgtatatggaaagttagattccaaggattaaaaaaaaatgaaattcttaaacaaattttggattccaagtccagattcaccrgctagttccaatgggtttgaggggatgacgtataatgtctgtgtttgataagactaaaagctttttgaaagtgtgtgatagccaagaggtaaacttttgctcctaaggatctattgattaccttgatttcatctccttacatgagatacgtaccttttagctttcatgggccatgaatataccctgtatatgtttatatgcctgtatatatgatatattcatatatatgtaaataaaaatcaagtatgatagtaaaaggatttgtgttaggtctctcagctcttagaagtttgaataatctcatataagttgcttaacctctggtgcttttctttccttttaaaaatgagggtgattataccttcttaagtgaagtttatgaggcttgttttcatgacatatacaaaagacagggattcttaaggtcaaatgaatacagctagggttaggttatctggataattaaagctgaaagcttggagaaaaaagatttcattgggatggagggacatatattagggagagtatttaaataatttaacttgattcattgtggatgtccgggtcattgaaaaattaccagtctttcattttgttttgtatcaaattgacatgaaaactgtagtcacttcatatttatgcccagttcacaaatatctccttgctgtttagtcacagacaaaagataataatattctattacagtgtatcagttgaaataggctaaatatttatgaatatatgttttgaaattggaagcatgttggaagaaaagaatcaataaagatataaacttgttttgctaaaacaatttgaaccttttaaagattttcttactgatctgattatttgacatgcccaaagcgggatagaaacaaaagaatttgttaagaggcttacttatatacttatgtatagagtttaattcttggattttattttatgagtttgaatattaattttaatatactttactagatcagtaactcacacactattcattctgggaatgtttcatcttcagataactaatatgctaaaaatataagagattccaaaaaagttcaaaattacacatgaaaatgaatctgtagattttaagctttgattagaaagatttgaaaatttattgtgattaaagataagtttaagtacttagataaaacactatggacagatgaaaggaaatctaataggatagcaaatatgtagaacacattggtatttccagcattttatattttagtgtcttcagtttccataggtaccattacttaaataagagtgatttttttttcattctctaaaatggggaatagataaaaatgtgtgaagcaactggtttcttctgtctgatttgggcttctagatgccatgcctggagagtttgtagaagaacatagtattaggacttgccttttttgaagtgtaatttagaagtcaatataactaggaatcttagttggacaatctctactttgttatggaggcactgtgtagagtgagttgcatctagcagtcaggtgaaaatcccatagtcagaatcatggtttagggatataacacagtggccaattttaccttacttttttcaggtcatgtgtctaggtggtctcacttcagttaattttacaggaaattcattaatactcatttgcatattttatttctttttctttagtcagaaaacacttaaaataatttatatattctttccataggatttagcctgtgtatattgactgtcagacttcaggcatacattatttggggatgatggaatacaaagacccacatgattgattatgtaattcaaatttactttctgcgttctgaagataccacttcactgtaccaacaatattttgacttgatcttagttactgtattttaaatgcttgcacaaaatgcaaggtaagggcaagatgtctgtttactgtttgaactgttgtcatcctaagttaaatatgtggatttttggctcattttttgtataactgcattgatctgatgtgtcctacctcagagaactgtgtttatatctttgcatcactttcttatgaattttgcattctattatttgtatccttttattattgttattagtaaatactaaaagcccaatggtcagacattctatctttttaatttttttctttgaggatttggcacagtacttgaatatggttgttacttttaagtgaaagttgttactttatagaaaagtcggcttgcaggccatggagccaggaactgatatgctcaccctctggagctggtcaggtgaagacatatcacccctgcttccagggacagacattggcttgcattgcctgaccatcagtgctggacactcctttatcaagctccagaattgctgcctctggaaacggaatgtagttttgccaccctctcctgaattcctgtggtcctagcttcttctcatccctagcttctgttgaaaatctgtggacccttggattagttggctgggcctatatcctgagcctaagtcctagctacaaggaaggttgagcagagccgtatgtggcattttctacagctacagtgaagagtgagctctgcctcatgaagtaagagattcttcaaacacagaaagtgggttcagatgctgggtactgaacagtgctttctctgggggcagttgctacattcccagagagctgtaaagtgacatgctagaagggacaagaaactttcagaacctgtactaccatagtacaggtgtcacttatgttgagaagagttctagtatatattttgaaaggcagattggtgctaatttatagtttttgctgtgtttaatgttttgagtatatatgatagtgacttagaatttgtaataagtttcatgaaaaaacaaactagaaggtgaaacaataggggaaaatatgtatgctaataacaggtgcaggtcaaaacagtaagatgaaagcttgtttcaaaaatgtagcctcctgataggattgacacttatagccaagtagtcaggtccttttggctggggtttggggaggcctgagtgaaatattgagtctggccatgtgactaagtctgttttattactcaaataatggacccatccacctgatgctcagctctgtatacagtccatctaggtctcctgatgtcgtgttctccttttcccatgccaccttgtaatcccatggtgggttctccttcccaagagcaggtctttcatattcagtatgggtccgtaggaatatattggtatatattataataagtaatgagtgaattaattctaaatttggaacatgatggtcatgatgaattagaaacctgtcacttagttggtacagtggtggggcaggagcagggagggacaggccaaatgtgcacattagagttatctggcaaactctaaccacttttactttatttaccataatggggtggttttgtttttacattttccctcttcattcctatgttttccccattcccccatcactcccattcctagcagctggaggtttctatttgggtatcctctaagtagctagtggtcatatgcctgatgttggtttgccagtcattgggagggggcagaggggtgtgtaccatgacacattttcccaaagatgctgatgatttagtttccaggctagcctacagaagcttatttaacttattatgtctctgagatatactaaggggtagaaaggaagtatagctagctttcccctctctttccaagttacatggttagtcccaagcataattttgaagtaagtaaaatccatcttttgcatcttgtaacttctctttgtgcatcctggtaatccttttgtcattctcctggcatttatagcatacttgaaacttgggactccatggwctttcagaacttttccaggtttaaacagagagctctggggacaatgtatttcccaagagagagaaaggctaagtactccaattattattattcattttgtgtcaagggtatatatcactacgccaaaaccctggggctaacttgcaacctttatgttccttagaaaactttggccttaacattctggtccaagcatggcctaatgtttttacctttgtttccrttaagcacacctgggataagccagaattttcaaaaagaaattcttaaataccaagggagaatggtaagaaaatactttttaaaactgacaaatgtattacagagctttgcccatttctatccagttttgattagtctaagcagagcaggtttgtgggattttgcctgtgtgtgagcttggctgggcttacatggagstgactcaagggctagcacttgcttttgggagttgaaatgtcagttttctcaaaactctcatatgccttttggtttctacactcacagatttccaccattctcccacacatgcagggaggaggaataggagcaatgaaaggtgaatttcatgaggactattgttgtattaagaagtgtaatactcaaatgtcttgctggtctgacattggaggtatgaagcagggaatgggatacttaggtcaggtcaaggagggcataaaatagggtcctcagaattggatgcaagtgttgtggcccccatataaaacaaaaatgggatttacccaaaatagaaggctactctgacttactttagagactatgaagcctctattgggctagttagcagctcagacagtggtgggaatttatctaagtatgctgagccttttaatgacagtgctatgacaggacacacagctctggaaggcttcctaatggggcaggaacctcacctgggggagggtggggtggtgatggaggaaacaagttagagagcgcctaggggaggtgaatcatagggtgtgatgttgagatagtttgctcctttccactgagtgcttctctactaaggttgtcttctggctagtaaaggaggcattccaaaatggttcatgcttcaaaatgacatgttttctttccccagtaaaacagttcttttttttttttttttgaatggtcactttttttttgaacttttctgcttttcttattttttcagaagcagctattctcaaactttttggtgtcaagacccttttacctaaaaattatgaaggatcccaaaaacactttgtctaggtgaattatatctattgcacaagaagaataagttaggattttatggaaagtaactgtctctactgttttgcctgtttacatatcttcagtaatgtatacctttttcctctcaaaaacttgagataggatgagtgagatttctgtcattcttggaatatgaaatttatatatagtttggtatagttcagagacctgaattgcttagctgggaatagttgactaggccagctctttttttatgttcatttccatgtaagcaggattctgcttctggggtctcttttctgtcatgatgctttatttgctttatttctatgtcacaaactgattttgtcaatttttatagttttatacgtttggtatcatatagggcaagttttctcatcttgttcttcataagagagctcttcttagccctttgttcttctgtgtaatttagaattagcctgtgcaattgctcataaaacatttttctttcagtttgattggaatttcattgaatctgtagattaaatttgagagaatgtttaaaataatgaattttccggtccttggctaagatcatacttttctatctctttgggtcttctttaatatatttattatataattatacaacttttgtttaaaacattttttgctactgttgtggatagtgtcttctttttgtccatgaawtaaaaggcaattaatttaaaaagatcattttttctgagacaaggtctcactttgttacccaggctggaatgyagtggtgcaatcatggctcactgcagcctcaacttcctagacttcagtgatctttccacctcagcctcccctagtagttggggccacaggcatgtgccacctcactgggctaatttttgtacttttggtagagatgaggtttcgccatgttgcccaggctggtctcgaactcttgggctcaagtgatctgcccacctcagcctaccaaagtgctgggattacaggtaatcacctgtatgattaccatgtccagcctgaaaggcaattaatttttgatactaactttcttagaacttctgagttattatcaattttaaaaatttgcctgcagatttcagattttctaaataggtgattgtatagtattccaataatgatagtttatttctttgttagaaaagaaaaaaaaatgcttatacttttgttttttttcttctttgtcttacttggacctcctttaaaatattgaccaaaggtgagggtagtggacatttttgtcttgtttctgattttaatgttaaagattttaatattttattattatatatggcatttggtgttaatttttgttaggtatatttgatcaggttaaggaagttctcttcaattgccatttatttatttgccatgtgttaaaaaattgtgaatggatattgagtttcrttgaacttttaaaatacatctatatagatataatcatataagatttctcctttaatgatattaataggtacttttcatgttaaaccacttgaattcatgggataagtctttgttgtattttatgtttttattcactggctgatcatatttgctaatatttttttcagagttttgcgtcaatggttgtgagtgagatagacccataattttccttcctcctactgtccttctgggttttggtataagggttataccagtctcctagaatgacctgaggaatgttttcacctcttaggttttctgaagcagtttttgtaatactagattggtttgttctttgagtgcttcattcagtttcctctaagaccatttaggacttttttttttttgcattatgagttttaaatttttcattcaacctctttgaagactatagcactctactttaaaaccattttttggagtcaattttggtaaggttatattttctttctttttaaattattattatactttaagttctgggatacatgtgcagaatgtgcaggtttgttacataggtatacatgtgccgtggtggtttgctgcacccatcaacccgtcacctacattagatatttcttctaaggttatccctcccctagcaccccacctccaggccccagtgtgtgatgttcccctccctgtgtccatgtgttctcattgttcaactcccacttatgagtgagaacatgcggtatttggttttctgtccctgtgttagtttgctgagaatgatggtttccagcttcatccatgtccctgcaaaggaaatgaactcatccatttttatggctgcatagtattccatggtgtatatgtggcacattttctttatccagtctatcattgatgggcatttgggttggttccaagyctttgctattgtggacagtgctgcaataaacatacatgtgcatgtgtctttatagtagaatgatttataatatcctttgagtatatacccagtaatgagattgctgagtcaaatggtatttctagttctacatccttgaggaattgccacactgtcttccacaatggttgaagtaatttacacacccaccaacagtgtaaaagtgttcctatttctctacatcctctccagcatctgttgtttcctgactttttaatgattgccattctaactggcatgagatggtatctcattgtggttttgatttgcatttctctaatgaccagtgatgctgagcttttttcataagtttcttggccacataaatgtcttcttttgataattgcctgttcatatccttcacctactttttgatggagttgtctgtttttttttcttgtaaatttgtttaaattccttgtagattctggatattagccctttgtcagatggatagattgcaaaaattttctcccattctgtaggttgcctgttcactctggtgatagttccttttgctgtgcagaagctctttagtttaactggagcccatttgtcaattttggcttttgttgccattgcttttggtgttttagccatgaagtctttgcccatgcctatgtcctgaatcatattgccttggttttcttctagggtttttatgggtttaggtcttacatttaagtctgtaatccatcttgagttaatttttgtatatggtgtaaggaaggggttcagtttcagttttctgcttatggctagccagttttcccaacaccatttattaaataaggtatccattacccattgcttgtttctgtcaggtttgtcaaagatcagatggttgtagatgtgtggcattattgctgaggcttctgttctgttccattggtctatatatctgttttgggtagcagtaccatgctgttttagttactgtagccttgtagtataatttgaagtcaggtagcatgatgcctccagctttgttctttttgcttaggattgtcttgactatatgggctcttttttgcttccatatgaaacttaaagtagttttttctaattctgtgaagaaagtcaatggtagcttcatggggatagcattgaatctgtaaattactttgggcagtatggccattttcatgatattgattcttcctgtccacaagcatgtaatgtttttccatttgtttgtgtcctctcttatttccttgagcagtggtttgtggttctccttgaaaagatccttcacatttcttgtgagttttattcctaggtattttattctctttgtagcagttatgaatggaagttcactcatgatttggctctctgtttgtctattattggtgtataggaatgcttgtaattttggcagattgattttttatcctgagactttgctgaagttgcttatcaacttaaggagattttgggctgagacgatggggttttctaaatatataatcatgtcatctgcaaacagagacaatttgacttcctctcttcctatttgaagaccctttatttctttctcttgcctgwttgtcctggccagaacttccaatactatgttgaataggagtggtgagagagggcatccttgtcttgtgctggttttcaaagggaatgcttccagttttgggccattcagtatgatattggctgtgggttttttccttctattttactttttttgttgtttttcttattttgatgcttagctcattaattttcagcctttttttctaacagaagattttaagactaaattttactgcttagctgcatctcgcaagtttttatatttgtatgtttgtcattagttttgtgttttctgatttctattgtttactcctttggccatgaattatttgtaagtattaatttttttactgacagttttttactaatatatttcaaagctctttgttaagtatatataagtttagacttatgtcttcctttataattttaaaagtcattctttccttatgtacttatatgccatttccttatttctacttaagtctatatgttggatgcaaatatagctaaattggctttccttgaaggcctcttttaaagtcttttatttgcaatatttttgtgtccttattttttaagaatgtcttatgaacagcatatcaatagatttcttaaaaattcagacttttaaagataacagggaatttggttcacttagatttattataattattaatatatttgtgattatttttagcattttaatgtaacatttccatttctgttggttttttttttcctcttttttggtgatttttttgagtttttccttctcatttgttttgtcccctccactagcagggagcttagttatttttaaaattgtttattctgttattttaraatatatgtttgtaaatatgcgtgtgtgtgtgtgtgtgtgtgtgtgtrkatatgtatatgtccacatatrtttgtatttatatatgtgtatsttaacaaagtctacagttattcaatattcttactctccttgtgaaccatttaggtcatttttgttattctgcttcttgtgtttacaaaattgctcgtatttagatttttaaaaaaactttctgaatcagataattcttactgtcattaatacaattattatttattttcatttacatacctgtttttcttttcactgtttattcatgtatcatagattttcctctagtattagtttcctttttcctgaagtgtacatcttttaataaaggattattaagccctctcatttttttgtctgaaatcttatgcttactcttaagcaactgtaaatagcacactatctgattcctgttgttcaaaagaaaacataaatagtaagataaacttagtataaaattttacttcttaaaatatctatcaaagtataatgatttgtgtattatctattgctttgttttatccatactcctatactgttcttgcgacatggataatcaagaataacctgtaggagattcagaatctttttttttcctattacaaaattagtccaaaatagttctcctatttctttttattcccactggatagtactttcttgcttgctctaattgctgttctgttctaaaaaaatgtctgaacttgacttgtgttaattttctttagttcccttaactgtctgggcactgaaacgggtatagctattctcaatgcattctcacttgtcacaaatttgttattttgtatggtttagaaaatcagtgcttatttgaagcagaactaggacttaggagttcttcatttgcatatttgtagttgtcacattgtgataacttgaatgactaagtgtcactaaagtctaccagtatcctataagattgcctcattttctgtgtcagtcttgatagagactttggggccagtattgttagagttggggaagtttaggtcttctgtgcccctgttgtaggatgagagttcctgtcttgctttctgtgtttggttacctgccttcatgattacctggacaactttaactgggatctcgctatctgctgccaggtttgcctgcctacttgcctacctgccagcctgtacctgtgacagtgttgctcactctgtcctgttgcctgacactacgttctccagttactgctggcccctagcttggttggatttttttcatcagtgatgctggttggacagacttccaaggaaaacatttctgtaggcatgtttaattttctcagacagcccattttgttggtagttgaacccttggctctaaagtaccggtgagcatttcagaaaggacacaagctttcaagagaaaattagctgcaattaagaaccttctttttattgtaaacatattgagtgttaatattctttggttctagtttatttctaaacaaaaacctgygtgccatagaagtagaattttagatcttttattttctatgtaaaggttgatttcttaactttattcatgttgaatttcatattattctatttaatttatctaaacaaatggattattttcctacagtactgaaatactacctcattgatttatttcattttctggttgttacctggtgattaatttctgtaaatcagcagaagtaataggactatactgtaatatcattgtactgtagtcatagatacttggaaagctgaggtaggaagatagcttgagctcaggagttggaggctggcttaggagttgaaggctgcagkgagctatgattgcgctactgcactccagcctgggcaacagggtgagaccttgtctcctaaggaaaaaaaagtggtatgtagagatggtcagctccccgaaggcaaatcttattattatttttaatttcacagttactggctcagtgcctacccatagtgcatagtcagtcttccattaatgttttgaatagaaatcaaccagatgagctagcattaaagtttggattcagaattttcatttatcaattgcagaaatataggtaattataagataactgcatmctgaagtaatttatatccagatataaatgtacgtgatcagtttgatcagttttccttttcacaaataaagtgttaaacatcaaagtggtttttagtataaatgggacttatgaaatggcagagttctctgccataatttcacatcttattttggaacaagtggaagatttgtttccttgtgttctttattttaaagctacactacagttttatcggttaataatagacttattcttaaggcactgcatcagatagttgaagggaagacatagtttttgcctcagtcactcatgtgctgtacagtttaaagccatgggacagcctggacttcagtctagctgcttgggtgtcatgcttgacaggggttaaaacttgaagttccttatctcttaaacatttttatgtttctgagttcaatcctgttaagattaytgacaacattcttggaagactgtgtcctaaggaaggaagaattttgaaaataaatgattttgctagatagaatgggagaaaagaaattcttggagtacatatgggaggatgaaagtcagaattttagggagttatcaggaagcaaaagtaagtgtgactagattggcagttatggttagaactgggttccaaagcttagggaagggagatgattttaattccttttccaaatgctgactgttacctttgaaattataggatttgggagcaaacgttcatcttttaacaaaagaaagaatctgtattattattctttctgttgatttcatggagatatacaatgcctagctttggaggagttaaaaattggtgcctgagatatcctacttagcccactttactgtacaacccctttcttcacacttctttttgtaggaacgacaggaatagtaggcagtaagccatactaactaaagcaattttaattgtttttctacctttgactaactagttatgagaaagcaactatatatttgagaggcctgctgtcatgatttctgggtagaaatttcataagcagctttctaatctactcatttttagattagaaagtggcttagtggtaaggtactagtgttagacccttattctttattaatcattaatcagtttcaaatgtggattataagtgccctttgaggacaagacatactttgtattttgtgtgcaaaaaaagcctaaaatgtggttgttggtctcagtagatccagcacttgcctagaacttaataaaactagttaaattttgtgaatgatttgccggaaggagtttgtgtatggatagtttctcacctccaaaccacttgcctaaatatcacttccttggagacctcccctgttctgcagtttaaattggcttctcaggctctatcatatcactctttttatttccagagtgtaacttatcattacttgatgtttcttcttcatttatttttctcatattagaacttataggttccaggatagtagagcccttgtctatctcattcacctctttatccccagtgcctaggccactgcctagcacaaggcaggtacagaaaaaatattcaccaagtgaatgggtacattttcttactctcaccttcttttttcttttttgcttacttttatttgttagagttattatgttgttatttgttagagttattatgggaataaataataggtgtgccctaaaaaataatgaacagccttatcaaatcagggctctgaggtaaatacagtttcattaagtcatcagcaatgttaaattaagctttgagattgtattcgctctcttgttacattgattatatatttattttcattcattaaaaattgtaacttgggtaaaatcccagactgtataaacaattcctttttaaaatggatttggttattttcaaagaaaagatacattttctgtattaatgcttaaatttccytaagagcttttatgataattaagcttaaaataccaaagatggatatggttacatattttgctgatttcaaagtttggagaatagttaatgaacaactactagaaagttaatagaaatagttaatggacaaccacttgaatgtaggaataaaattttcatttatatccaaactaaatccagcatatgataatggaaggacaactcttgacttagtttggatgtaaatgaaaaagcacaaaatgttgcaagattagtatttcattttgcctatggaaagaatcatttacttagatttatcaagttacttagttactcggtatttaataactacctatagttggaggattctatgaattcagattctataaaagaaatagtcacttctaaaacctgtcattaaatttgctttatttaatgtgatgtgtttggtgttttctgagcaatagtggttgtggacataaaaaaatgaaaagattattttgattttaaaaattaatattaaatttattaatgttacagattcaaacacctagttttatctttggcttctaagttctgtttataaaacacattattcttgttataagtatatcaaattttaaacatttaagggtttttgaatgatacttagtcatttataaatttaaccacattaaaccatttaaaactctatacatttaatatatttgatttttaattacttttctgagaattgaaaaaattttatgcatgtcacaaattaaacttacaaatatagtgactgtaatgttctcttaaatatgtcaatactatgtttagtgctagtaagatttctacttataatcacaagtctcaatcagttattcaatttttaattttaatcagaactacaaggaattattgtcctgtcactctaataggtcatattctcttataagttacacatacttaaaatatgattggttttgttattataaaatgttaacagtatgaatttgattctcctaaatatttcatattttaaatctcctcagargtatattatcccaagcaattttctcaattatttgargctgcgtgaagaatttgagcaagatgttcatcagatttttgttagttcatttaagatatatcaaactttatttattgataacaggcatgtaaaaattaatttctgcttcaccatgtggtctatacccctattctattcatttgtagaatgttgtctgtaatacttgattggattttctatttctttggctgttaagataattaaataccttttcaccaagctttaaagatccttgaactatatggacttctttctctctctctctttttttttttttttcttcatgttcttcctatctggcagaagcacagaaatcttactgttattaaaatatctgattgaattctggcactctcttaagactgttcagttataacttacaagatgattctactgatcctaagtaaaactgatcagtgaaatcttttagtcctttgacccttcttccagctttgtgtgtgtcctctatgctgagggagggagggggaaataagagttctcttaaaaagtacactgatactaatcctatagtgtcctttatgttataaatgatagtctgtgttcctttcagttgaggtcaaaataaaatgaagagaaagctcctgaaaccctttttgaaagtaggggtagaaaaaggaaataacactaaatgcctacaccttagcagatgttttgcatagactatttaatttaaattgatttcattcttaccataaacccccaggtaagtaatattaatccctcataaagtttatttacacataaggagactgttattcagtaaagttaacaacttttcaggggtcataaaactattaagcaaaggagccaaaatttgaatctagatgtgtttattttttttaaatccagatctcttttttttaatccagatctccttcgtcagaagataaatgacaataaaattaaaattgtgttcatttaaaagatgtttcttgtggctatgtttcttttcatttgcttgttttccctgcagatgtatttaatagaaaagcaaagttccaatgtgctttctaaatcatccctattggttttgtagacccatttattggcagggaagatacatgttctatagagctggcatctgcttgcaggtttctatagcctttcctctatgtaaattagtttgaataggtaaaggggagaattgagtagtgatatgatgtatttagtctggaaggaaaattgtaaattcactaacttcctgactcttttaaatgttctcttctccttcctctgctttataagaaaacaagactggttaataaaaaaaacaaaacttataaataaatgacacatttgcyttaaaagggaaacttgaacyttaatgaggggtggtttattttttcagataacttgggtgtcttttggttgtattgaatgttttgtgcttttcaaaatcatatcatgaataataatattagtattattctaataacccagtaggttgagtatactaggtattattcccatttcattaataagtaaataaaaaaaactgatagcctgagtcatcgggccggacaaattcagagccaaaaatctataatattttaagcaaaaggttatgtttgaaagactgtgaggttccttatatgtataaaattggatagatttaggagttctatctggttatctttataggaagtttaagtattcagagttaaggttatttttagaaatgactgggtgcccttttgcaaaaactgttttgaactatttatatgaattgtagtatcaaatagtgccaaatttggatacaaatrtccttttaggcagcaaagtactatttaaagtatgaattaaagtatttggaaaatgttygcccttatcgtttaacacattcatgttttactcgtgaattaagcacaaatcgtagaacagatttgtattggtacagccaatgtatttgagtggagcccaagtattgatatgtcagagggtggtcattttgcyttatttttttaatcaatattgttgactattttataaatatttcaatgcctactatgtgcctaaaagtattctatgagaaatgtattgaatctactttttgaatcttcaytgggtttcgggatagaaactttagagtcaaatgaattttctgggattcactgtacatcaactaatcccctagtcttaatttaaatcttttcaacatcaggagtgacaggtttttttgttgcaggtcacctgtgaatgggtcctttatatagaatgagactttaaaaaatatttgtttatgtctaatccatcctcacattaactcatggtatgtttctgggtagtttgttgtctccaaattttataaaccacaaaaatgtgytgctgctgagatgtcagtaattaattatttttataaataatcttttgtcaactctggtgccttagctgttcttaggtttttaaagaatatcctgataaagcaaagttctcatatattattatattggattgtcagttgaaattagtggtttttttaattaagaaaaagccactcagaattttgtaaaatattgtaaaatattcaagggttttccccatgttgtgaatgtatgacatatgactctaaattggatttctttaacctctttctcataaaaaaaatctcacttttctgttaaaggaatgcagaagttattccttataaggaaaacatcaggagttctatttataagcgtatagtattcaatcaaaaaactcatgttgaaaattcagataaatagctagcaaaatcacacattaaaaaatacattgaaatgatgtatgtgtaatctaaaaaaaattaatatacgtgaaatgcagtgaattccaccttaattttgggcttgatcttgggagtctgagtgactacagtgtcattgacttgagcatgaaaggactaagtatattcctgctggagtcaagctcgcatattaacacagctccctttgaatttctgtatctgtgggttttggtgtaggcagaagacttgccacagaataacaggataattcacagtagaactttcctttcctggatttgcttcctgttcatacatgctttatcagtaaaatgacttacttttaaatacatgaagtcacagaattgaaaattcaaaatagaaattgcttaaatacagcaaaaaaatctagttattcaagatacttggggaatcaggcatttgggtttatgaaaccacatagccataaaatataaacaaacaattctcaaaatattaaaatatatttaatatggaaacttctttgaataagtagtttttgtgtaaatgtgacattttaggaatttgaaatgaattttgggtttaccagttatgccacacttaacttggattggtgaagcatggaaatgaaaaccctttcttaatgagactttctaaattttaatatgatggataactcaattttaaagtatagtttctattttttatagcagctttattgagatataattcayataccataaaatttttagtatacttgcagaattggtcagccacaatcaattttagaaatttccatcaccccatccctggctcacattagccacaggcagctgctaatcatatgtttttttctggattggcttgttctgtacattttatgtaaatagaatcatataatatgtggtcttctgtgtcttctacctttcacctaacaatgttttcatccatgttgtagtgtataccaatatttagttcctttttgtagtcaaataatattcattgcatggatatacatgttgagtttcccttttcagaaatgcgtgggaccagaatgttttggatttttgattttttgaagttttgaatatttgcaatactttatgtattaggcaagcctttgtgacatattcaacaatatctttacaccagatagtagagaataagcagaaaaaccacaatragtgatgcacataggtcttggcctcatgtgggggcattgtggggaacctggcattggcatatcccattggcatatccacctgcacatgtgccattttattaccctttgtctgagtgtttgtgtaggagaataagggcatgtaggaaaatatatattccaactgaagagggttggaggggtcttttttcccttggggacactgactaaattgtttattgtgcgcctgtgttctgaatgcaacttgtcacaagaagtcaggtgtggaattttccatttatggagttatatttgtgctcaaaatgttttgaatttctgggttagggttgcccaaactgtaccatattttatttatccatttatcagttgagagacatttgggtagtttcctcattttggctgttattaataatgctgctgtaaacattcatgtggaaatttttgcagggacataggctttcttttttttagataattatctgggagtgtatggttaatatttgaaagattaattttacttttttaaatttatactttaagttctgggatacatgtgcagaatgtgcagtttacataggtatacatgtgccatggtggtttgctgcacccatcaacctgtcatctacattaggtatttctcctaatgctatccctcgcctaaatccccaccygctgacaggccctggtgtgtgatgttcccctccctgtgtccatgtgatctcattgttcaactccaaattatgaatgagaacatgtggtgtttggttttctgttcctgtcgtagtttgctgtaaatgatggtttccagcttcatccatgtccctgcaaaggacatgaacttatcctttttatggctgcatagtattccatggtatatatgtgccacaatttctctatccagtctgtcattgatgggcrtttgggttggttccaagtctttgctattgtgaacattgctgtaataaacatacgtgtgcatgtgtctttttagtagaatgatttgagtatatacccagtaatgggattgctgagtcaaatggtatttctagttctagatccttgaggaatcaccacaatgtctttcacagtggttgaactaacttacactcccaccaacagtgtaaaagtgttcctrtttctccacatcctctccagcatctgctgtttcctgactttttaataattgccattctaactagcatgagatggtatctcattgtggttttcatttgtatttctctaatgagcagtgatgatgagcttatgtttgttggctgcaaaaatatcttcttttgaaaagtgtctgttcatattctttgcccacttcttggtggggttgtttgtttttttttcttgtaaatttgtttaagttctttgtagattctggatattagccctttgttagatggatagattgcaaaaattttctcccattctataggttgcctgttcactctggtaatagtttcttttgctgtgcagaagctctttaatttaattaggtctcatttatcaattttggctttcattgctattgcttttggtgttttagtcatgaagtctttgcccatacctatgtcttggatggtactgcctagattttcttctagggtttttatggttttaggtcttatgtttaagtctgtaatccatcttgaattaatttttgtatatggtttaagtaaggggtccagtttcagttttctgcttatggctagccagttttcccaacaccgtttattaaatagggaatccattacccattgcttgtttttgtcaggtttgtcaaggatcagatggttgtatgtgtggcattatttccgaggcctctgttctgttccattggtctatatatytgttttgggtagcagtaccatgctgttttggttactgtagccttgtagtatagtttgaagtcaggtaacatgatgcctctagctttgttctttttgcttaggattgtcttggctatatgggcttttttttttgtttcatgtaaaattaaagtagtttttttctaattctgtgaagaaagtcaatggtagcttgatggggatggcattgaatctataaattactttgggcagtatggccattttcacaatgttgattcttcctatccatgagtatggaatgtttttccatttgtttgtgtcctctyttatttccttgagcagtggtttgtagttctccttgaagaggtccttcacattcctttaagttgtattcgtaggtagtttattctctttgtagcaattgtgaatgtgagttcacgtattatttggctctctgtttgtctcttattggtgtataggaatgcttgtgatttttgcacattgatttttttatcctgagattttgctgaaattgcttatcagcttaaggagattttgggctgagaccctggggtttctaaatatacaacatatacagtcatgtcatctgcaaacagagacaatttgacttcctctcttcctgtgtgaatacctttatttctttctgccctggccagaacttccaatactgtgttgaataggagtggtgagagagggcatccttgtcttgtgctggttttcaaagggaatgcttccaatttttggccattgattatgatattgactgtgggtttgtcataaaaaactcttcttattttgagatacattccatcaatgcttagtttactgaatttttagcatgaaggggtgttgaattttattgaaggccttttctgcatctattgagataatcatgtggtttttgtcattggttctgtttatgtgatggattacgtttattaatttgcctgtgttgaaccagccttgcatcccagggatgaagctgacttgatcatggaggataggctttttaatgtgctgctggatttggtttgccagtgttttattgaggattttcgtattgatgttcttcaggaatattggcctgaaatgttctttttttattgtgtccctgcagggttttggtatcaggatgatgctggcctcataaaatgagtttgggaggagtccctctttttctgttgtttgaaatagtttcagcaggaatggttactgctcctctttgtacctttggtagcatttggctgtgaattcgtctggtcctgggctttttttcgttggtaggctattaattactgcctcaatttagaactggttattgatctattcagggattcgaattcttcctggtttagacttgggagagtgtatatgttcaggaatttatccatttcttactagagtttctagtttatttgcatagaggtgtttatagtattctctgatggtagtttgtatttctgtgggagatcagtggtgatatcccccttatcatttttgttgtgtctatttgtatcttatccctttttttctttattagtctggctagtggtctattttgttgatcttttcaaaaaagcagctcctggattcattgatttttttttgaagggtttttcatgtctctgtctccttcatttctgctctgatcttaggtatttcttgtcttctgctagcttttgaatttgtttgctcttgcttctctagttcttttaattgtgatgttagagtatcaattttagatctttcctgctttctcttgtgggcatttagtgctataaatttttctctaaacactgctttagctgtgtcccagagattctggtacatttgtgtctttgttctcattggtttcaaagaacttatttatttatactttaattttgttacttacccagtagtcattcaggagcaggttgttcagtttccatgtagttgcgtggttttgagtgagtttctttttttttgttttgaggtggagtcttgctctgttgccaggctggagtgcagtggtgcgatcctggctcagtgcaagctcttgagtgagtttcttaatcctgaattctaatttgattgcactgtggtctgggagactgtttgttgtgatttccattcttttacattttttgaggagtgttttacttccaattatgtggtcaattttagaataagtgcaatgtggttctgagaagaatgtatattctgttgatttggggtggagagttctgtagatgcctattaggtcaacttggtccagagctgagttcaagtcctgaatatccttgttaattttctgtcttgtttatctgtcaaatactgactgtgaagtgttcaagtctcccactattattgtgtgggagtctaaatctcttcgtaggtctctaagaacttgctttatgaatctgggtgctcctgtagtgggtgcatgtgtttttaggatagttagctcttcttgtcgcattgatccctataccattatgtaatgcccttctttgtctcttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttrtatttttagtagagacggggtttcaccgttttagccgggatggtctcgatctcctgacctcgtgatccacccgcctcggcctcccaaagtgctgggattacaggcgtgagcgtctcttttgatctttgttggtttaaagtctgttttatcagagactaggattgcaacccctgctttttttttgctttccgtttgcctggtaaatattcttccatctctttattttgagcctatgtgtgtcttagcacataagatcggtctcctgaatacagcacaccgatgagtcttgactccatccaatttgccagtctgtgtcttttaattgtggcatataacttgtttacatttaaggttaagaagttctcctggataatatcctaaagagtgttttccagcttggttccattctccctgtcactttcaggtacactaatcaaatgtaggtttggtcttttcacatagccccatatttcttggaggctttgtttgttccttttgattcttttttctctaatcttgtcttcatgctttatttcattaagttgatcttcaatcttggatacgctttcttctgcttgatcgattcggctattgatacttgtgtatgcttcacgaagttctcgtgctgtgttttttagctccatcaggtcatttatgttcctctctaaactggttattctagttagcaatwcatctaaccttttttcaaagttcttagcttctttgcattgggttagaacatgctcctttagcttggaggagtttgttattacccatgttctgaagcctacttctgtcaattcgtcaaactcattctccatccagttttgttcccttactggcaaagagttgtgatgatcctttggaggagaagaggcattctggtttttggaattttcagcctttttgtgctggtttttcctcatctttgtggatttatctacctttgtgttttcatgttgacctttggatggggtttctgtgtggacgtcctttttgttaatattgatgctattcctttctgattgttagttttccttctaacagtcaggcccccctgctgcaggtctgctggggtttgctgcaggtctaccccagagcctgtttgcctgggtattaccagtggaggctgtcaaacagcaaagattgctgcctgttcctgcctctggaagctttgtctcagtggggcaccttccagatgccagtcagatctctcctgtatgaggtatctgtcgacccctgctgggaggtgtctcccaatcaggaggtacaggggtcagcaacscacttgaggaggcaatctgatgcttagcagagcttaagcactgtgctgggagactccctgctctcttcagagctggcaggcaggagtgtktaagtctgctgaagctgcgcccagagccaccctttcccccaggtgctctgtcccaaggagatgggagttttatctataagcctctgactggggctgctgcctttcttttggagatgccctgcccagagaggaggaatgtagagagtcagtctggctattgtgcctttgctgagctgtgttgggccccacccagttcgacctttctggtggctttgtttacactgtgagggggagaaccgcctactcaagcctcagtaatggtcgacacccctgcccccaccaagctggggtgtcccaggtcgacttcatactgctgtgctggcaacgagagtttcaagccagtgggtcttagcttggtgggctccatgggggtgggatccactgagctagactgcttggctccctgccttcagccccctttccagggagtgaacggttctgtctcacaggcattccaggtgccactggggtatgaaaaaacactccagcagctagcttggtgtctgcccaaacggccatccagttttgtgcttgaaacccaaggccctggtggcataggcaccaaagggaaactcctggtctgcagattgcaaagaccatgggaaaagtatagtatctgggctggagtgaaccgttcctcactccacagtccctcacggcttcacttggctagtggagggagttccctgaccccttgcacttaccgggagaggcaatgccccaacctgctttggctcatgccccaccctgctttgtctcactgtctgtgggctgtacccactctctaaccagtcccaatgagatgagctgcgtacctcggttagaaatgtagaaatcacccatcttctgtgttgaccttgttgggaactgcagactggagctgttcctatttgaccatcttgccagccacctttttttttttttttttttttgagatagagtctctctctgttgcccaggctggagtgcagtggtgcgatttcagcatattgcaacctccgcctcctgggttcaagcgattcttctgcctcagtctcctcagtagctgggactacttaattttacattgttaagagtaaacagggttctgtattctgtatataaagaactgacataaggaagcatccttgagtagtggaaatgggttttctaaccatggctttagtatttaaatcttctgtacctctaatttcttacatagtaagtggaagttcaacaactggaagatctctgtggtctttagcgtcctcaccctctctctatgctttctcrttcagcaaacatttgtcaagtgtctactctgtggcagaatttgtgtaagaacttggggatagtctgtcttcagatgagctcagagtctagtaggagagaggggaaagggacaaaagagaaaaaaaagcaatacttgtaagtcaaccgttagaagccagtgtggtgagtgcctcaagagtgataatcacttagtggtggaccactgaggagcctcccactgggggtcagggtgcagtgggggaggtctaggaagatttcttggtagaaatcacatttaagtaatcctcaggtagtcagccaagtgtattaatgggcaaatggcattttatgacaaaagctacttggtaatcatttcatgcttgaaattttggataaatgaattgctaaagatgaccaagcaagaaaagactgcaacgctttttttctttattacccatggccagatttcctagttattttctcattgcaaaagaatgtgaaacaaactgattaagtgtaaaataactcttaactcttatttagactatcrtagtcatcttcaaaactctttgagatcatcttgagaattcacagttttctattctttttgttgctagcaggtgaaattatgtacctttggaaccctctgtatgggtcagtctgtggtactcacagtagtctttatataggagtgtttgcatgtgattgcaggtcagcggagaagcaaacaaagcaataaccaaaaaaggtgtgctgaaagttgctgtttcaactcatagacatagtaatctagttgaagtattttaacaatctcttcagtgctattcagaagacaaatacattgaactttgttaatctattgagattttcaggatttttaaattggttaggatataagaattctttcttcctaagtttttccctttgctttcatagtcatttcctttaaaacctgatttaaagctttgtgttgaagaaggcttccatcattacaaactctccttatgcaatttatttacatacttcagtacaacttattacccagtttgtattctcataatgagttgattctaaattaaaatacagagatatttctgttatggccatgatgacccaggcacacatagaaggtggctgtgggatgtgaataataatgcctaattttaattcataaaagcagttgtctgttttttcatacaaccttggtattgtactgtacttattactggtcttttgtactgtgtatatatggtcttgttatttttattaggtagtttatctaagttttagttctagttatgtaagtggataagattcacattgattttgactttcatgatttattacattaatgcaaatcaaacattgaccagagagaaaagcaacaacctttcttagatgaaacaatgcattcctaacttatgctgttaggaccaattttttttttttttccctgcaaatgtgacaggcttcttgttctctagcagtgacctctaccttggccctgactcagctggtatgatggttctttgtgcaaatattttctcaaccttcaatttgtcacaagtagctaagcattatccygtgaataatagatttatgattttgctagcattagcacagtgactaggatactaacttattccagctgtgtttcctgggtttgagttttcttcccaggaactggcctttctgagcaagaagagaatgaatggccgattaagtagatttgcagtaggtgtacactggcagcctagaggaagattaatctgaagacaggttgagagcacctggaacattttaggatttagrtgatctgactattaagtgttgccaagtcatgggacctggtaactaccatgttactgatggggagactggatcttagagagttagaggatcttgtcaaaaagtcatcccattctaaatttaatacactcttactgaatccaagtttcatgttctttccattccataacagttataaagaccaatggaatgaatagattcttaatggtaaggaaataatgacttcctggacacaatatatttttaaaaaccggaagtagaaattacttcgtacttttccaggatgtttcagtcatttaaaacaatgctgagatttcacttccttcacttttttgctttatgagattttgtcccttgtcttaaatactgtgaaaacaagaaacctccacaaaatattgaagcaagaaatatatctaccacatcataaaaataatgtgtttttatattttggttattgtttactaagttattttctaccttaggttataaactagagttgaaaagggctgaactgcttatttttaaaaagtgatttaataagattattgtttaggagatgtagagagaatgataggctaaaaaaatgccttgaattgtaatgatgtcatgtgttgagaaccaaaaagcgagtttgggacttaagcattcccttgaagaatagatggataagaaaaaaagtgaacgttatagattttggagagttgaactgttggtggtggagaatgacagactaaaatgaatatagtaagtgagataggaattagcatgttgaatgaacatttgtaatcagagtagataattcataggggacaagagagagatagggattagatagtgtcagaattaggaagatgacctttatttatggtatataagtcaagttatagaacagagaaaacaaaagtggtgttttagaaattttattttttttctttctttctttttttttttttttgagaaaatgtctcgctctattgcccaggctggagtgcagtggcacaatcatagctcactgttgcctcaacctcaaggctcaagtgatctttccatctcagcctcccaagtagctggaattacaggcgcatgctgtcacatccagctaattttttatttttcgtagagacagggtctcattatgttgcctaggctggtctcagactactgagctcaagcaatccttccacttcagcctccctaagtgctaggattgcaggcatgagccactatgcctgacctcagaaattttaatttgaggaaatgtagacaccatttaggaaattgattgtggttttaggatcctgcactctggcaacaatagtaggctttgagagatgaaggatgtgatattggatgaactgcatgagttaaggatgaatctgagatagaggttctgaaacttgagtgtgtattaggatcgcctaaggagcttggtaaggttctgattttggcaggttgggtaagaggacagaaattgcatttttaaaggcagtctcggcatttctgatgtaaatggtaaacaagttcctagccagagacaccaggataatcatagatagagaaatggaaattaggagaatagttttataagatgaaatggtaagtttagttttggataagttgagtgttatctttatatattgcaatgagtttgatgacaggacatccaaatggaacgagctgtccaataaaaatagatctttgtgttggattgtagtgtgagagtggatgatgtatcagaggaaggtgttggaaaaagaacaagagcatgtccttttcttctgattaattcatctaagaaacactggggcagtgatgggtctctttagttacgtcaggtcaacacagtttcattcttgtttctcttctaaaaaaacattgacgcttcttgttttattttcttaactcctgggaaacgtacataaatgtctttgccacagtcaagctggtcttgactggataacagcattttcaatcactaaagtcagctatttgagttgttcagtagaggcacattaaaataactcataaataagtcaagacaagttatagagaagagaaagttatagagaagagaaaacagaaatggtgttttaatttgaggaaatatagacaccatacaggaaattgattgtagttttaagatcctgggctctggtaagcagtaatagaatttgagaggaaagtttatagtatctgatatgtccctatatataaatgattcttaatccatatttttcaggacccttagggagcttttcagataagtttagctagcatttttaaattattgaaaaaatgaactcttctcttaatttggaaaaaaaatactgtgttgcagtctttagaagaatcttagtatataacatactctggtctcaaaatcaaataagcagtgacattgtgctataacctaaaaattgatatgaatcactgtgataaaggaagtttactctagtttattcatagatgaagaaaagtagcctggtagcttgaagctgttcttttagctttgctgcagatttataaaatgttcaacatttccatttacctctggacaggctgtagttttttttgttttttttttkttttttttttttttaaggattaagatccttgaagctagaggtctttgaaactgcatctgagtggaagaggtctagtgtaaagtgactcattcttaaacatattcagaaatgctgtgggccaaattgaatcccttgaaatataacctgtatacacagtttccagaacatgagctagttgtgtttcagaagtttatgtgtaagacagctgtttggaactcagaacacattttttttttccttattgaagcagtacaaaaattactggctatgttcccaggccagttcacaaatatttttcacccaaatgtactttaagtattaactgtacaatttccatttattgagttgatatttttgtttctgtgggaaaatatatcccaaatcagtttgaaagaaataggttatctttgcttagctggattggggtcttctcagaagatgtcactggtcattcataaaaaccagtaatttattaattgtacatttttaaccccttcctctcaattataaaggtacaatttcaggttattcattcccctagtgattactattttagaaagtagccccggtttctctgtcttcctctttctttactttctcttttctctctaaatgttgggtcattattaagtttatgtctctatatcagggattgtgtgttcaggtttggttacaaaatggttagtgctcctgtawtttttttagccagcattgattaacagagttaatcactttctgtctttaaaagagactgataagggcttatgatataaagtttatttgggaaattatctgttatctgtcaagtatggtgatgactggtattgtacaggacagaaaactaaaatacctactaaattattaataacataaaataatacaaaaattattacggcattgtttattatgttggattttagttctttggtgagtcatgcataatacattatctgttatatttaacatgttttattcttttttttttttttttgagatgaagtctcgctctgtcacccaggctggagtgcagtggtgtgatctcggcccactgcacctctgactcckgggttcaggcgattctcctgcctcagcctcccgagtagctgagactataggcatgtgccaccacgtctggctaattttttrtatttttagtggagacggggtttcagtgtgttagccaggatggtctcgatctcctgacctcgtgatccacctatctcagcctaacatgttttattcttaatgcatattttgttttgactggttgtggttggtgaatatatgtgttcattaaataaaagaggttctttttagcagggagtaaggctgttttaacttcagcctcagggaatgttttactttgatgggatggctgttattttgaatggaatcaaggatctggaatcttttatttattaatcattcactctacatgtatttattgagtatctgcttggtgtcaggctctattctaggtattggggatactacagtgaccaaaacagacatggtcccttctttatgtaggttatattcttgctggggatctagagaataaatgagaattgaataagtaagtgtgtgttgcgatatattgggaaggtagatccaacttggctaacagattggctatggtatatgagagtaaaggatatcagccaggtttttggtctaaacagctagaatcctgtaattgcctttccctacagtggggaagactgaaggatatgggggcttgtgggagtaagaggggatcaaggatatggtttttacatattaaacttgaggtgcctgttagacattcaaattgaggtgttcgaaaggcagtttaggggagatgtctgggttgaagagaaatttggcagttgtcactagagagtgaatataggaaaagaagagattcgagtcacaagccccagagctctccattattgaggggctgggaagacaaggaatcagcaaagtagaccaagaagagcaactgtgaccatcaagaatagctgaggtagatggttccccaaaagccaagttaagaaacatgtttcaagaaaatggggtgatcagttttgttaaatgttgctgatggttcgactaagatgagaattgaccattgagcaacattgaagacattggtaatctttgaatggagtcattttcatggagaggtgggacaaaagcttgaatggggtgagttcaggagagaatttagaggagataattaaattgaagattaacaagtcagactgtttatcaatctgtagacaattgacaatgagttcctgagaggatggttgggatatgaggccaaatcaggggatatagagaatgttatggtgataagaggctaggtggtgaaggatgacttgggtatcttggtcttctttttcattttcttttttttttttttttgaaatggaatcttgctctgtcacccaggctggagttcagtggcrtgatctcggctcactgcaaccactgcctcccaggttcaagcgattcttctgcctcagcctcctgagtagctgggactacaggcrcgtgccaccatgcccggctaatttttgtatttttagtagagatgggatttcaccatattggccaggctggtcttgaatccctgacctcatgatccacccgcctcggcctcccaaagtgctgggattacaggcgtgagccaccatgcccggcccatcttgggcttcttgtggtgactgatatgaaggggataaagtgagtgtttagctccagtgtcttcaaagtagattgtgatgcaaagcctgtgaacgttgagggatagggaatggggagtggcataattctcctaggccataaagtgatttcttataagatacctagctaaggaataatctaggagagtaaattgtttcagtttacctgagattgaattgtaccaaaaagccaaattatggctatctactaaatatagagcctgcatgtttttaattgatttatgattatagagtagactaaatttttatgtgacatgtaaatggctactgaaagaataaatgcttgaaagactgaataaatattacagattctccttcagtaaagttatgaaagcctgataaataattctaggcatgatagtatttttcctaaaaacttactccttttcttggaggctgcttaaaaattttacattgccaattcatttctcgacacttttttctatcttgatcttttttttgtgggctgcattcattttcattcagtggtttcttcgctgagtgcttttcccaaaataaacaccagtcatatttagaatgaaataatgacctagtgtaagtattctgaatactgtttcaacttttcaacatttctgaaaattctagactgatttattttccagaatccatttaatttagatgttcagagtagtgcttcttcttaaaacatcaacagtttttgttttgttttgtgagacacggtctcgctctgttgcgcaggctggagtgcagtggcgtgatctcagctcactacaaccttcgcctcctgggttcaagctattctcctgcctcagcctcccgagtagctaggattacaggcatgtgccaccaggcccagctaatttttgtatttttggtaaagatggggttttgccatgttggccaggctggtctcgaactgctgacctcaagtgattcctccgccttggccccacaaagtgctgggattataggcatgagctaccatgtccagccaacatcaacatttgtagtgatagaatttgagttgtttagatcaagtttatggtgctttctgggcaaattctgaagggagagacagttggtttactattagagtttacttgtttgagcaaactcttttattttgttaatcagatttgtcatatatttgtagtgccagattacatttttagtttttctgcaataaattgtattaaattcagtttattaatagccaggtatatcctgtatatctccattagtgagtctttataggagagtgtagctgttaatcagtgctgtctctgtgaattttcttggagatctctcaatgggatttgtggtttgagtgtatcacccttaggtttttacaaaagataataagcactaatgttaaatgctacttagcaaatggatgcaaagctttgacagtaattttaggttatttctagatagtgtggacttaaaaaaagytttttagaaagctgttttcagttgacttagagttacttgtaatctgttattatcaaggtcaccccatggaagatctctgaatacccaatgaggcaagtgtcattattacctcttaattttctccaggggaaacaccaaattctgtggtggcttaggtgaaggagtaaggctctttactcagcttttgtttttaattgtaactgtgcagatgtctcmtatgtcctatggccagttatttaaaatagtgaaagccaaatgctagtttggtggtgtgcaggcataactcaattatctgacaagagaaaaagaatggttgagtatatgttactttggttgacaatgttaaaggtatttttttttggttttggggtacctttttagtatttacctgtaaggattgaaatattaagtcagaaaattcataatacttgtgaattggtataattgtctagactaatgcttcttttaccattggcgtaattgtctagattgatgcttgttcttaaaatttggccacaactctacactctaagctggggtgtccaatcttttggcttccctgggtcacactggaagaagaatcgccttgggccacacatgaaatatactaacaatagctgatgagctaaaaaaaaaaaaaaaaaaatcacagaaaatctcataatgtttaagaaagtttacgaatttgtgttgggccgctttcaaagccaccctgggcctcatgcggcccgtgggccacaggttggacaagcttgctctaagcagtgcattggcacatttatgtgcgtgtgtgtgtattaatattgtattaatattacagttatatatataaaataaaagtttcatgaaatagtacttacttttacattgtacagtacattctaatacttttctagctgtttataaaatattcagtttttgagacagggtctcactctgtcgctcaggctagagtgtggtgacgcaacctcctgggctcaggtaatcctctcacctcagcctcccaagtagctgggactacaggcgcatgctaccatgcccagtttagtgtttttttttttttttagaaaaagttggacatgagctaaattgatttcataacccttactgagtcataacttgctttttgaaaaatcctggcctaccttatctctgaggtgccgcacaactatggagtatgttactgtgacagtgtacataaaaataacttctttgatctgggttcttatgagaaggataaaaatattgaatattactcaaagcccactgaccataagaaagtgatctctaccatcagataattttaaaaatgcatatagaagagtcatatatttgtataactaatctttgttgagtggcatctgtgtgccacgctctgaacttaccactgcctatttgaaggtgaacaaacaggccgtccttatctccaggaatttcagtgtagtggaagagataataagcaagtgaataaatatttgtaaattgctgtgcagctgtgctagagaataatgggagatggttgcttgctcacagtttttcatcatctcatttgtatctagcttaaagaagaaaatgtgagctagaagcttaggtttttggtctcagatgtcacattctttctgttgagtagggtacccttgttcccataaaccttcttaggcagggggcccagtgtacttatttatttattttttttgagacacagtctcactctgtcgcccaggctgtagtgcagtggcaagatctcgatctcggctcactgcaacctctgtctctcaggttcaagcaattctcctgcctcagcctcctgaattgctgagactacaggagtgcgctaccgcagccggctaatttttgtatttttagtacagatggggtttcaccatgttggccaggctggtctcaaactcctgacctctgatgagcctgcctcagcctcccaaagtgttgggtttacaggcatgagccactgtgcctggcctacgttttttttaaaaaaaacttattattacagataattatcttgtgggcatmttttcaccttgtattacagataattttcttttcaacctccagctggtgttattttcaggtgaagtcttcatcttaggctattatacatacatatgtacatatattctaatacaattttgtatttcttgtcttttcacactagtgtccatattttcatagcagtcatgaagcaaaattgaggttgttacaagttgctgtgattattacagagaagagtttctttttttaatttaatttaattttttttaattatactttaagttctagggtacctgtgcacaaygtgcaggtttgttgcatatgtatacacgtgccatgttggtttgccgcacccattaactcatcatttacattaggtatttctcctaatgctatccctcccccaaccccccaccccactacaggcctcagtgtgtgatgttccccgccctgtgcccaagagttctcatcgttcaattcccayctatgagcaagaacatgcagtgtttggttttccatccttgctatagtttgctcagaatgatggtttccagcttcatccatgtccctacaaaggacatgaactcatcattttttatggctgcatagtattccatggtgtatatgtgacacattttcttaatccagtctatcattgatggacatttgggttggttccaagtctttgctattgtgaatagtgccacagtaaacataggtgtgcatgtgtctttatagtagtatgatttataattctttgggtatatacccagtaatgggatcactgggtcaaatggtatttctagttctagatccttgaggaattgccacactgtcttccacaatggttgaactactttacagtcccacccacaatgtaaaagtgttcccatttctccacatcctctccagcacccgttgtttcctgactttttaatgatcgccattctaactggcatgagatggtatctcattgtggttttgatttgcatttctctgatgaccagtgatgatgagcattttttcatgtgtctgttggctgcataaatgtcttcttttgaaaagtgtctgttcatatcctttgcccactttttgatggggttgtttgattttttcttgtaaatttgtttgagttctttgtagattctggatattagccctttgtcagatgagtagattgcaaaaattttctcccattctgtaggttgcctgttcactctgatggtagtttcttttgctgtgcagaagctcttcagtttaattagatcccattttggcttttgttgccattgcttttggtgttttagtcatgaagtccttgcccatgcttatgtcctgaatgggtattgcctaggttttcttctagggtttttatggttttaggtctaacatttaagtctttaatccatcttgaattaatttttgtataaggtataaggaaaggatccagtttcagctttctacatatggctagccagtttccccagcaacatttattaaatagggaattcctatttaataaattcctcattgcttgtttttgtcaaatttgtcaaagatcagatggttgtagatgtgtggtgttatttctgagggctctgttctgttctattggtctatatctctgtttttgtaccagtaccatgctgttttggttactgtagccttgtagtatagtttgaagtcaggtaacttgatgcctccagcattgttctttttgcttaggattgtcttggccatttgggctcttttttggttccatatgaactttaaagtagttttttccaattctgtgaagaaagtcattggtagcttgatggggatggcattgaatctataaattaccttgagcagtatggccattttcatgatactgattyttcctatccatgagcatggaatattcttcaatttgtttgtgtcatcttttatttcattgagcagtggtttgtagttctccttgaagaggtcgttcacatcccttgtaagttgtattcctgggtattttattctctttgtagcaattgtgaatgagggtacactcatgatttggctctctgtctgtctgttattggtgtataagaatgcttgtgatttttgcacattgattttgtatcctgcgactttgctgaagttgcttatcagcctaaggagattttgggctgagatgatgggattttctaaatatacaatcatgtcatctgcaaacagggacagtttgacttcctcgtttcctaatcgaataccttttatttctttctcttgcctgatttccctggccagaacttccaacactrtgttgaataggagtggtgagagagggcatccctgtcttgtgccagttttcaaagggaatgctttcagtttttgcccattcagtatgatactggctgtgggtttgtcataaatagctcttattattttgagataggttccatcaatacctagtttattgagagtttttagcatgaaggsctgttgaattttatcgaaggccttttttgcatctattgagataatcatgtggtttttgtctttggttctgtttacatgctggattacatttattgatttgcgtatgttgaaccagccttgcatcccagggatgaagcccacttgatcttagtggataagctttttgatgtgctgctggattcggtttgccaatattttattgaggatttttgcatcaatgttcgtcagggatattggtctaaaattctctttttttgctgtgtctctgccaggctttggtatcagggtgatgyttgcctcataaaatgagttagggagaattctctctttttctattgattggaatagtttcaaaaggaatgggaccagctcctttctgtacctctgatagaatttggctgtgaatccatctggtctcggagtttttttggttggtaggctcttaattattgcctcaatttcagagcctgttattggtctattcagagattcagcttcttccttgtttagtcttgggagggtgtatgtgtccaggaatttatccatttcttccagatttcctaatttatttgcatagaggtgtttatagtattctctgatggtagtttgtatttccttgagatcggtggtgatatcccctttatcattttttattgcatctatttgattcttctctctttccttctttattagtcttggtagtggtctatcaattttgttgatcttttcaaaaaagcagctcctggattcattgatttttttgaagggttttttgtgtctctatctccttcagttcttttctgatcttagttatttcttgccttctgctaacttttgaatttgtttgctcttgcttctctagttcttttaattgtgatgttagggtgtcaatttttgatctttcctgctttctcttgtgggcatttagtgctgtaaatttccttctacgcactgttttaaatatgtcccagaaattctggtatgttgtgtcttcgttctcattggtttcaaagtacatctttatttctgccttcattttgttatttacccagtcgtcattcaggagcagattgttcagtttccatgtagttgtgcagttttgagtgagtttcttaaccctgagttctagtttgattgcactgtggtctgagagacagtttattatttctgttcttttacatttgctgaggagtgctttactatgtggtcaattttggaataagtgcaatgtgatgctgagaataatgtatattttgttgatttggggtggagagttctgtagatgtctattaggtctgcttggtgcagagctgagttcaagtcctggatatccttgttaaccttccgtctcgttgatctgtctaatattcacagtggggtattaaagtctcccattattattgtgtgggagtgtaagtctctttttagatctctcaggacttaccttatgaatctgggtgctcctgtattggatgcatatatatttaggatacttagctcttcttgttgaattgatccctttaccattatgtgatggacttctttgtttcttttgatctttgttggtttaaaatctgttttatcagagactgggattgcaactcctgcttttattttcttttgctttccatttgcttggtacatcttcctccgtccctttattttgagcctgtgtgtgtctctgcacgtgagataggtcttagaggagagtttcttatgattgagggcacttgccccaattcttctctattactctataaaaaaatggaatcataaaattttctttcagattgttaaatattcttcaacttaattttaatagctaatggcaattgccatgtatggatggatatgagaaagttttcagaaaaatgagatatttatcttgaggaagatttggctgktgggaggaggagacataatagcttttttcagatattcagtgtaagtgagtttgcacaagttttaaaatctttggaagctaacttgatatcagcaagcaaaaaatataatggagaaaattttgatggttggggaaagtttgtagcactggttttggtgaataatatgttaggtaggttctttcaaggttgtgttatacttttaccactaccattattttctttttagttaaacttgcatttccattgctcaaattctagaagaacctgttctgttgtctcttccttttccaatattcttgtccacttgacttcatgctctcttataataaaattattaaaattattgttacatggattaaaatattgacattcagaaatagattcatgcttctctgcaacatggatgaacctggaggacattatactaagtgaactaagtcaggcacagaaagataaatactgtgttctcactcatatatrggagctaaaacatgagcggatagaggtagagagtagaattgtggttattagaggctaggagaggttggttaacagatacaaaattatagctagaagagaggaataaattccagtgttgtacagcaatgtaggatgattatgggtaacagtaatttagtgtatattttcaaaaagctagaagattttgaatgttcacagcacaaaatgataaatgtttgaggtgctgcatatcttaattatccagatttaatcattatacactggatacacaggcattgaaatagcacactgtattccatgaatatgtacaattattatgtgtcaattaaaaagaaaagggaaaaagaaatagatttatgattttgacttttgaatagactatatacttttaaaaagctgctgctgcttctagttttaggtaactttgttttgtcttttttattataagawtggcttatgccagatctttaatgttgtaaaagtatccattgctcaccagccatataggagctggccagtagggtttgggcagcagcctttggtgtggagctgttctcttgtcggggtatggattgggccacttttctcttataattgataacatgaactatccagttccttggtgatctcaaagtaagagaccagtgaagtttaggaataaaaataaaatgtttgcaaatggtcagaaattgataaaatatcaaccagaggagaacattgtgtggttgacaaagtagggaatatttgtcgttttcaaacctttttctcttttaaacctagctttggctgtggctctgctgtttatgtcacataaagtaattcattctgttgtgtcctattcagcagataagcagcgtctcaaaatttatttaaaagaaaaaattgtaaatttagtgaaactgcaaatatggttgaagatttagaaattaaatcctattaagaaaacagtatcttaactatatagataaagtaatactccttttgcatcaagtgtgatagtaggagaggaggtatttcttccagtaaaaatcaagatgtattcrtatcctttgagctagtaagcctacttctcatagtgtattctatgtaaataattcaaaaggatgaaagttctctgtagcgttatttaaactagtgaacagtcacatacccttaccctaaaagtgacacattttaggtatcttccctgaatgctattttatgcaaccattgaaagggatatttatgaaattatttatagtggtatgggacatgtaaaaatgttttataaaatgcaatttgtacactattatgtatgagccattttttaactttaaaaagatgttctcttcttttgaaaacatgtttagaatagttgttagcttatttgctaacttactattattgttttttctcaattcctccttatcttattacatacatttgagatgttattcagatttccagctttattctctttgtaaaatattaactgtcatttgaagtacagttcttgtcatgttttgcattgtaagtcacttaatattctaacttaaaggtgataaaacacatcctactgtgtataagttttatttatttgattaaaaaaatagttaacacagtaaatacttggaattggatcagaggttcattaccctggacacttgtgggctaaaggcctaggaatttttcatctgtttccagatgggaaactctgcctgctgatgtttggtctttattacaattaaaataccagaaaattttgttagaaggagatattgggaatatgaagacataacccaaatatgtgtatattacaattctggaggaaatacctcagttaaaacaaaacaaaaatcaagaatattaaaagtcttttataatttgacaatagatcctccatatcttctcatattctggtgcttattttacatatttgtaacttaagtatttaagaagagacctttccaatttattaaaaattattggataagacaccagctcaacagtttagtaagttttttttgttttagtaatgtttccaagtggtgacactgtgtgtatttaagtaattagtgaattggagggatgagccaatttccagcagatctgattagatctgaaaactaggctaaataattcctagtgagtatagaaacagaatttgagtgtctgaattatgtaggtatttacttctgttacattttcttaacctttattgaaaacagtggaaaagtgaaatgagaaacgtctactttctaaaaaaatgaaaataagaagttatgagtcaaaatatatgttgagagtaaaccattctgtaggtgyaaagtaggcagagtttcagctttagaatagatgtaatacaaatacatatacatatacttatactgtttcatatcctaacatcctggattgataacctgcctcccaccccataatttagcctgattttttttttcagtccttagctgttcaggagttttaaaatttgcattaaatcttttaggttattttactcccatgtaaaactactgattaaatttggtgaaccctttgactttacaacagaaaacaatcaaaatagttaactctaaaacaatggttatcacagttttgaggactcttttagtccagtagctttcagattttagcttgcatcagaattacctggaagtttggttagaaaagtaggtctaaatgtagcctgagaatgtgcatttctaacaagtttccaggtgatgttaatgaggctggttttagaaccatatgtgaaaaaaaaccccactgacttagggtttcaaagagatgtaaaattaacactcttatctagatacaaatratgagttatctaagtattgaacacattttgaagattttatttaagtcattaatgatggaactagtcagatattataaacagttcaaagaagcacaaatttatgtggagtaaaggatattgaactaaatttccaagtggtcagcaaactgactttctattgggggtagtcagttgaacctccatgggacagaattttcttgcatgtctccagactagaataatttacattgctctcagttatctacagcagttaatcaacaatttgagttgcagtatagctcgaagtcaatgaaaagctagaattagaaaacgtggaaggttttgtaccacaaagtccatattttttcatcttgagtgcactgtcatcttttttctcattcccaatttccttacagtggctttttaccaaactcctcaggtgattctgatgcagtctgaagtttgagaaccatcggcttaatgtaacagacaaaatatttagtatatttgtaatacttatttactaaatcatgttttcttatacaacttatttcttatacarattatttcatacgtagccagttcattatttgaaaaatcaaggtcagattgcccctgttagctgatattttaacctcttgattgcctataaaggaattaaatatgcatttatataataaagtagttgtgaagtttttgaacataattagaaaaaagactctttgttgatcgagtayaaaatgtgcttcatgaagcgtttgattagttaaaatatgaaaaattttagttgaagagcttttaatagggcttatctttagtcagtcattttatacataataaaatgcctctcacaattctgaaaggacctagcgaatttaagaagctgggtgatgtaatataaagagccctggatttaggaggtcagtcttagtttattccctttttgtagctagtaagttatttaatttgtaattcacaatggtggtgagggcataaagataaatgcatcacagctcttgtgatgacataagtgcttgctttctggatttcagttttctcatgtgcaaaataaggattatagagccaaatgagacccaaggttgtcttaagcactaacattatgtgatactttgaatattrcacagtggaaaacattaaacaagtgtgtgctaaatcggagttgttcaccatttctctctcatttttcttttttttaacttttaaaactgacacgtaataattgtgtatatttattgagtacataatgatgttgcatatcagggtaattagcatatccatcacctcaaatatttatcatttctttgtgttgggaatgtttaatatcctctttctagctatatgaaactatgtattattgttaaatgtattcattttacaatactatagaacactagaatttactcttcttatctagctgtaattttgtattctttaacaaatctctccctttcccttccttgtgcttccccttcttagcatctagtattttctgttctactttacttctatgagatcaacatttttttagcttcctcatatgaatgagacatgtggtrtttaactttctgtttttggcttattttacttaacataatgtccrccagttccatccttgttattgcaaattacaggatttccttcttttttatggctgaatagtactccattgtgtataaatacaccacattttctttatctctgttgtcggacacctgatttaatttcatatcttggctattgtgaatagtgctgtagtaagtaagtatagggttgcaggtgtctctgcaatatactgatttcttttcctttggaaaaatgccccagcaatggtagttctatttgtagttttttgagaaacttccatactgttcttcatagtggctgtactagtttccattcccaccaatagtgtatgagttcccttatctccccattcttgctagcatttgctatgtcttgtctttttgataatagccattttagaatgagataatacctaattgttttgatttgtaattccctgatgattagtgatgttgagcattttttcctaaattggttggcaatttgtttgtcttttttagggaaatgtctgttcagaccatttgcccatttttaaattggatcacttgcctttttgtttgtttttctgtttgagtttcttgtatattctggatattaatctcctgtcagatgaatagtttgaaaatattttttcttattcaacatgttatctcttcactctgttgattgtttcctttactgtgctgaggctttttagtttaatatagtcccatttgtttgtgtttgttgcctatgcttttgggagtctgattggtaatagttcttcttttcttaatctttattttttctttcctttttattttcaccactctttatatttttttagtttttaaatttttgagacagagtctcgctctgtcacccagggctggagtgcagtggcgtggtcatggctcaccgcagccttgactttctgggctccagtgatcctcccacttcagccttccgagtagctgggaacacaggttcacaccaagacacccagctaacttctgtacttttggcagagatgaggtttcgccatgttgcccctgctgttcttgaactcctgagctcaaacgatccacccgccttggccttccaaagtgttgggattacaggcgtgggccagtgcacccggcctgttgtcaccactcttattcaaagtttctccttttaaaattgctttattgaggtatagttgacatccaatgtactgcacgtatttaaagtatactatttggtaagtttaaacataatgtataccctatgtgatcatcatagcaatgaggaaaatgaatgtcacaccccaaagttttctttgagtccttctataatcttcccttcccccacttcagacaactactgatacgcttcctgtcataatagactagtttgcattttctaggattgtatataaatggaagtacagagtatgtactcttttttaaatccagcctttttgttcagcataattgtccatgttgtgcaagtatcaatactttctaacttcttgttgctagctaggattcttttttttatggctgtrccacaattcatttgtttgttcgcctgatgacagatgtgggaattgttttcagttttgggtattacaaatagagctgctatgaacagatgtatacaaattttaatataaacatgcacttttcttttgggtaatcacctaggagtggatcgtattgtaggtgtatgtttacttttaaagaaactgccaaactgtttttcaaagtgattgtaccatttttatattcccactaatagtatgtgaacattcaatttcctttacatccatgccagcacttgggctgggcagtctttttaaattttagccattgtaatagatatgtagtagaatgttactgtggtttcaatttagatttctctaatggctaatgattttgcatctttttattgcctttttttgcaatcatatgtgtatcttattttgtgaaaaatttgcttaaatattttytgattttttaaaaattaagttgttttcttactgttttaagagttatttattctgaatataagtaatatatttattctgaatattttgttgaagtccgctttagcaagtttttctttcatggatcatcttttggtgtcatatctaagaaatctttggttaatccaaggtcacaaatatattctactttttcttctagatttttgtagttttagttttacttttaagtatatgatgtattttgagttaattttatgtatgttgagaggtatggattagtatgtgtatggttttttttttcttttttgcatctggatatccagttgttcctgtaccttttttcaaaaagaccatcctttttctacagaattgcttctgtcaaaaatcagttttttatatatgtgtgggtgctctattttatgtattttatatatttctgggttctctattctgttccattgatctatttgtcttgtgttgatgccagtaccacattctgttatggtagcttaataataatccttaaaagcaggaacagttagcctttgaactgtgttcttttccagttgtttggctcctctaagtattttcwtttgtctatgaattttagaattagcttgtcaatttatacaaaagagcctgctggtattttgatttgtattgtttggaatctgtgaatcaatttggggagaattggcatcttagcaatatggagtttttgtgaacaagctgtagctctatttgtataggtctctttaatttctctcagcagtgctttctagtttctagtgtacatatcttacacactttttttttgctgggtttattcctaaatatttcctatttttgctgctaaggtagatggcaatttttaaaatttcaattttcggtgctagtatctagaaatgcagtgggttttaaaaatacttttattttatatcttttaatcttactggactctattagtagmagtagcttggaaattttgtcagaktttttacccagactgccatgttgtctgtgaataaagatacttttacatcttccttttctctttgctcgagttactgaactggctaaagcctccagctgaatgttggataaaaatggtgaagcagacatctttgtcatattcctgattgtagggatgtaggggaggaaaagaaatatcttttccttgcccattacaaggtttatggctgacatcctataacaaaagacagactgacaagagagaagcctaacaaatttatttaaccgaagttttatctgacacaagagccctcagaaatgaagacttaaagacccagggaaaactgtgtattttttttttcatwggtgcgatgaacaaataaatagtcatgtagaagtatgattggactgaaaagatataatctattgggatcatagaggaaacttagaaaggcctgtttgttcagattcttctgtgtcttcattccttcccgctgggtatagggcaggacaccagtcacatagggtcttcaggggagaaggtggggagaattctttttatggacccaggaagaaagggcgggagaagatcagagtgatctttgtgttcatgccaagatgccgtattttgggatataatgtcctgagccctgaaaaggaaaacactgagtctttcaccattaagtaagatgttagctggatttttaaaaaatgtactttttatcaaattgatgaagttcctttctattctttgttaaatagagagtttttattaggaataatgttagatttttaagttattaatttggttaattacattaattttttaaaaaactaattgctgggcgggtgtggtggctcatgcctgtaattccagcactttgggaggctgaggcagacggatcacgaggtcaagagattgagaccatcctggccaacatggtgaaaccccgtctttactaaaaatacaaaaattagctgggcatggtggtgtgcacctgtagtcccagctacttgggaggctgaggcaggagaatcacttgaacctgggaggcggaggttgcagagttgacatcgcgccaccacactctagcctggtgaccaaacgagactccgtctcaaaaaaaaaaaacacaaaaaacccacaaaacccaaattgctttttcaaggtaagccaaatttgcatttttgggataaaactcacatggtcataatatattatcctttcaacatactgtttaatgcagtttgctaatgtagtgatgaattcttccagcttttatgtatctgaaaaaaagtatttttcttgcctttatttttgaagatatttttactgattatacaattctaagttgatattttttttcattactttaaagaagttgctgcattatcttcttgctgtcattgtttttcaagagaaatggcctctcatcctcatctttggctgctcttaagagtttccttttattgctgattttgagtaatttggttatgatatgccttggtgcctttttctccatgtttctcatgcttgggttttgttgagcttcttggatctatgggtttagagtttttataaaacttggaaaaatttggccattttttccccccaatgttttctttcccttctttttcttttccttaggggactcaaatcacacatatgttaggttgcttgaagttgtcccatattttacttgatgctcttttaatttttttattataaatttttttttcctgtgtgtctcattttggatagtttccattatgtcttaaatttactacacttttcttctgcaatttctgtactctactgttaatcttattcagcatattttttatcttagacattataattttcacatctagaagcttgagtcttctttagtatctcccatacctctacttaatttttgactctatgatacagttataatgatggttttatgtccatatttaccatttctaaaatttgtgcccattgtgtccattctatattgatttcaatgaattgatttttctcagcattattgttcaaactttcttgcttctttacatttctgagactctgtgattggataccattctgaaaattaccttattgagtactagatatttttgtatttctataaatattcttgagtttttttctgggatgcacttaagttatatagaaataattttatccttttggatcttgctttaaaaagttttgaacagtacaagaacagcatctggtccatggctcataattayttcactagtgagacaaagtccttctgaatacccagtctatttctccataaattacaatgttttccagtctggtagaaggactggatatatcttggggaaaaaaatgtaccttgacctctaacttatgctatacaaaagttaatatgtgatgaattgtagacctaaatagatagctgaaactttaacatctctaggaaaaaaacagaataacattttcatgtcctgaagataagaaatgatttattatacagaacatagaaaatatgcataaaagacgttgataaattgaacatgataaaaattaaaagctttttataaaaagtcactgttaataaatggataagaaaactagatactgggagaaaatatttgtcatgtatgtatctgacaaaaaaagtcctctttagactttttaaagaactcctacagatgagttaagattttctcttttttgctggtttttactaatgtgatactgatgtggctttggtgtggttttcattatgcatatcttacttgagcatctgtgagttattgttttcataaaaatttgggaaattattggccactgtttcctcaaattccttttgtgaccttctcttattcttggattcaaagtacacatatgtcacttgtttactattataggctacttaggctctattaattttttgcagtccattttttctcactcttccatttttgttagtttgtattgcagtgtgttaaaatttactgtaattttcatttttcagttcagatactctgtgtttttttttttttttttttgagatggagtttttgctcttgttgcccaggctggagtgcaatggcacaattgcagctcactgcaacctccacctcccaggttcaagcaattcccctgccccagccgcccaagtagctgggattacaggcatgtgctaccacgcccggctaattttttgtatttggtagagacacggggtttcaccatgttggtcaggctggtctcaaactcctgacctcaggcgatccacctgcctcggcctcccaaagtgttgggattacaggcgtgagccaccacacctggccagatactctgtatgtttttggtctctaaaagttccattttcttttatatatcttccattttttaaatcatattcatattttgttgtaaatatttgagcctatttatattaattattttaacatttccatggtctactaagtttattatttcttagatttttgggtctgttctagtctctttttttcacccatttatgaatcacattttaaaattcatatctgaaattttttattggatgttggatattatgactattatactattgtctagattttattatcttcttttamattttttgaaatttgttttgagtgctgtcaaagctactgtggtttagcttcattttttgaggcttttatcaaaacttcgttatagtgggtctggtgacacccctgtggaggcagggtagctctcctactaagatgtaacactctgctcagtgtttagggtgtttgagtctctctattcatgtctgtcagaactcaagcatcttgcagcccagtgagaccactgggaattatttagcttgcagctccccagtaataggtcacccagtctcatagaattttctcctcygtgtatatgtgtaacttagtagttagctattggcgtaaggggcctctgtgaagatttctggagtttttctctgccaagctctgagctcactagtactcagccctacaaactctggcctcttcagtctccctagagtcttatttttaactcctcaacygagtgagactgctgtgatctacttgggattcctagcctgcactgttatggaaagggtcttatggaaaagggatttactcagtttttttccttcactcatggatcataattctgggctgcctgttgtctcaatgtttgaaaaaaaattttttttcctcagttttctagtagcttacagtaagaaggtatggacaattttacttattccatcatggcagaagtggaacagtttctgtttttaatagaagaatttattttaattgtgactttgaataaatataacctgaggttgtttatttttcttgtttagtgagtagctcttcacagaattagagccctccctccttttttaaaaaatgaaattctacacaggaccccaatatagaaaatagttaaaacttcatctgctctcatttaaattaggtttatagctctgttggtctctacctaacaccaaagcaatctggtactcccaaaaataaaatttgaaaacctgtgaactatttacccctctcattttacaggaggaaactaacttctagaagggtcaaatgttttgtcttaaagtaatgaatcttaaactgtctggcttatatgagtttttctagcatttgaaataagacctcttatatcctaactcagtgtctgatttttcttagtcagcttgattttttttaaaaggtctctttgattttgagctgtttcagcatgagattcttgagaactccatttcctattaatctttgtatggcgcattgagtccacatgggctctgttgtaacttctagctgtttaaacaatcttggaatagtttatattaaatccagtccaacatttggtttattctgttttctcacacttcagtatataagatttctgcttatccgttttacaaaaactgtatgaagatggctacatacttcttggtgtttttttgtttgtttttgagacagaatcttactctgtcacccaggytggggtacagtagtgtaaccatggctcactgcatccttgaccttggggctcaagtggtccttccatctcagcctcccaagtagcagggactacagatataagccactatgcctggcaaatgtttggtagagacagggtctcaccatgctgccaggctgatcttgaacccctgggctcaagtgattctccccgcttggcttcccaaagtcctgtgattacaggtgtgagccactgccatccatcttgttttattccttattcctcttcaattgttgtgtttatgtcatttaatctcctagaaactatttggactatattgtgatgaatgatgtactttgaactctaagtagtagatcatggattgtgactttgaattgttggggaagtttcatattgaaggaagcagggaatgtcaacagctttcactgtgttacttggcagaaatcttctttatgggcagtctgcagtctgaatctaagagctacagtttaattcttcctgaaagctgtcctgtrttcagtcactgcttcatcagtatggcctatggtatagaaatgggacagccactctagatggatgagaggtggacaggcaggatagatacagcactaggttcatctcttcagtctactggttatagctagactttaatattgaagaattatgttgctgctattctattatttcattttcttcttacttaaaaaagaaaatcaacagaaaacaccaaataatttagttatacatatgtcctcagatagtcttagaaaggtttcctttgaaatgcatctgtagtggctactagggactcaatgaatattcatccaatgaacagatgaactaagcccaataaaatcaacaaaacatctcctaagaaattgttgatcgtgtgcaactgtttgagttgcattactttttagcacaagaagaatagcatcactaccaaaaccagctgagatatcttattttattwatttatttatttatttatttatttatttatttatttagatagagtctcactctgttgcccaggctggagtgcagtggcatgatcttagctcttggcaacctcggactgccgggttcaagcgattcttgtgcctcagccttctgagtagatgggattacaggtkcctgccaccacgccaggctaattttttgtatttttagtagagatagggtttcaccatgttgactgggctggtcttaaaatcctgacctcaactgatctgctcgccttggcctcccaaagttctgggattacaggcatgagccaccgcgcccagccaagataccttatttaaattaagattcatcatgcagttctgatgtagttcttttgtaagtagtgcggcaraatttttcatacccatcattgtgtcctaaacactcaaaataatgcttcatacatgatataggtgttcaggaagtgtttgtagaatgagaaaataaatctgttctattgcattgcagtgtgtgcacatgacaggcctaacagatctcaagaaaactgttctttcatggctgttgatttcatgtagatttttgcatgtacacttcacatacacatrtgtttacatctctatgatgtatattagtagccatttcctttctaacattggtacttagtagtttgatttttttttaaacaaatcttattttatgtagtaattgatgctttttcatgtactcttactatagcctacataatttgagttctttttcctttatttttttcctttttccaggtgaaaatttcctacctattggaaatataatttgtagtttttgactgatttatcttatattgataaaagatagggcatttaggaagaatttttatrcatattattttgttttctccctcaacttctttgtaaggtaggtgaacagatgaggtaaatgatgcagataggctaatcgtctctctccaagtcacacagttaagttgcagggttaggattccagggtcattgttccttttgctgattctacactatctctgaatattctctttcaaaaaaggatacataatctatttgctttagttaacgcagaattgacttgcaattttggttaaagagaatgaaaaggaaatcactgtatttagtgggaaaatgtcatttcaaaggttgattctgatctttaaaaattgtaattgtaattatcttgtgtagagccctgtgtcttaacatcctcatttaataatttgtttgtcatataagcagatggtgagaaaacagtgattcccagatctgtcattactgctgtggtaatttgatgttttatagttaagaattttgactggtagaaggctgatctagaattcacatgtctctggggacctgtattgtttggatttggaggtatacttgtatttgaattcagggaaggctgttataaataaggacttggcttgcatgataagtaacatttctttatatagctattcagttgagctattgaaagtaaaacatacaaacaaacaaacaacaatagcaraaaacgctttgtgttgttgttgacagaaaagttgaagcttttcaatggtgttttcctctctcatgtcgcataaccatgatggtgataagcgtacaattatatataaaggcaaaaaagttcaaagtccagaggtattaaatctttatggtaaatgagagcctgtaagtcatgtaatacactaagaagtatgttctgaaaatcttaagagatccaattgccatgtgactctcacaatgttatcctttatgaggagaataaaaggatgcttagtgtgacttttgcaacatcaagcccagttgaaacacaaattttattttgatttgtgagtccaatccaaccagttatttttcattttccatttaccatcattttgattagtattttttgttaatcagttcagagttactatttgcagccctctgaaagctggagcctacattagaagttttctaaatgtattgaagacaaagccatttattaaaatctgatattaaactgtcactttccagaggcatatttgaaaaacagaaaaacaaacaaacaaaaaaaacacaagggaaaccatagagctcttcctgagatgctttaattcaggagtttctactcaaaaagttaatcactgacaaaattctttgaaatgttttagtgttcgtgtgagtgtcacaagccatgctttttagaaaccagaattttgtaataagtgctctctctgcagcaattaaaaagtggcgtcatctatggtaaacactaagttggtctattgagagggaaatagctagcccttcaaaatacctttgtgggagtgaaaattacctttcgtactgaaacttactaacccccagtgattaagaggccatttcatgttcaaaaacatgttattaaaaataatgagtgtgatattttaagtacatgactattactacaaaaattgtaatattatagattaggatttattcatacactgaaggtctcatatgttgatatgaactatatttcatttaagaaggccttgggaggaggagtcaggatcatgaacaatctgagagtttatccaagacctgtaagttataagaaggaagagttgagaggtagctgaggtgggtgtctccaggtaggacacgtgaagatgggaataagttcaggggacctgagaaaggtgcttggtgcctaaagtcagaggaaagycaaattagggattccttttagggaggtgaggagagcaacttagacgtgatgttgcatttgtgagcttggaacccagagttaaaagaaaatatacagaattgaaaaatattacctggcctaaaattggaagtagaatgatttcgcaggaaagaaaagtgaaagaggaactatcatctcctaggcaaaaacagaacagtgtagagtcaggaagaaatcatgatttgtcttcaagctgagattagttaattggatggcacagtataggtgtctaacttacccgtacatagtttactctcttcaggtgtccttaaactgtgatgtaagtgttcatctgaatttactctgtatttacattctatccatgatgtctgtaatagctatgactataaaagggagggccagcctcattactccttggatggctacactgcagtaggacccagaggatgtgagtatgggaatctgatcctgagtcctgctggttggagagttgccagtgtcatcataacttgtaaaaaaagtcccataagacacttgtaaaggataagtcttaaagtatgtaagaataaatcagaaaattgccttttttaaaaaaaagctttttaaaaagctttttagctggtgattgtgtctttcttttctttaggattctttaataagtaattttagtaaagtgtcattcttagttgctaaagaaaacagtcgtctcctgttttcagtcatcagattcaagcctattaggaaaaacttgaataattattcttacacgtctccattaatatgaagaatcatgcataaaatgtagtccatgcttatctctaaaataaacaaggaaataaaatttccgggttctgttagttgttagaaaacatggtaactcaacttgttattctgcaccttgggaaaaaaatgcttccttgttgattccaagtaagatcatttagaaactaaagtctaccatgtagagtataaaaatgagattgttaaggggatgctcctttattctgaaaactctctaatgagggaacaaaaatataaccctggttttaatatttatgtaactttttgcagaaataatttaaaatagggagaggtaactttcaatcccaaacatagatcaaatacttagtaatttrtttgacctataatgctggttctcaaccctggctactctttacratcacctgggagcttcttaaaattaccagtgtgatcttaaccccagagattctgatttattgttggtctgggttagggcctagrcatggttaattggattccttaggtaattctaatgtgtagtcagaattgaaaaccactgccttagaaacacacagttgaactttcttttatcttcatatggaatcagaaaagtaaagaggaagaaaaggagtgacctgtagattagctacccatctgtacttattctaaaagatcaaggtagggagcaggtgaaggcttggattttgcaccctttgtaccagaacacatgggccagtgtgcagtactggaagtaaagttcttggatgttacagtgtggtggcatttcttgtcaggagagaagggaatgatagattgttttaacttttcttcttctgcttgactttgagtaaaaagttgagcatctcctgcttttttagcattttaggaaaaaaattattgtgccaagagtatcaggtaatctgtcataaaaatatatgaatggagcagatctgtgcatcacttcaaactaaagatatataaaagcattcctttgtgcttttttgctaagctgtgacagcacaatcactggttattttgtaaagaaatttattttaaaacagtatgacggccaaaaaaaagctattggaaggagaggaagagaggacacacctrggttacatttggcctcttttaagtctgtgagacatgtttaaaaatctttaaagaaagcttactttgtcactatcccatttctgctataatcaacataattatacctttttaaattaactaatctatgagtaccgacttaatgaatgagttccatgtatatggagctgcttaaagactctgaaaagaataggaatgtcttattaatatcaattctggatactacgtgcctaaatgaaccttctttagagggctaatccagagtactcatgcatagaataaaagcttactggataggctcaataatagaatggatatgactggatatgactgagagtagataccgtatactgtggtatgactggtgacctgttggatgtcgctgtcctgtagtcattggttaaatatactcctgatgacagatgggtacatgcacttcatccagctttgctgctgcacgttgtcatggtgaaggggaaggacacactacaaatgatgattccttcccacagactacagtccatatcttaacaaagatctgtcgaatgtttccctgtggaaaagaggattttaatatatttttctcttgctgacttgagtaaagatttctgattatcctagaacagagataatggargtaatttttcatggaaaaactatatactttcgtttgtaagctgttagaattggcattttgttggttgggtgccargctgctagactatgcaccacgtgggcagggattttgttttgctcaatgttgtattcctgatgaaaggtaaatgattttaattttgataaagtgatttatttactttttaattttttcattttttccacttgttatttcactttgtaattatatgatataatctatttttagttttctccacagggctaaatatggtaacaatttattgtttattcagggcactcagtaaactgaggatttgtgaatactgtatgaattcattttatagagaataacagtttaaaaaaactaatgactggaacattagtattgaacttttgtcttacaataaactttttaaaaaagtttaaagaaaatttttagaagtttcaaggcatataatcacagatataaaatgcattaagaaaacctattcagaatcgcacagatttattcacatttcaaaacacttaaatatgcaaaaaagaaaatccacagaatggttttaaattacaaactcaccttgtgaatttaaacctaatttcattttcaaaagttcaattttcagctcattttaggatcatttatatgttgtaaaagtgatatatactagcatctggttatggtcagcacctgccaagaaagttaataaagcatttctttaagatctttggtttagaaaaatgttctggctatatttatagtagcctatataaataagtgctacaaaccttaccacttcacaatttttgtgaattctttttctccattgaacagatgcaaatagaaaaattaattagcctttcccttgttaccagacataaattattattctcttctaaagatacaaaaaaaaattgatgagaagaatcatagaatttttagaagtggaaagtatcttagaagtaatctacacttatttttagcatcttgcttatagatttcaattttgtaaaaaccttagtggtattttgatggtaggatatttttattaagtttttaaatgtcttaatgttctctctgtagccttatttgttaatttttgccaagaatctttccacaaaatctgaattacttgcttcaatttgcacctttcataaggattaaaataaattgagatcttaagaacttatttatttatttatttatttatttatttatttatttattwgagatggagtttcactcttttgcccaggctggagtgaagccgcacratctccgctcactataacctccgcctcccaggttcaagtgattctcctgcttcagctccccgagtagctgggattacaggcatgcatcaccagacccggctaatttttgttatttttagtagagacagggttttaccgtgttggccaggctggtctcgaactcaggtgattcacctgcctcagcctcccaaagtgctggaattacaggcgtgaaccaccttgcccrgccaagaacatttttaatgcttgtttatataagaagatatttggctaggcctttgattttttgaaaggaagatcctaaatataaagtgcatgacctattatatatttctgcaacacaggaaattaacattttatttagtaggataataccttctggtaaactactgagaaaaaataaaatttactacattctaattataaagagtactttgccatatcccttacccttctcaattctgatatggtctcctggaggtgagacagggtttatttgctaatagcctgttgagcaattcagttgtcttaccattgtctcctttccctgcctgatcttttttcaytgaatggccataataattttttttttttttgagagacggagtttcgcgcttgttgcccaggctggagtgcaatgctgcgatcttggctcatcgcaacctccacctcccaggttcaagcaggtctcctgcctcagcctcctaagtagctaggactacaggagcacgccactacactaggataattttgtatttttagtagagacgaggttttaccatgttggtcaggctggtcttgaactcccgacctcaggtgatccgcccatctcagcctcccaaagtgctgggattacaggcgtgagccatcgtgcccggccataataaatttttgaatggccatcctaaattttaggtgcctcattggagtacagagttttgccatagattgtaaattattctagggagatatttttgatgctattgacatttaacccagataattctttgtcatgggagactgtcctgtgcattgtaggatgtttagcagcgttcccagcctcaccccaatagatgccagtggtacctcctcgcccaatttgtgacaaataaaaatgtcttaagatgacgttgcttgaatgtcctctggagggcaaaatctgcggttgagaaccactgctctagggcaagaaggtcttttgtgtttgtattctctcatttcccatacatatgtctcctcaattgtgttattatgtataagaacccagtaatttttacttaattgaaatagtaactttattttaaggcctgattatcttgtattgaaatggtaatttttatgttatagcctgtatgtatcaacaaatatgtaaaaacctggagaggaaatattgtataatccatgtatagtataaataagagttagctttaggtatctgttggatcgattttaaatactatccttagtattccatatgtggctgttacaaagttatagaaacgaagctttgtcaggcgtggtggctcacgcctgtaataccagcactttgggaggccgaggcgggcggatcacctgaggtcaggagctcgagaccaacctgatcaacatggtgaaaccctgtctctactaaaaatacaaaaattagctgggcgtggtggtgcatgcctgtaatcccagctactcagaaggctgaggcatgagaattacttgaacctgggaggtggaggttgcagtgagctgagattatgccattgcgcttcagcctgggggacagagtgagactccatctcaaataaataaacaaacacacaracaaaccaagcttcagttttttctcctgtaaaattgaaataatgtctattttrtggttttatggtaagaaacaaattacatgataaatatggtcagctaagctcagctgagaatcagatgcctttggtgggttgtagtttgatggtactcttctactccattttaacatttctgttatctgattcataaaaggggtttttagggggaaacacctacttgaaatctccctacaatcggcatacagatatatatgaagctttaaaatgcattagagagactccttatagatttatctctatttgccaagaggaacaatggatgaaggaatcagccttattgtgggattctgttttagttaaagagtaggctaagttgcagtaacaaatccacactttaatggctcagttcagtaaagtttatttcctactcacatgatagtccttactgcttcaggtttgttggacattctttcaggaacatgaagctccttctgtctaatgggatcaccatgtacgttgtaagcttcactgttgtcctctggtagaagaggtaaacgtgtaaaaggagtaccactgctttcctaaaagcagtggtctggaagtgggatatttaaattctgctcatattctatttgttcttatttggtgagaacttggtatcatggtcacacctaccccattgaagaatgggagagagtggagttttgggtatatacccaaaggattataaatcatgctactataaagacacatgcacacgtatgtttattttggcactattcacaatagcagagacttggaaccaacccaaatgtccatcagtgatagactggattaagaaaatgtggcacctgtacaccatggaatactatgcagccgtaaaaaaggttgagttcatgtcctttgtagggacatggatgaagctggaaaccatcattctcagcaaactatcgcaaggacagaaaaccaaacaccgcatgttctcactcataggtgggaattgaacaatgaaaacacttggacacaggaaggggaacatcacacaccggggcctgtcatggggtcggggaaggggggagggatagcattagaagatatacctaatgtaaatraggagttaatgggtgcagcacaccatcatggcacatggatacatatgtaacaaacytgcacgttgtgcacatgtacactagaacttaaagtataatgaagaaaatatatattaaaaaaagactcttgctttaaagaaagaggttgctgcctactctcttgacagggatgatagcattgttctctagcatccaggtgtgctgggattcttaacgtcttcgccatcaagatgtggcggtttcctaatgctaccagtggctaggtagtagggaagttttgagttccagctttgattagcacttctctagacccatcagagatgcatcctgatgacttgtaatgaaatgtagaggtcaggagtaatcactggacccttacaagtgctcctttggattttcaagaatactgggagttgtacaattctgccagaacttgtgcttcagcagtttgagcagttagggcttaatgttgttagccaagcaactaggagcttggaattattgacagccagttgaaatgaaaggaataaatatatattcatagagtgatgaagtgaattctggttacttggctgtaaagaggcaggaatagtgcacacagcatatccagccaggtaaagaggaggacaggggcagaatggcttagcaggaaagtagtgttccttgccacatagggaaaatagttcctcaggttttgtaggcttgagcagcagcaaatatttgattataataaaaatggaacttagtattaaattatttaatgaatgatgtgttctattaagagcctttccatgctagagatcttagcatttctggtactgtatgtactattcagagggtacaaactattcacagttccagaaatgttaatatcaaagagcatttgcctatatattaaatttcatactggctggatgctgtggcttacgcctgtaatcccagcactttagggggctgaggcaggaggatcacttgagcttaggagtttgaggccagcctgagcaacacagtgagacactgtctctacaaataatgataataataataataaaaatagctgggcatggtggcacacacctgtagtcctagctgctctggaggctgaggtggaaggattgcttgagtccgggaggtcagggctgccatgagctgtgattgtgccactgcactccagcctgggtaacagagtgagactctagacccatcagagatggcaagaaaaaaaaaatagcttcctttaaatgcagtctgatttcggaacttctatttttctttacaagtttgataattatctctgcttttaaattaaaggaaattcattctttaaattttacttggtctttttggtttctgttactgaattctactcacaatgaatttagtcgaagtctgtgtttctagcgtagttactcaatattgaaaatgtatgttagcaagatggagtagtcccttatgtggttagtaggccttcaggcagtttttttcctttttgccttcacctttagtttaccccaaaatatataatcaaaatatataattttaaaaaattctatatactactgtttttgaaaattataactatttgaaccaggtactattgctataacagataatattttaaaatttaaagataaacaggaggctgtgttaggggagcagtattcttatattgatgttctgcatttagttgcagatgttactgttcataaagatatacaagtaccactgatgttggtattgcacgtagaaagtaggtaaaaatgataaattggagtctgcctgacagaatgcagtctgagagaaaacttttctctttcaatataatctctttacatttggcctaagtttaaggtaacagtgttgcctttcagaattcagcctttctttaaagatatttttcatatcagcatattacatccaaaatacctcatgctcaatattatgttatatttaaaatgagaatcatgcaaacattaatatctgaattaaacataccaaaattaattttattctttcaaatatggaattacaatagagctttctttcacaaggttgatttttagattatcttacagtaaaagcatctgaaaaattttggcttacttagtctttctcggagtttctttttataagggaatcttggcagactgtgctctgttctatgagctactgattgtagggggaaataatgatgctatttacttttgtgattttcttcaaactgaacaatcaagttaaaacctaagataatgtttcaaaagtmatcactatatatgtggtcttatccttttatccttattttctctgtaagtgattccttttctgctcttctgatttcttaatatttttcactttcttcagttaaaatttattaatcacacatttactactaatcaggaattatgaagactggaatttaaaaactactctactggagagaacaactttcagttgaaattcttcatggttgggtgactaaagattccaaaagagagtggtttggatgaatcagcactggcttggaaagggagctcttgaaatctgctccacatttcttatgaatgacttagatgaaggtacacaaaataaatttttagggcatgaaaagttgaaaggaatagctaatatattgagtagagaaataggaatttaacattatcacagtggactgaygtgctatgtcatggcaaataatatgttatttaatgtgaataaatatatatgtctgcattaatgatatataaaatattcacttaatttcgaggaaacagtgcagaaaggttttagttgactgcatgttttatatgagccaacaatatgataaagctggtaaaactgtcaaaataataatggactatagcagttaatagtttctaaatagtttccaagaggcccctggtattagtcagttcttgcactgctgtaaagaaatacctgagactgagtaatttataaagaaaagaggtttaattggctcatggttctacaggcygtacaggaagcatagcggcctctgcttctggggagacctcaggaaacttactgaggtcatggcggaaggtaaagaggaagcaggctcgacttacatgggcagaataggaggaacagggaggggaggtgctacacacttttaaacaaccacataccctgagaactctattatgagaacagcactaggggaatagtgctaaaccattcatgagaaatcacccccatgatccaatcacctcccaccaggccccacctccaacatgggggattacaatttcacatgatgtttgggcagggacacagatccaaaccatatcaaacctgtactctgttgtctgctctttaggatacctttggagtatttgtttcattctacactttatatattaaggaataattggatatccgtaagatgaacaagatcatgcttttaggaagagatactttatttggagggaatgcatgagaagtctagagaaggacttctcaattctagggaacctgatctggagaaaagatttctgacaatgagcataaaattattccaccttcttatraaaggcaggactaggatcactgagtatatagaaattttagggaagtagattacattaatatgtaatgatgtgaaaagttggaatcactcaatatggattgattgggctgccttcacaaagtgagtcctttccctgtcaagctaaatggcaatttgtctagattattattgtaaagaggggattaatttactagcgggatgggatgacttctctggccccttccattttttttgtatatgtagtaggttttattgaagagttgggaagtttttgtttttgttgtggacccctttgaattcacattattcctcaaagtatgaattgggaaagaggttggtgttggaattgtaacaggcttcatgatacatgcagactcactacccatgccacttgaccatttttaatcttgtgagcctttgtcattttcactgcataagaaattaaccaactgatggttttatttgaaggataggggtttaccgatggggcagtctcattgttttactgatatatatatgggaatataattcctagacattcataaccttaattcagtatggtaaagtttagtcaatttttaattactgtatattcttcccatccatttacacagttcagtggtttccttccttcattcatattccttaaatagtttttgttccayggactatcattttttattatatagtttctctgtccctgctgattgcattagtctagtactagcaaacagagggttatccaaatgtttaagaactaaaccagagtaagatgatatacaagtaatagatacttttctgcaaatttcaccaaatcttttctgtgtagtcattgaagagactcctacctgactgctgttgtagtgggacagattttgatccccagtttagtaacatatacttttttcgttcatttggaaataattagtgcttgtgcttattaattaagaaattatttagtttggtttgctaccagtgcaaaaagaaatttttcagttcacatttaaaaggtagaagtgatttaaaaattattaatattgcagcccttctcaaatctttcacttgatcaacaagtttttagcattttctctttacttttctaactttttgttttgaaataatttcagatttaaagaaagattgtagaaagaattacagataattctcatgtactcataacccagatttcctaaatgaaaaatggaaacattttatcatagttgttttctctgccttcttcttttttctttttgaactatttgagataaagttacagtcatgattatgtttttatccccaaatactcaagtatgcatttcctaaaatcaggaacatggtctaaaacaaccataatgcattgatcaaagtcagaaacttaacattgatacagtacttttatttatttaatctgtatcctttattcaaattagacccgttggcccagtaatgtcctttatgggaaaacaaaagaagtctgatttagaatctgatctaggctcagacattaattacatttagacatcatgtctcccttaatttggaagagttccttattttttcttcgtcttttatgatactgacatattttgaaatgtgtaggccagttaattgataaaatattcataagcttgggtttatctgctctttcctcatgattagctttcaatttatgcagtcttggcaggaatactgtggaagtgtttttgttttcttttcagtgcatcagatctggagacacattataaagatttgtccaattattgattatattaactttgatcattttgttaaggtggtttctccactttgccagtttgtcccctatgaagttattattttatcctttaataaatatcttgtgtgaaaatactttgagactttgtaaatatctatttctcatcaaagttaaatgctctagttttagcacctgttgattcttgcatgactgaagcactactgctttaaaaaaagcattactatgatagttgtaaaatgatttttctcatcctgtcacttccgtatttactaattgtcattgtactgtaaggaagaagtttcctttctcatttgcttactgacttatttatttatattagcatgaactcatggattcttatcttaatctatgagttaaaatccattactgtggtttagtgttttgctcgaattatcccagatttggcctattggaaccttttctggatggtttctgtttcctgttgaaaaatctccatgattccttgaattcttctttattctgtggcacaaaaagatattctagactcattgtatacggatctcttcctgtctaggaataatccatttttccaaggagctatagtttcttttatttgaatataatttttagaaaccaggacctgggcacttcatgtgaaaatttataatggattatcattgcttctagttgctcttagtgggcaaacataaaatatatatgtacacacacgaatatatatatayayacacacacacacacacatacacacacacatacatatacatatatatctgtttctgtgttgatctatctatatttaaaaatctacagtgtgtaatgctatttatcattgccacaacttaatgtctacacasaatgataggaagctttatcaaatatgtctttattttgctttcatttgtaaggattattttcactggatatagaattctgaatgaaatctcactagataggcttaataatagaatggatgtaacagaggaaagtgtcagtgaactagaagatagatcattagaaattattgtgtctgaaaagtagagataaaagattgagaaaaaatgaacagagtttcatggacctgctgaataatatcaaaatttatgatgttaatataattagactcttagagaagagagactgacaaggaaaatatgtttgaagaaataatgggtgaaaagtcttgtaaatgaagagaaagtcacatttaatgattcaagaaggtcagtgaacaccagttaggataagtacaaagaaaatctaggtgatttatggtggctcatgtctgtaatcccagtactttgggaggctaaggtgggaggattacttgaggccaggagtttaataatatcctgggcaacatggtgagacccctgcctctacaaaaaataaaaaaaattagggcaggcatggtggtgtgtgcctgtaggcctagctactcaggagactgaggcaagaagatcttttgaacctaggagttcaaggttacagtgaaccatgattgcgctactgcacttcagcttgggcaacagtaagacctaagaccctgtctctaaagaataagaaagaaaatcttgcctagatagattgtaatcaagctgctgaaaccacagatgaaaacaaagtcttaaaacagagaaaaattacttatcatatacaatggaataatgacttaaatgaccacagatttctcattggaaatcatgggggctagagacagatagatgaagaaaaaaaagttatcaatatcaggaatgaaaagggggatatataatagtactacagacattaaaaggataattagagaatacagcaacagtcttatgccacacatttgacaatgagatgaaataaataaatgttttgaaaatttcaaaaattgccaaaaccggataaaaacattgaaaagctggtaattatagacaaaaatctatcatgaatgtaaatgcaagaatcttaacagaatattagtaaatcaaatgtaataatatataaaaggataatacatgcctaagtagaaggtatcctaagaatacaaggtttatttaacatcctaaagtcaatcagtgtaattaaaaaaagaaatgaatctcattattattttggtagatgcatttaaggcctgtgacaataatccatttattaaagaaaaattaggaaattcttcaaactctgcacacctaggaagaatctgtaactcatatttaatggtgaaagacagaatcttattcccctgagaataagaacaagacaaggatgcctactttcgtccacttcattcagcattgtaatggaggtcccagccattgtaataaggtatgtgttatggattgaatygtgtacctcaagaagttatgttgaagtcctaacctctggtacctttcaatgtattcttatctggaaatagggtctttgcaatgtaatcaagttaaaatgaggccatgctgatttagggtgggtcctaatccaatatgactggtgtccttattagaagagaagagaygcagtgggaagacagccatatgaagatggagacagatactggaattatattscctcaagccaaggaacttctaggacaaccagaagctagaagagggaaggaagaattttttcctagaggctttggagggagcatggcccagtaacaccttaattttggatttctagcctctagaactgcaagataataaatttttgttgttttaaaccaagcagtttgtggtactctctgggaaactgaaatatagcaagtaaaagaaatgaaaggaataaagatggggaaatgagaaataatactgttactgtttacagatgttatgattattacatgaaaatattttaggaaccctataaaacaactactagaactagtaagtgaatcttcataattgcaaactacaaggttaatatactaaaattggtgcattcatttatcctaacagcgtactgttggaaaatgaattttaaaagaatcccgtttataatagcaccaaaaatcataaaatacttaggtataaacaaaacaaagatgtctaagacccctacactgaaaaatacaaaatgttgccaatagaataggagggtagaaactgagaagctgattataaaaactatgtggaagttaaaaaggacctggaataaccaaagaagtttaaaaaaaagaaggttggaggacttatcctacctgatttgaagaactaatataaggctacaataatcaacacattttggtatgatgaaattatacacgatagagaatctaaaagtaggcccacacatatatgatcaattgatttttttaatagatgtacctgttctaagacaaattcttgtggttctctgacatttctacacatcttttgagcaagatgcattggcatgtttgttctagactatctttccaaagacatttgtatagtaaacttgcttgggagattgagatagtgcctttctctgggagaagagtctggatttgttttcttttatttttaaccatgcaacaatagcttattatgtatgggttttaaaggtttcaaaaattatttcctgaatctctccatacacaggcaaaaataaatgtgctatttaacatattggaatgtgcaaacttaatcattgcctagagaagggaaaattatccccaaaacatgcttaaccaggaggctgattcatctgctgactccaagaacatgaagatgaacatgatagacagactgtccaccatctgaatgttcattcamcacccattcattcagtaacccttactcaggcccagatgagcagcacatttcttgccaacaatcattaaatgtccaagaaggctctcgttatcatcttctgcagcagaaatctgggatatgtttcttgtgtatcactagaaaatgtgttggaagaggccaagatggcagatgacatcactaaggctcatgtcgtttggcctggtgacaacacaatctttgggaatattttccacaaagaaatcccagctaaaatcacttttaagtatgactagtatcttgctttccatgacattttccctcaagcgctaacaggagggaggaactggatttgttttctgaccacgatagtaagcataatgtcttcaacttaggcaaagcctgggtagggttgctagcagccactgtgtaagagtgagggtttgctaagtttatggttcctcagttgtgacactgacccgctgtgtgccagccttcatctgaccttgcttctgcatttccctgtgggcgttggtggttaaggaggaccaatgcaaacatgaagctcttactgcctgacgtgctgagagtaataaggtgctttgtctctgattcaggtgtcttgggtcttctgctggcatgagggaagccattgcgggctaacttgtagcttgcaagtagggtaaaatctcagacccttcatrgttcttgacattaccaaggtaattaaaagggaaaaggaaaatcttttcagaaatggcaccatattaactggatatccatctggaaaacaattaacattaactcttaacttcataccagacataaaaatttgattggatcatagaccaacatgtaaaacttaaaaccatactacttagaaaaaataggctgggcgtggtggctcacgcctgtaatcctagcactttgggaggccaaggcaggcagatcacttgrggttaggagttcgagaccagcctggctaacatggtgaaactccatctctactgaaagtacaaaaattagttgggtgtggtggcaggcgcctgtaatcccagctgaggcacaagaatcaattgaacccatgaggtggaggttgcagtgagcccagatcgcaacactgcactccagcctgggcgatagagcgagactcagtctcaattaaaataaataaataaataaagtaacatataacttaaaatcttcaccgttggggcatgacacagtaaggtcacatcacaaaaaagcaagaattgaagaaaacatttccaaaacatatatcagacaaaggacttgtgtccagaatatataaagtactctttccatttaataataacaggacaatccaattttaaaatagtgggcaaaatttttgaactaatacttgataaaagaaaatacatgaataatcgataaaccataaaaagatgattagcataggttgttatcagagaagtgcaaagtaaaatcacaattttatcttactctacatccattaggatggcaagcatgtggaacaactggaaattatatatatcgctgaagtaaatgtaaaacagtaaacagtttggcaattgcttgaagcattaaacatcccccctcgcccaaaccagccattccactcctagttatttatacaagagaaatgaaaacatgtgcccatacagaaatttgtacatgaatgttgatagcagtttcatttgcaatagccaaaactggaaacaacccaatatccatcaacaggtgaatggagaaacaaactgtatcatacccaaacagtggactcagcagtcaaaaggaacaaatggctatatcattatcatcatcatcatcatcatcatgatgaatttcaaaataattacccttaaagaagccagaccaatagagaaatatttattatataattctacttatatacagttctagaaagtgcaatgaacctgtagtgacataaagcagatcaatgttacctggaaacagggtacagtgagaattggattgtaaagggtctggtagaaatgcttgttatcttaggtgtagtgatggtttcatgggaatatataggtcagaaatcatcaaattgtacagtttacatatccaggtcattgtgaatcaaatgtcaataaaatttaaaacgaagatataaattaaatattttattattttttagaatattcaatttgtaagttcaactttatcatagaaaagagctacatttttgttgttatttatttatttatttgtattatactttaagttctagggtacatgtgcagcacgtgcaggtttgttacataggtatacatgtgccatggtggtttgctgcacccatcaacccgtcatctacattaggtatttctcctactgctatccctcccctagccaccagcccccatcctgtcccccagacaggccccttcttgtgtccatgtgttctcattgttcagctcccacttatgagtgagaacatgtagtgtttggttttctgttcttgtgttagtttgctgagaatgatggtttccagcttcatccatgtccctacaaataacatgaactcatccttttcaaataacatgaactcagccatagctgcatagtattccgtggtgtatatgtgtcacattttctttatccagtctgtcattgmtgggcatttgggttggttccaagtctttgctattgtgaacagtgctgcagtaaacatacgtgtgcatgtgtctttacagtagaatgatttataatcctttgggtatatacccagtaatgggattgctgagtcaaatggtatttctagttctagatccttgaggaatcgccgcactgtcttccacaatggttgaactaatttacactcccaccagtagtgtaaaagcattcctatttctccacatcctctccagcatctgttgtttcctgacattttaatgatcgccattctaactggtgtgagatggtgtctcattgtggttttgatttgcatttctctaatgaccagtgatgatgagcattttttcatgtttkttggccgcataaatgtcttcttttgaaaagtgttcatattctttgctcactttttgatggggttggtttttttttttttcttgtaaatttatttaagttctttctagattctggatattagccctttgtcagatggatagattgcaaaaattttctcccattctgtaggttgcctgttcactctgatgatagtttcttttgctttgaagaagctctagtttaattagatcccatttgtcaattttggcttttgttgccattacttttggtgttttagtcatgaagtctttgcccatgcctgtgtcctgaatggtattgcctagggttacttctagggtttttatggttttaggtcttatgtttaagtctttaatccatcttgagttaatgtttgtataagatgtaaggaaggggtccagtttcagttttttgcatatggctagccagttttcccaacaccatttattaaatagggaatcctttccccattggttgtttttgtgaggtttgtcaaagatcagatggttgtagatgtgtggtgttatttccaagggctctgttctgttccgttggtctatatctctgtttttgtaccagtaccatgctgttttggttactgtagccttgtagtgtagtttgaagttaggtagcgtgatggctccagctttgttctttttgcttaggattgtcttggctatgtgggctgttttttggttccatatgaaatttaaagtagttttttcctaattctgtgaagaaagtcaatggtagcttgatgggaatcacactgaatctataaattactttgggcagtatggccattttcacaatattgattctttcctatccatgagcatggaatgttttccatttgtgtgtgtcctctcttatttccttgagcagtggtttgtagttctccttgaagaggtccttcacatcccttgtaagttatattcctaggtattttattctctttgtagcaattgtgaatgggagttcactcatgacttgcctctctgtttgtctattattgatgtataggaatgcttgtgatttttgcaacttgatttttttatcctgagactttgctcaagttgcttatcagcttaaggagatttggggctgagatgatggagtttgtaaatatacaatatacaattatgtcatctgcaaatagagacaatttgacttcctctattcctatttgaatatcctttatttctttctcttgcctgactgccctggccagaacttccaatactatattgaatagtagtggtaagagagggcatctttgtcttgtgctggttttcaaagggaatgcttccagtttttgcccattcagtatgatattggctatgggtttgtcacaaatagctggtcttattttgagatatgtgccatcaatatctagtttattgagagtttttagcatgaaggggtgttgaattttattgaaggccttttctgcatctattgaggtaatcatgtggtttttttcattggttctgtttatgtgatggattacatttattgatttgtgtatgttgaaccagacttgcatctcagggatgaagccaacttgatcgtggtggataagctttttgatgtcctgctggatttggtttgccagtattttattgaggattttagcatcaatgttcatcaggaatattggcctgaaattttcttttttgttgtgtctctgccaggttttggtatcaggatgatgctggcctcataaaatgagtttaggagaattccctctttttctatcgtttggaatagtttcagaaggaatggtaccagctcctctttgtacctctggtagaattcggctgtgattctgtctggtcctggactttttttggttggtaggctgttaattactgcctcagttttagaacttgttattggtctattcagtgattcgaattcttccttgtttagacttgggagggtgtatgtgtcgagaaatttattcatttcttctagattttctagtttatttttgtagagttgtttatagtattctctgatggtagtttgtatttctttgggatcagtggtgatatcccctttatcatttttaattgcatctatttgattcttctctcttttcttctttattagtctggctagcggtctattttgttgatcttttcaaaaatgcagctcctggattcattgatttttttgaatggtttttcatgtctctatctccttcagttctgctctcatattaggtatttctcgtcttctgctagcttttgaattatttatttgcccgttgcttttctagttcttttttttgtttgtttgagatggagtcttgctctgttgcccaggctggagtgcagtggcgcgatcttggctcactgcaagctctgcctcctggtttcacgccattctcctgcctccttcctgagtagctgggactacaggcacccatcaccacacctggctaattcttttgtatttttattagagttggagtttcaccgtgttagccaggagggtgttaatctcctgaccctgtgatctgcccgccttggcctcccaaagtgttgggattacaggmgtgagccaccatgcccggccttctctagttcttttaattgtgatgttagggtgtcgattttagatctttcctgctttctcttgtgggcatttagtgctataagtttctctcgaaacactgctttagccgtgtcccagagattctggtatgttgtgtctttgttttcattggtttcgaagaaatgttttctgccctaatttctttgtttacccagtagtcctttagtagcacgttgttcagtttccatgtaattgtgtggttttgagtgagtttcttaatcctgagttctaatttgattgcactgtgatctgagagactgttaagatttccattcttttccatttgctgaggagtgttttacttccaattatgtggtcaattttagagtaagtgtgatgtggtgctcagaatgtatattctgttgatttggggtggagatttctgtagatgtctgttaggtcacttggaccagagctcagttcragtcctgaatatccttsttaattttctgcctccttgaggtgtctgatatacacagtggggtgttaaaatctcccactattattgtgtgggagtctaaatctctttgtaggtctctaagaacttgctatatgaatctgggtgttcctgtagtgggtgcatgtatatttaggataattaggtcttcttgttgcgttgatccctttaccattatataatgcctttctttgtctcatttgatctttgttggtttaaagtctgttttctcttagagtgggatcgcaacctctgctttttttttgttttccatttgcttggtaaatatttcttcatccctttattttgagcctaygtgtatcttagcacatgagataggtctcctgaatacagcacaccgataggttttgagcctttatccaatttgccagtctgtgtcttttaattggggcatttagaccatttacatttaaggttaatattgttatgtgtgaatttgatactgtcattatgatgctagctggttattttgcccattagttgatgcagtttcttcctagtgtcaataggctttgtaatttggtatgtttttgcagtggctcgtatcgattattcctttccaagtttagtgcttccttcaggagmtcttgtaaggcaggcctggttgtgagaaaatctctcagcctttgcttgtctgtgaaggattttatttctcctttgcgtatgaagcttagtttggctgggtatgaaattctgggttgaaaatcctttttttttttgagatggagtctcgctgtcacctggcttgagtgcaatggcatgatctcagctcactgcaacctctgcctcctgggttcaagcaattctcctgcctcagcctcccgagtagttgagattacaggtggtcaccaccatgtctggctaatttttgtatttttagtagagacggggtttcaccatgttggccaggctgttcttgaactcctgacctcgtgatccaccctcctcagcctcccaaagtgctggaattacaggcgtgaaccactgtgcctggcgaaaattcttttctttaagaatgttgaatattggcccccactctcttctggcttgtagggtttctgcagagagattcactgttagcctgatgggcttgcctttgtgggtaaccygacatttctctctggctgcccttaacattttttcctttatttcaaccttggtgaatctgacgattatgtgtcttgcagttgctcttcttgaggagtaactttttagtattctctgtatttcctgaatttaaatgttggcctgtcttgctaggttgggcaagttctcctggataaaatcctgaagagtgttttccgacttggttccattccccctgtcactttcaggtacaccaatcaaccatagatttggtcttttcacatagtcccatatttcttggaggctttattcattccttttcattcctttttctctaatattgtcttcatgctttatttcatyaagttgatcttcaatctcttgataccctttcttcagtttgatcaatttggctattgatacttgtgtataattcacgaagttcttgggctttgcttttcagctccatcagatcatttatgttcttctctaaactggttattctagttagcaaattcctctgtccttttatcaaggttcttagcttccttgcattgggttagaacatgttcctttagctcagaggagtttgttattacctgtcttctgaagcctatttctgtcagtttgtcaaactcattctccattcagttttgttttcttgctggcaaggagttgtgatcctttggaggaagaggctttctggtgtttggaattttcagccttttcatgctggtttcttctgatctttgtggatttatttacctttggtttttgatgttggtgaccttcagatggggtttctgtgtgcacatcctttttgttgatgttgatgctatttgtttctgtttgttagttttccttctaacagttaggcctctctactgcaggtctgctggagtttgctggaggtctactccagacccagtttacctgggtatcaccagtggaggctgcagatcagcaaagattgctgcctgttccttgctctggaagctttgtccyagaggggcaccctccagatgccagccggagctctcctgtgtgaggtgtctattggtccctgctgtgaggtgtttcccagtcaggagacacaggtgtcagcgacctacttgaggaggtggtctagtctgacccttagtggaactcaaatactgtgctgggagatctgctgctctcttcagagctggcaggcagggacgtttaaatctgctgaagctgcacccacagttgccccttccctgaggtgctctgtcccagggagatgggggttttatttataagcctctgactggggttgctgcctttttttcagagataccctgcccagaatgtgggaatctggagaggcagtctggctacagtggctttgctgaggtgtggaaagctctgcccagctggaacttcccctctgctttgtttacactgtgaggggaaaaccacatactcaagcctcagcaatggcggacacccctacccccaccaagcttgagtgtcccagttcgacttcagactgctgtgctggtagtgagaatttcaagccagtggatcttagcttgctggactccatagrggtgggatctgctgagctagaccacttggctccctgacttcagccccctttccaagggagtgaatggttctgtcttgctggtgttacaggtgccaccggggtatgaaaaaatactcctgcagctagcttggtgtctgcctaaacagccacccagttttgtgcttgaaacccagggccctggtggcataggcacyggagggaatctcctggtctaaaggttgcaaagaccgtgggaaaagtgtagtatctgggccagaatgcaccattcctcacagcacagtccctcacggcttcccttggctatgggagggagttttctgacctcttgcacttcctgggtgaggtgatgccccaccctgcttcggctcgccccaagtgggctgcacccactgtctaaccagtccccatgagatgagctgtgtacctcggttggaaatgcagaaatcacccacgttctgcgttgatctagctgggtgctgcagaccatagctgttcctattcagctatcttgccagcctctcttgaaaagagctacatttttatagtcatgtgtcacttagcgacggggatacgttctgagagatgcttcaaggtgattttgttgttgtgcaaacatcatggactttatttaaacctaaatgatatagcctgctacacacctaggctatatggtttagtctattgctcttagcaacaaacatgtgcagcatgttactgtactgaatactgttggcagttgtatcacgatggtaagtatttgtatagtttaatatatctaaacatagaagaggtacagtaaaattactgtatggtattataatcttatgggaccaccctcatttttgtggtctattgtcagccaaaacctctttatgctgcatgcctcatgtgactgtatttgatttatgtattttgtttttttgtgctgtggcttcatgaatgacctgcctgtgtatttacttttaggtccattgagtgacatatattcgttttcaggataacataaaattattttcattttattcagcctcacttttctcaaccataaatttagggctgtctcatatcaccaaaggttcttctgtgactaaaattctgtattgtgattatggataaatgagtctttcaggattcagaatcacctcagaagacaatactgtagagaaatcaagtatatttaatcatacaactcatgtgtaatccttttagagaatattttgatgattttagatcaatttagtaatgcaaagttggacaaacagaaagcagctgcccaaagatgaaaactcagcctagaataactgatatttctaatcaggggtataaatgaaatatgagaaatatgaaattttctttcataaaaatgaattcatattgcttactatatatttggaattagaatagcaatctcaaatgctctgctgaagggaaatttaaaaattaacacaacacattttattaatatattgttcatgtaattgcatatattaacatgtaatctaggtaagttttattagaaatcgtgtgatggaataaatattaggtaacattttagggctagaggaaataatgtgtgttcacttggctgaatagaatgtggagcataagtggggaagtttttgaaaaagtgctttttatgaagtttaaagttcttagaatgtgcatatgttttactctattatgcttgttacgtaaagaacatcctatttaatacatacaaacaaattccatagacagatgttccctggtgacagaaattaaacacctacagaagttgtttgtagcagggctgcattgacataatagccctctttgagtggagcctaaagcaggaagatagcttaactgattgaaccttgtggtttcactctttagacctgcttggacaaacaaggaggtcagtgtgaaaagtctatttgcagattggtctcagaagaaattctcagaagtgatttttttttaaagccaaggaaaatagaactcctgtttttggtgcatatgtcacagctgagcctttctgtttgaagagcttcatttaataatttttgccttttggagtgtaggtgctagactatatcctagacactgtagcattgataaatgttaacatacagaggccgcgtatattctttgcaccaaatactttccttgttcacactgttctgtcacaaatctttttcacagggtgaggaagtgttttatgggaggccaagctactttttaaaagatggtatgaaaacatgaattgaaatgtattattgttattgttattattgttgtgtagtaagtcctaacttaatggaaatttttgtgttctggaactgtaagcaagttttgagtccattggaagtagaccagattttgatttataaaaaatatttggaaaaacaattagagaaattgtgattgagataattgattccaggcaatagcttatgatgttaaaattctgtgcaattacatagaatgtatattaaaatattgctcaactgtttaaccatcagtgaatgaagggagcccagaaggtctgtttagtcttaagtaattacagaagacaacttgtgtgttgtaaagtgatttttccacttaataactttggtaaagaactattagggataggagacttatatcatgctactgctggaattattgtaattaatttttaaatgggaattttatctaataaatcccagggaagaaaattttattttgaagcatgtctttcctatcacactcattattggctttttggaaaattattttagacatgtgtttgatttcatatttctgatgcatatcttagtgaatcaaaactgacatacattgccgttttagttggcatttactttactaaatgattggtacatttactaagtttacatgttattgttttaaagcgacagcaggcttaacttgagcatcatggctgttgcaggtactagggctctcgcctttgcagtaggatgaatatggtaatgacagtgcaagagagattccaaagacgtatatctcatcgctaactctattttagccctttgagctcgtcctttagttagaattttaagtttctctagggtacttcttaggcttcttttgctgtgcacagtgccctctcttaattaacagcagagtaatattgggcaaatgtctgagagcatcaatatcctcatctgtgaaatagtgttaataacatatatcacagtgtagctggtcagatccaaatgagaaatatttagaaagatttttaataagtaaacaagtgtttagtaaaacactttttaaaaacatctttcaaatgttatcttagttcactttaattagcaagttgaatcaaactgacagtctctttggcatttggtggtgttctagatagccagtagttactattccgttaagttcctctgagactgtagagaaaaactgtacattttgatatgttttgttgaaaaacatttttgtaatcttttaattttttttttaattttgcacagattgagatcagggaaagagactgacatatacttttagatgtctgatttcctagaggcaaatattttggactgagttttcctgtccaagtgttagctctgaagttcttaccattataatgacaacaaagaaaaaagaggtggtaaccccaaaaagaacagggagcaacgttgcctacctacatgcataaagctgccagtaatttgatcgactcaaccaaagagatagaaaaatttgaagtcagatccactaaatctcttactcttcctttagaaggcataaagtatatttcacccacatagcgtttacccaagggtgatattccaaatatttaacaacctatgtggcataggcaccaaggattcaggactggaacagcatactgggcctgccctttcctcctggggtttcgctctttagttgtggagttgtggggaatwtagggcaggtggcttattcagggattctgggagaggagactgggaacctcgtgtgggaaaggggtagttgggccctctattaaacagcagctgatggccaagtagggcagaaacccatgtgtgactattgaatatcaaccttgcgtttacctgaatgtgtctacccaaaactggattcataatactggttttcaattttgtcttatggaaacttgttcttccttttgtttactttaatcagttgtaggagatagttgaaggaataacttaatataacatttaattcctaacgttggcagctgaatgtataacttagatgtaacattaaatttctaacatttttaggaaggtatacagaaagcgttacctctaataagtaaaaatataagttctgggaaaattatttaaagaaaccctatttggaatcctttcataaagtgataattttaatttatcttgggcataatattggatctttaataaaatctttgctgtaaaatcagtattatagaaactggctaggcacagtggctaatgcctgtaatccgagtactttaggagtttcaggtgggtgggatcaccttaggtcaggagttcaagaccagcctgaccaacatggtgaaatgccgtttctactaaaaatatcaaaattaactaggcctgatggtgtacacctgtaatcccaggtactcaggaggctgaggcagacgaatcacttgaacctgggaggcggaggctgcagtgagctaagattgcatcactgcactgcagcctgggcaagagagtgagatttggtgattcagtttcaaaaaaaaaaaaaaaagaaaagtcaatatagaaccttaaatagtatatagtttttgaaggactaattcatatgtaattatggaaatgggaagataaccttaaattatttcaactagactggtccaagtcatctgtagtcagtcagtcagtcactcagctagtaaatgcctgaggcaaaacctcggatttctgtttcctrttatttctactgtaccctatctgtattcagaagtgatggtctattttataatctgtctgcttcaaatcactttggcaaccattatgatatatagccttttgagatatgtagcatggattttattgtttctgtttgaaatttggggaaactgagtcccagaatttcctggttttaggtcttatttcacttgtcatgctggtggatgtcaaagatgcagtttwtcaccattcctgtgtagctagccaaaggtatccatccgtgcttctcttggttgcataaaattatggtgagagttagtagatggtgcaggttcatggacgatttctcaaaatgcattttatgaaaacatgtcacagagagagaaaacttgatacttgtgtttttactaagacataatctttttttttttaaattgaatgagaaactgagatctagaggagcaagctcactattcaggaagatttactcatcaaactaagggtaggaatagtaaaactaattgaatcatttcccccaaatctacccttatctaaagcttatttcttcagctttagctggtcaatttctagaccaatgcccccacttccctgtaaccttctctggcaaaagcaatatatcttattatattctaccccacaatggtgagtctgactctagaacaacaaaatggggaaaatctgaatctagaagttccatttttcaggagaatctttattttgggctatatagcctgtgttgtctggaaaattgtcactgagttcttttagtacaattaagacagtctgctatattacaaaatatatacaaaagtgtgtaaaactgtcttatattgtgtataattacgagtaattataaaataaacacctgtgtaaaccacctcctacattaagaagtagaatattgtcttcacctcagaagtctctaattcttagaggtaaccactgttcctgatttaacagtaatcattctgttacctttaaaataatattatttaatgcattcctaaatagtagtagtataccttactctttaatttttaattttttaatttttttattttgagacagagtcttgctctgtcgcctgggctggagtgtagtggcatgctgttggctcactgcaaactctgcctcctggattcacgccattctcttgcctcagcctcccgagtagctggaactacaggcacccgccaccatgcctggctaattttttttttttttttttttttttagtagagacgggttttcaccgtgttagccaggatggtctcgatctcctgacctcgtgatccgcccgccttggcctcccaaagtgctgggattacaggcatgagccaccgctcctggcctaattttttatttttaagtatgtgttcaagtcctttgtctatttttcattctagtgagctatcttttcttatcagtttgtacaatttatatatgtagtttgactggaaacctaattgcttctatgggtcacagtgtcctgtctcattctgcaccatgtcttttcactcttcattatgttttctgttgagcaaaagttttttttcaatttagccaaatttatcagttatttccttgatggttagtgctttttgtgtgtcattttagaaatctttcccacctcaaggtcatgaagatttttctcctgtatcctaaaagttttatattttgcttgtgttcacattaagtcctgaaaacttacctgaagttgatttttgtgtgtgtcagagaaggatccaattccatttttttttccatatggacatctagtggtctcaatattgtcattgaaaagtctgtcctttttctgcttctatgaagtgtgccagttttgtcttaaatcaatgattcatatatgtatgggtctgtttctaggtttttctggtctgtcccatttgtcttttgtttttgtgatgctatataccaatgctgcactatcttcattgctatttatttataataaatattcatatctcataaagttcttacacattgttcttcaaaattgccttgttttttattcttggccttttgcgtttgcatataaatttgagaatcagtcagtttccacagaaacttttttgtgaatttagactgggataacatttagtccatggtaatttggagaaaactgtcatctttatatttactcttcaatccatataaatagtgtatattttcatttatccaggtctttttaaatgtctcaataacattttatgaagttatctttagagatttttgtatgtcctttgctagctgtagtcccatttagcaagatttctggtatacaagattaaaataaaaattagttatatctatataatatcaataaacataataacatttttaaaatacagcattaattaaaaaaatattctaagcaatacaatagcatttattctaaatatatttaaaattaaggtgtaaatttctcacacatcgtgttttgtcctttgtttcttktttgagactacaacctctgcctcccaggttcaggtgattctcatgcctcagcytcccgaatagctggaattacagccagctaattttcacatttttagtagacacagggtttcaccacgttggtccagctggtctcgaactcctgacttcaattggtctgccagcctcagcctcccaaagtgcagggattacaggcatgagccaccacacccggtcgtattttgtcctttgaactctaaaagtttatggtatttgagtctacaaatacagtagtgctgcatttaccaattatttgtacatttgtatcaattattcagaattatggaatattctagtttgagaagtaagagatacttgattttatagtgttaatagcaagaaaaaatrctttactttcttgcctatatttttgtttaatctttttaacaaccttaagagtagagcattatgatttctgttctatagcagatgagacctaaatgcagggatgttaattaatttgcacaatatcacagggctagaaagttgtgagtaccatgatctgaaccaggctgtgtttaacaccaacatccatgatgttttcactataatattttgccacatatcaataactcctgagctcagtgcagtatttcagcatggggatggtaattgattatgataatgagaaatctgaagcatcaaaagactaattaatattcagtttattctgttttattaggcgtaaaagagggtactacatttttcagatttctattcaaaacattaaaatcaaagtttaagcctgctgagcttcaattaatgattcaaattaattaaaaatatttttcctatagtaaagagaacatataatgcatgaatgtagtactcattaatgctatatatttgttaaaatagaaaaatgttttatatttaaataytccacattgtacatagagcccaattttttagcataggaaaaaatgtgaaattttagcttatatttatatatcttttctccttctgtcagtgactgccaccttgccaaatctgtgggagttttatgatctgttatcctctgagatctgtggattcatttaacattttgctgtgattttattggttttggaatcaagaaccaaaatctgaatatagttcactattcatataacaagatttaaggatgtttagtttttaaaagttcttttggtccatattagatttatttctgtttgactaataagtagatggaggaaaaagaatcaaacactgcatatggtttctggaggtatgttttaataacaaaatcaagtctggtcaatgaaagctttcagaaaatggttttataaaaaaaccttgcattctttttagatcaagagcagttttcccccaaaccttaatgtcagtcgtacgattttcttcttcttattttctgttctccatttttgcttatttgttgaaaacattttttagctatgtggagacttgcctgaatgctgtctcctatttaggtagaggccaataagatgatagctggaaaagcttcgattgtctrtcatgaagaccaggatggaataaaagaaaaataagtaatgcagttgtgatattctgcagtatacttcggctctcttaataagatcatgctgtaagcagtgtcttttaactgaagcttgcaacctgttggtgggtcatgaagtagattttaaacattgcaattagcattttatttaatgaatagacatagaatagcatggaaatttaagagtgactatagacttaagagaattgtaaataggacaagtaaaatagaaaaattaatgtatcacacataaaaaggggattttcatgaaactttagtattagttccacagacacacagatacatcaaatagcgtgtgagtcaggatttagtccaggaaacaaaaattacatttatttaaaacaggaagatatttaatacaagagaatttgatgcttataaaatagttggaagatctaagatatgagttctaggctgttcttgctggaatgactttagggagtacagaaatgatccacccaagagccagttatagctaatatggttgctgcaactgtgwgttatgaatatactcctcttgctgcaatccagtaatcaggaagccagagttacactgctaatgctgtagtcacaattgcctcttgacacccagaaaattggaaagtgccacaaaaagcactgctaacaccttgcatttctttatctttgtttgcagttaaaacagtygaaaggatgtaggaaaatggcttctgcttcgcttctgtgttcattatcttagatgaattgcttctaatttgcagaagcgaattctcatccagaatttgaactgcaagagaaatgttttattattgacctctccagtgatctagactgagggtaggagggcagataagagaatccatacacactatccaactcagttcatcaatttgatttctcaccactcacactcactcttccattcatgcttaagtttccaaatggcaacactagtggtgaaaacatgctgctgtcgttcatacacaggaaaagtagttcacttctcctccaaagtgagtgagagcaaagtcactgtacccagtggagagacttttctatcccatagagatacatactgaagtattcgcatattgtctgggatttgctttaaagtactctggaaaaaaaagagggggagggagagatgagacttcatggcagaaatgttgataattattgagaatcaattatgagcatatagtggtccattatttttctctgtttttgtatatgttggaaaatttccattattagtaatggaaattttatatataaatgtatctgcttttctttaactgaaaaaaattgagataactatacaaagaatattgattctccttgttttctgaaatttttaaattagtgattacattcataaatataaagcattgtcactcttggcctgttattttaaaatgaaaatgtcacctggagttatgataataattattaggaccacatgtgttatgaccaaaagtgatttcatatctattttaatgaattaggattagaggagttaaataatcaacttagtacatctgaaaggttcatggctgaatcttcttactctaaataccaggtttgcactattgtaatatccttaagttgctctctatcattagcacctttgaatatgctctattcatacattttctttccttagcccttgttgagaatacaaatctgaaagaatgctgtgtgtgtgcgtgcgtgcgcgcgtgtgtgtgtgcgtgcacacacgtgcactttaacactggattaatataaaaattagatattgagtctcccagtttcagttctgacattttragatcaaggaagttgttaatcttggctaggtgtggtggctcacacctgtaatcccaacactttgggaggccaaggcaggaggattgtttgagcccaggagtttgagaccagcctgggcaatatagggaaaccttgttctacaaaataatttaaaaaaaaaaaaaaaagctaagtgtggtggcaagtgcctgtaatcccagctactcagaaggctgaggtaggaagattgcttgagcccaggagtttgaggctgtagtgagctgtgattgtgtcattgcactccagcctgggtgacagaacaagaccatgtcttaaaaaaaaaaaagacgttattattcacatcgttagaacaagaaaaaactggacaaactgaaaaactagtgacttttcttggaccctgaagcagatatttgaggttacagggcaaaccccctccctgaaatctggagacaggtgcctccagagagtctcagccaagatctatttacctggagaagaagctgctagagtcataaactggtaggaacagtttaaatggcaattttgataaattgctgaagactaagtattcagcagggtgtgacttagaaactcctacctacctccccaccagtgttcatgggctttacctataaggaaccccaccagtttctcacagatgatctgagaatgattccctcatggccctggtgggagaagtggacaagtaatcatcctaaaatgtacccagagcctttttttaataaaatgtccacactccagggtgaaagactgtatcagagccttgtgctgcagccatgggagtaggatattactgcctgggccctgtagccttcctgcttcactgaaggaattggaaaaaacaattcatgaaaaaacttgtaaaggtcacaggctagagacaaagactcactaaaagacattctgtaatctctgattaaacagaggtttagtataatcagagattatagaatgctactccttgcccccatttcactatcacactggcacgtctccagtttaataacagcagatgacagctgaaagaacttcaagacacaaattccctccgaggaagagtacttaaagaaacccatagttaaaagggaagatgaaaacaagggcactgcagaaattttatacctctagcaccctacagcaaacgttagacagcccaacacatagccagcagaacataaatcctcataccaaaagcccatgtacctcattcctatttcccattataacatgtccactttcaacaaaaacttataaggcatgccaaaggcaagaaagaacacagtctgaagagacaaagccatcatcagagcccttatcatagatgacacagaggttggaattataagacaggcagtttaaaataactgattaatatattaaggactctaatttaagaagtagacaacatgcaagcacagatgggctatgtaagaatggagtcgaaaactcgaataaaaaattaaaaggaggccaggcacagtggcttatgcctgtaatccagcactttgggaggctgaggcaggcagatcacttcaggtcaggagttcaagaccaggctggccaacatggtgaaaccccgtctctactttttagttgggcttggtggtgtgtgcctataatcccagctactctggaggctgaggcaggagaattgcttgaatctgggaggcagaggttgcagtgagccaagatcatgccactgtactccagcctgggcgacagagggagactacatctgaaaaaaaaaaaaaagtattaaaaggaaatgctataaatcaaagacactgtaacagaaatgaagaatgccttcagtgtatcaatagacttgataaggatgaggaaagaataaataagtttgaaaataggtcaatagaagcttcccaaattgaaatgtaagggaaaaaaggaatgaaggaaaaaaaaaatcagaatagagcatctaagaactgtggatcaatttttaaaggtgtgacatacccataattggaataacaggaggagaaagagataaaggagaaaaatatttgaagtgataatggctaacaactttctaaaattaatgacagatagaaacccacaaacacaggaagctcagagaataccaggtagcataaatatcaaaacaaacaaaaaccaaataccaacagcccacacctgagcacatcatattcaaactgccaaaaatcaaagacggagaagatcttgaaataagagagacggtggaagatacatctatcctatagaggaacgaggatcagaaaggtggattttgaagcaaggttgcatatattctatgacatgtaattgtaccttcaatttcacatagatgttttaaacacctaccatatagcatgttttatgaaagataatacagataaataagacctaataacttctctctctcccccagtcaaataactaaaatctagtagaagaaagtaaaaaaagtgtataagtaaaaatataacacagattttaaagtatcctagggaggtaccaaaaaaaaaaagtgctataagggatttagaggaggaaaagatagcatggctgagtcagtaacggctccatgcatgatgatgttaaggagttattttacttataagcagccagcatcctttgagaccagcctgggcaatatagggaaaccttgtttctacaaaaaaaaattaaaaataatacaggatattattttaataataataatacaggatgtactcctgttgcccacaggagttgactcagaacttgacctttgttattttcctctcgtttcttgaaatttgtatcttctcccttactcaggttattttgctttctgttttactgagaaaatagtgatcatagagaacttaggccatctttatctccatcctttcccttgtgccacatctagatttcactaggcacttttcattctctgaagaaattgtttaatctactctcgaattttagttactggcttgtcttgcatgattattttgatgatctgttgaattttttccccaatactgccctcccagcataatatgcattctccatgaaagagattaatcctctctctccctgctgaaaatcctctacagttctcaccttggcctccagaataaaatctacctctttagcctgtctttcaagggccttcttattctgccccaaactatagtttgtgatttctgagaggagatatcccatgaaatattttccaaatttatttgacagaaatatccactttgtatctcctgggtctctaatgttttgcagagtacagtttgggaaatgctgggattgaaggaagaacgtgaacatttgggaaagggaacaggagggaaatgcatgactaaggtcatcttagtagtaatgagcatggagaatagcccagctgcatatgaggttatgacatacattagtagacgaatctcaaaatgctgatttcttctccaaggtttttagaatgatcccctgcgtctgtttgtaatctgcagagactgtcatgcagaaaaataggaggaaaaacctttccgctctgaatctcaggagaaaaaaagattttaatcatgtttctggaaacttgcattggtagaatttaaagtcttccagagagctcagttttatttcatttgttatcatatttcatcttgacaatgtaagtgtagattgtttgacaaatttaagaagaatgtgttttcatttcttatgcatttttgtgcagcttttctatagcctccctaaatactatttgtatttatccaattgtcactctaaaatatgaatgtatacttgttaatgttcctattgcaaaggctgtgcttcgttcagttttcttttatttgtagtttctcgtaactagaaatctcatgcttttctgaaataggaataattgaatatttattgacatgtccttaaggagtactatatcactctgaagtgacttatggcacatcaaaaatattaactatacattattactatacattattttacttattattataatttaaaatttcattatttcctgaaaattttttcagtgagacttccagaacctgtgctggaaggataaatttgagatctatttgcacactaggtggtgcaaatagaagttacaacactttacatggcacctttatttaatcagaggtcaaaatacatggccagtaatgtagtacatccttgggaacaggacattatttgcttcactcactggtggggagagggtcctaccatccatctcgaggcscttgggcaataggttttacttgggaaggtgatgtcagggaaggcaggtagccaggtgtgcttttactgccctcagggagttcctagtctacttgtgcatgaaatagacctatatgtaagcatttaagatgataccaaaaatattccgttttccaggaggtgtggagttgtgagtagacaaggaagaataagcatttaaggaatacgtgatactcatgcatcatgtgcagtgcaatgggtctttttctgaaattttgtctacacaacctaaaattcctacttatgctactatttttaaaaactgatatgttttattagaagagtcagatgacatgtctgtttagaagtagaactttttatatcaaatgaatttaagaatgctatcttatgaccttgtttttgcatgaaggcatctataccatttttcatctcatcaagtgaaaataccaaattttggtaaagttgtacttcatttatgatgccttgaaaaataaaccatacacgtgattcatttattacacatttaggctgttgatagtgtgtcagttttattatgcaaaataatatctttctgttcaacacacctgctcttcacaggtgtatattaatgaggacttcatgatgtgttgatctaaagtaaaacttcttgtcgatgttgaatttagtcaataggttatttttatgctcaagaaaaggtgaaagatatcatcaagctgacaaaatacaatggtttttgtatcatctacatgttaaaataaatttcatgttttgaaataatccacacattgaaataaacagagtttagctgatgactctcactttgaaattttatttttctggtacatctaaaagtatatttttgttaaaaaaaaaagtccctttaagacagattttaggtactccatttgctacacaatttcattaacttagaaccatatttttaaaatgttttctccacacaagtaagatacatatggaaaatttgctactatgcagtccctgtagcatatataaaaaatgaggctgctaaattaggtcttttcttctttaccttctttaaacctacgttattcttttgtgatatttccatcacttaagggaatgagatttcaaattaaattctagagagacttaaattccccttgagttttcttttacttgaggtatgcctatgctatggggtaattagtggtacctcagtaggataatataagcagagtggtaagacatatctgccttgaataactgtgtgagaaaaaacaggcacatttcactaaatacccttgcttgtgctttctataaaattaaaatattttggacagtaataacatacaacacaaatgaataaaaacttgtacatgatgttttgtgtggagtcctgataagtaagcaacaaggaggaagggccccagatggggaagaacagtgaacaactgttctgagagatggctaatcacaaacaacacaagggcacagtgatctcgacctacttctgcaggcacagtgaccttgttctccaggtaccccctctagcatgaccctgtaaaacttccctccagcccctgcatctttgcggacagcccccttctctgctgtgctgcctgtcttacaacatattttcatactttctctaataaatctgcttttctttatctactattgtcttgttaaatttccttactgcctgtgccaccgggcccagatagtcactagctggcaacatttagggaattctaacatcaaattcctctaacgataaactgttaaaacatcatctctagacccagtcttaactttcctcttactggctactccatgccatttgttttgtactctgattcttccagttctgtcctgaaatacctaagcctcttgttcattaattttcttagggtttaaagtacattaatatcagaaataagattagtggatcactccttagtttgatcaagatttaaatccttcttattgcagaagcacaacaatacattggagactgcttcaaaactcaactgaaaaagagaaaaatcaaaagaagccttaggctaggtgaacaggaaatgaggcagttacagtgttttagttgtttgtcctttatttctggagggggtctgccagtggctgttctaactgctccctcttgcctcagatcttgaaagccacactttatccatcattctcacctatttactaaaaagaatgagccacctgaagggacttccctctactttctcctcctctaccttaactgtggctctttatactcttttcctcctgtgtttcctctgctttatgtaagtaattgaagtttaaaagaaaaaaaatatgaacatttttgcccatgcagtatcatttgcaagatcaggaatattatctcaagtttctaacttgaaagggtctaatgagtctaaaagagaaaaaagctgaaaatgtcttgaaaagtaagggactatacaatcaataagctgatattattaactatttttttcaggatttttttttttttttttgagacagtcttgctctgtcatgcaggctggagttaagtgacacaatcaaacctcactgcagcctcaaactcctgggctcaagcagttcttccaactctgcctcccaaagtgttgagattacaggtgtgagccaccacacccagctaattaaatatatatatatatataatatatatatatttttttgtagagatggaggtgtctcactgtgtggtccaacctggtctggaatgcctgcgctcaagtggtcctccctcctcagcctctcaaagtgctgggatttacagagtgagccactgtgcctgacctcagtctttgattttgacatagtttgacccagtttttgttagtggaataggtttggttttaaaaatttaagtggtttcagtaaagggcaataaaaatgatgaaaataatagaaaatgggttctaggactagagttgaaaaggcttgggtcttcattttgtccttagaaaattaggtaagatgattgactccttttaactccttcaagcatgtgaaataatatatttgttagtggtggcaaatatccgagttactggcagcaaagctatacgaatctatggcaacctcaattcttgcttcctaagaagaaataattcgaccgaggggcatgcagtggaaaaagagaccaaggcaagtttccgagcaggaatggaagtttattaaaatgctttagagcaggaaacaaaggaaagtacacttggaagagacctaaacgggcactttggaggtcaatggtggcgtatgaccttttgatttggagttttatatgttggcatccttacagggccttgtttaccttttcccatctcttagggtgggctgcccgcatgcgcagtggcctgctaacccttgggaggtgagcatgcgcagtgtgtttaagaagttgtacacatgctcacttgaggctttcttccctttttcagtggaatgcccctggaaggtcatactctgccattttgtctcttaatgcacatgcccaagcctacttgcccaattcctgagctgccagttaccaatttcaagtgtttttatctattgtgaaattgcctctttttggcgcctgtgaccaatgatcatttttagagaagtggtgtgtcaactgtgggaccatcacctgatggttgcctgacatttctagtgggcgaggggagccctcttctgccctgctcatgcctaactacctactgtatggttgcctgacatttctagtaggcgaggggagccctcttctgccctgctcatgcctaactacctactgtaatatattgatgcaacaaaaatcaaatggagaaaatgggcttataatggagcaacagaaaatagttaattataatttctgaatttaacgggttattaaacacataccaggctactaaagaaggctgtataattatcagtgttgagtatcattaagattaggtagtatttcttttcttttgtataattatcagtgttgagtatcattaagattaggtagtatttcttttcttttttttttttttttgagacagagtctcgctctgccgcccaggctggagtgcaatggcacaatctcggttccctgcaacctctgactcctgggttcaagcaattctcctgcctcagcctcccgagtagctgggattacaggagtatgtgccaccacgcctggctaatttttgtatttttagtacagatggggtttcaccatgttgacaggctggtcctgaacttcaagttcttggtcttggacttcaagtgatccatctgcctcagtctaccaaaaggctgtgattaccagcatgagccaccatacctggtcaagattaggtagtatttctattaaatgtttcagatattgtattttctaaaagcagataacccgatggcctttggcattgcctaaaaccttttggactctgctatttgataacacggaattgtggaatatcatatgaaactcttatttttctcttctgttgtatttaaattctttcttaatatgcacattttctaagaagatactttttaagagagaaaagatagaggcctgcatgggtaatacttggattgagcccagggaattctctgtcatgcattttagctatggggacatcagctgctacttatttgctactgatttctcacttccttctttttcataccagctttcaattgcttgtttctaaacaatgcgttatctttgattaaattagaccagtaataaaagctcgtgaatccttraatgaaaagcacacattctggtcttcttgaccctgcattccaaaattattctctaatgtttataaccaccttggtagataaagtcttctttttccttctcagagaaacggtttgcagccaactgtgaccactaagctaaatctattgcggtgtttgtaattgaaagctttttgtatgtcttggttgtggtgctgggctctctcctggatttgttgatttcaacaatggagtaattcaggagaacagagagggaccagttagagctctccaggttctgtgtaacacacaccatagttggcagcagctgagatttgcttcatatttatctctaagggcgttgtggtggttccagccccaagattaaagtcagcatgtcatctctttttattatttcgaatggctttttacttttatagtatacatgaataaattttatcagcagggactattaagcagtgtttcggcacaaatgctttagagtacattttttagttgatgtgtactatgccagttatagagagctgtcaatacagtttcagtcttcagtgacaaaatctatcattttctaacttgctagaaacctttctttttagaaattcactttttgagacataatggcttcaattctccaggatctttttctgtctgttttgaatgagcttattgtttattcacagtaaagaatgtttctgatactgctttgttgtaaatatagttgagtgccctagctgacatccttgttgagcccaaaaagactgtttgagtacactttttgtcaggtggtacctttgctgaaactgaagaaggagattttgaagaattttcttgatttcaccagattattttaatggccttaaattttccatttaaatttgcaataacttttgccagttatagagagtgattcattggggaccactttatcttttgcattgtggtatgaggcacagatgtaaaggggacacattcttggggtagctttttctattaggcctttgcagttggaagtactccatatagaaagtgtttgaagtttttacaaaaatgtatgctgtaggctgaacagatagaacaaactataagtataaaaacatgctggttaataaatctttcctgtttttccttagacagaattcagttttatttgtattattaaacaagagtaagactttaattatactttcccaagtagaatatttattttaaaaaggaatagctgttaacagaataagaaaacttcattatatttttaattactcatctaattttatgtaaaatgaaatgtacattaaatggtagtacataaagtccagcataaaactgcctatagtacaaatgttgatatttatttcttgttcactaggatgacaaaaattgagagcattttctccttaatagttagcatctattaagtctaatttatggcttcttgtaattcattcatttatcatttttaagtattcattcaacaaaaagttacataacaaagttttaagataaacaggatcagatcatacttagcctcaaagaagtaatctgagaagtttggatatgaaagataaggaaatactatatgatgagtacaataatagaaatattattatagcagtgtcttggaagagcaagtaattggcttgagtagttaagggtaaattttctggagaaattaacgtatatactggtatttttttttaaccatgacagcgttttgttgttgttgttgttgttgttgttgttgttkttttgagacagagtctcattctgttgcccaggctggagtgcagtggcgcgatcttggctcactgcagccttcgcctcctgggttcaatctattctcctgcctcaacctcccaagtagctgggattacaggtgcctgccaccacgccgagctaattttttgtattttttttagtagaaacggggtttcactatgccggtcaggctggtctcaaactcctgaccttgtgatctgcgcacctcagcctccgaaagtgctgggattacaggtgtgagccaccatgcccggccctatgacagctattatttttaattactgtgtttttattgatataaccatttatataagtgtatctgttatttgaaattatttcagttatatctataaatttacaaatactgagaagtaaaaatgacttgggcatttcaaaatcatgttctacaatgtattgaacagttgaaaaataaagcaaaagagaataaaacaaacacaaacaagcacagggagaagtctggtcagaccctgggctatcatgcttctgtttgtgtgaccactgggtgcttggttgtagcatcccaaacccacaccatgccggaaagagatatgcataggagtatgtagaaggtcacatgtggaataaacttcatcaacagtcacttccaggctccatatattaaaatttcagggattaagatcagaaggaattgttccaatttgtttattttggagaagaaaggtcaatttttacctccaggggataaaccactaatttgcgaagagattgggttaaaaaaagaggaccccacctacttttaaaaataggctttactttttagagcagttttaggttcatagtaagattgagtggaaagtaaagagaggctccatacataccctggctccttcccagcctctcctactgttaagatcctgccttactgtggtacatttgtttcaatcagtgacactactttgacacatcattatcacctaaagtccatagtttacattggggttcactgttagtgttgtatttttcatgggttttgatatatgtataatgacatatatccacatcatgcactgtggtattattttctggccttaaaaatccactgtgctctgccaattaatcccttcctcctgccaattgctaatgtttttactgtctccctacattttgcccttttcagaatgtactatagttggaattttgtagtatacaacctttccagattgacttctttcacttaaaatgcatctcagtttcctccctgtcttttcatggcttgatagatcatttctttttagctctgaatagtattccattttctgagtataccacagtttatccattcacctgtgggtgctttcaagttttgacagttatgaataagctggtataaacatctgtgtgcagatttttgtgtgcacataatttttcagttcatctggataaataccaaggagtgtgattgctggattgtatggttagagtatatttagttttgtacaaaattgccaaactgtcttccaaagtggctgtaccagcaatgatgagagctcctgttgtatcacgtccttagcagcattcggtattgttagtattttggattttggctattctaatacatgtagtgggtatcatgttgttgttttaatttgcagttccctaatgacatatgtggagcatctkttcatctacttatttaccatgtgtatatcttcattggtgggatatatctgtttaatcaaattgattgttttgttattgttggcttttaagaatttttaaattactttagataatactcctttatctgatacctcttgtgataggcatatctgaaggatgtgttgccatccttcaagataagaaatataaacaagaggctgggcttggtggctcacacctataatcccagcactttgggagtctgaggcaggtggatcacttgaggtcaagagttccaaaccagcctgaccaatgtggtgataccctgtctctaataaaaatgcaaaattagctgggcgtggtgatgcatgcctgtaattccagctacatgggaggcgaggcaggagaatcgcttgaacctgggaggtggaggttgcagtgagccaagattgtgccattgcactccaccctgggcaacaagagttaaactccatctcaaaagaaataaatacaagcaagaaagcaggctataggagaagatagtttcattataagtgtgttgaatttaaggcattttaattttataagtaggtaaggatatagacatttttaagcatttatatcatagaattttataatattgcatcattaaattttcttcttcctgctggatgtctctaaatgggggtcccatcagtgccaaacttgtttactggcacaagtaaattttaataagtccagcttatcaattctttctttcatggtttgtgcatttgtgttatatctaaaaagtcatcactatccagagttatctagattttctcctacattgtcttctaggagttttatagttttgcatcttacatttttacatttaagtctgtgattcatttttagttaattcttgggaagggttatggtctgtgtcttggttctttttttttattgattcttttttttttctttcgaatagggatgtccagttattccaggacaatttgttgaaaagactgtcttttctccattgtattgtctttgctcttttgtcaaagatcagtcaagcatatttatatgggtgtgtttctaggctatcgtgtacaattgatctgtttgtcttctttcaccagtacctcactgtcttgattactgtagttttatagtaagtcttgaagttaggtagtgttggtcctccaactttgttcttctccttcagtattgtgttaattattctgggtcttttgtttctccatataaactttagaaccagtttatcaatatccacaaaataactttctgagattttgattgggattatgttgaatccatatatttaattgggaaaaattggcatctttatacatgtcatttcagaaagaggaaatagtatgtataaatttactgaggtatgaaaaagtatactattttctggggttacccagtttgctactattggaacataccattcagagttagaagataaaactggagaggtatttagaaactcaattacaaaagatcctttatgccaaaacaacaaaaaaagtcagccatgaccatcactatttattgaacatctacagaaccagatgcattaaaattttttttttattttaattttttttttttttttgagacagagtctctctctcactcaggctgcagtgcagtggtgtgatctcagctcactgcaacctcctcctccagggttcaagtgattctcctgcctcagcttactgagtagctgggattacaggtgcacaccaccatgcccagctaacttttgtatttttagtagagatggggtttcgccgagttggccaggttggtcttaaactcctgacctcaagtgattcacctgtctcggcctcccaaagtgctgggattataggcaggagccactgtgcctggcccagatgaattttatagtcattgcctctctttactataaggaaataataaacagtcagtaatgggcttaatgtcagggagactacgaactggcttgaaatttaggaagattgttttgccaaacttgttaattggtaaaaagcaagaatgagaaagaaggcaagataagaagctattttagtagttcatataagagattatgatggcctgaagcaagactgtgatagagggaatggagaaaagtggaaggattgaagagttagttagaaggtggcaggaatctaatggttgaaaaggaggagttaagaatcgtacccaggtttctggctggggagccccgtggattgtgttgccatccttcaagataagaaatacaagcaagaaagcaggctataggagaagatagtgagtttcatgacagatgtgttgaattgtaggcattttaatttttgaagtaggtaaggataaggacatgcttaagaatttatgtcatacaattttataatgttaagtcattaaattttcttcttcctgctggatatctctaaatgggagggccttgtcagttcctcatcttctctccaaagccagatttttcttctgtgttcccagttttagttattggcatcaaccaatagtcaggaacttaggacagcaatcttgaagtcattttcaatgttctgtttccctcaccttatgtgtccggtcagttgccaagtgccatcaattctaagtctgcaatatctcttttacctctgctcatttctcttgtcgttgtgtctgctctatatcatgctctcatcatttctaccctggaaaagctcaaaagcctgggattctctgcatgcctctagtctccccttcttccagcctattattgactaagcccccagaacaatcttcctgtgtgataaagcatgctgccttcatggagcctgtttcatttctttgtattaatagtagcattggtgggacgacttccctccatcctcactcaggggaagtttcattaaaatgttgttcacagttagggtctctctgtgttgagatggatgtgaagaaactcattgttaaaagaaaagcaaataaagtgattaaagttttcataaaatcaaatctgaaggaatgtaatagaaatgggttatggctttcatcagtaaggtgttggtatgtgcttgtcagttttttacaaagcagagggaacagggaatagagtgaatgtggaacttgaacctcacactaaggaagtttttgtataattttcccacaatgcaactggctctggggaaatttcattcatgtacacaaaagaagtattgcagcaaaattcaataaggttttaagtaagtttcttaacaccaataaaaataaaaatgctagataacaggaataacaatattggaaactgcgtagaaagcctattcgtagatgtaattttacttttgaactatgatgggagagggggatgaaagtgaagtccaatactcaattttggagagggtgcttacaacttggattcctaatcctgaagagaaggatggcagctcaatacagaatctgtttgtgaggcacttgttacattgctgtatgtggtggtctgtaaagtaggcttacaaggatcttccctcatttaggtttctactgacctcaccaaactttggtctatttgggcagtaggcagtagcttggagaaagggaactgcatgctttggaaagctccctaacaaaattcattatacattgctctatagaagtatatagcgttcagctcagacaggtctattgaagataggaaagatctgaagggcaatcacaaaacaacgtttagcctaaaaagaaagaaatgttaaatcagctaaaataagtatacatagacagtttatgttgagtatacagagaagcatgacattttagaatagatacattgataatattagattagtccactatggcttcctccagtggttccccactgtgttttttttttttttttttctgagagggagtcttgctctcttgcccagctggagtgcagtggcacaatcttggctgactgcaacctctgccttctgggttcaagctattcccctgccttggcctcccgagtagctgagattacaggcgcccaccaccacgcccagctaattttttttttttttgtatttttagtagagacggggtttcaccatgttggtcaggctggtctcaaacttctgacctcaaatgatccatctgccttggcctcccaaagtgctgggattataggtgtgagccaccatgcctggcttttattttggatttaattctatatcattaccgtacattgtctggaactagggtgaccatttaatttatcattgaaattagaactcttttgagagtaaaaggaagtgctattactgattgtacctggagcacaggtgtgtccagtcctgtcccaggtgaagtagaaggtgtggttactggagctataaggccctatgcgtcctggctccctggtccctgcttgtccctgccacactaactgcttgttttttccatcttccacatctgacctttttctctttcttgactggtctaggtttgtacttgcccccagatgagctcttcttcccagcacattgacatttgtgtttcatagcattgaatagtatttgaaaatttttgttttatatttgtttacttgtttcttcataaaatggaaagtggggactgtgttgatctcattcattaccctacttccagtgcttagcacagggcctatttgtaatgttcaaaaatgttctttgaataaataaaagcaagttaactattttaacttacgtgatcaattcctgatgaattatatgtcatggtgttaaaaacaaagttattttaggaaaaagaaccttggtataggagggagagaaatctatgtattggattaagcattcactgactgtccttccctccttgatacttctatttccaaatctgttaagtggagataatatgtgcattgctcattttgccactattagcataaaataaatgtttgggaaaggactgtgcagagtgttagggggcattttatgactagaagtattattatatattttccattcctctccccagttaaaatattgctattttccaacctccccatttctgttgagaactctagtactgaagttttctgttgagaactctagtactgaagttttctgttgaaaacttcaaaattcttaaccctacccattcttttgttcttgatatggagttaattttataagtcctgttaattcttccttggaaacatctccagtttcagtttttattaccactacttaacacccacccctagtgtcatcacttttttctagattgctatgaaaacatttaacatgtttgttttctcttctccatcgagctcaccaaagacaggttaatcttctttaaaagtgatgtttgccaataacctttagtgatccccatagcttatttgataatatccatatttttaagcctagcctttgactttagtcatgttaattctgcatcatgtacatctccttggtttcttattagtacactcatttctgtctttttcttttgtctctcattctaccccagaatgcccttttgctcaagtaccttgtactctaggaagcgtttcctgacaatacactctaagtttgacctcaacatacgttaggaatttcttgttcttattttctctcacataaaccattgcatacctatttgagcttctacctactgagaacctaccatgtgccagaataacatactaataagcattgctaatcaatacagagcaaccccaaataagtattaatccagttatttactaacttgtattgttatttaactgttgtatataaatatgtttccattataaaaatttcaaaagctttcagaaggcaagactcatgtctcatacttctttacttgcatatactattagcaatattaatttctcacttttacttgttaaaatggcatgcatattttacatttcctaaaggctgacatttcttatcatgggcacacttgatacctatggatttgtgtgctaaagaactttaatggtccaagaagttcttatctaaacaattaaattggaatgacaaaagttcagtgaatttggtatttttcttgtaatctttcattattcaggaacaagtttatagacataggatttatgtggtattcaccctgccacccaacagatcaatatgctggtttatcgtcatgcaaagataatttcagtataacactggagtactttgagcagcatagcagatatattttttcttgtagtactggttacttcaaaccctggggctcacagtggtttgaggttaatgaagtgttgcattcttattaaccatggtaatcttatggtgtcacaaaataacaggctttccttgccatatgagtttttcccctgccatatgattttgcagtatttttcagtttgcaaatattgcatgcattgtttgaccatattcccagaagttgctttgtgatagtcaagtttgcctgaagtaatactaatggcatttacagctgtatgtaatatgaattcaactcatgaaagttatcactgatctgtttaaatgaaatattttaactagtatatttttgcaggtatttgctttaggagaagctcctaagaaaaaatgattcaatcttaaaaaggccaaaatctaaatgaatatttatgtttrgacattaattatgtcattctgccagaccagtttttaaaaattatcagacacaccttcactaaactttgttagacaacttcaagttatatataagaatagattaagttattaatgtgatttactgctttaaaaattgttgaattttgatctctctctccatgacaaatgtattatttggagacttcacttagaaaagaaaaagaggaatttatgacttcatcagaagcctcattagggaatatgtttggctttcatgttgagttgtctttttttccttttctttttttctgctgttgtttgttcccaagaaattcacagtctttgaactcacataatttgggggatttcaaatactgtatcattcaaccacagctgttttagatatgccacaaattgtagttctatgaacttgattttttcccctgaacatggagaaaaagcaaataataaagaaaagaaaagggggaaaatttaaattgtctccgtagtaattaaataactcatacagccaaagtgctatattttagtagtaactaccttgtttttaatgtgacatcaaaagctgatggtttgtttctcatttagtgcagatgtgaaatagtctacatctctagaacggtttaaaagaaattatggtcatggtagagagatttaatttgggtctactccatgaacttgaggcattttccccacaaagaactagcagatgaatttaggtacattaaagaaatgattatagacagcttatacaacgtctaaaacttgggaaaccatccctctgtttaattttttaaattcctctcagatctcatttgttaataaccctattcttactcatttttattccttgcacttacccagctttctgcttgggataattttcagtgtgatagaatccacttgactccttcttcctatgccctttcagtatagtattgaagaggaattcattatattgaatgaatgttcttaaatttgtttcacttacttcctctctaataatccattttcttctcagtttgaactttaggtatgggtaatagatcaggaattggggagacctttgttctaaataattggaatgaccatatttgtcaattagagagatatgtagaccaatggttataaaccagagtactagaaattcttgtagaacatcagggaacatgtattctgaagtttgtaactggagagtctgattcagtaagtcagaagtggccctgtgaatgagtactgtaaataatcatcttaaataatactgtaaggattggtcttttgttcctttgtagattgacctcccaaaagttctacctttagttagattgtttagttgaatttataagtaaaaaataatggcttaggctaaattaaaattgttaactggactatttacagatcccttactaggtattagatgttataactgggtaagatagagaatgcaaggaatttcaatatgtttttcctggaaaaaacaaaacaaaacaaaattacacacaagaagatgtacatctgggccgaagatgcttttagagtggcagcttctttgttgtaatttgaaccaagtaaatgagactaaaggggagaatgtaaactgagaagagaagagggctgtggaatcctcaggaagtacagtctttagtgtctggttaaaggagaaagggtctgaaagggagattgtggactagttgctagagaggcaggaagaagacgagaaagatatgtcatgactatcaggccaaaggaaggtttccagaaggaaatagtcaaatgtgctgaagctgttgtaagaggtcaagaaaaatgatacaagaaaattggctttagcaaaggaaagaaaagggatgggagtgggatcgggggtggagcggggtggagtagggagaaggttcttacatcaaagctttagttttcttttcttttcttttctttttttttttgagatgaagtctcgctctgttacccaggctagggtgcagtggcatgatctcaactcactgcaacctctgactccctggttcaagtgattcttctgcctcagcctcccaaatagttgggattgtaggcgtgtgccaccacatccagctaatttttgtatttttagtggagacagggtttcaccatggtggccaggctggtctcgaactcctgacctccagtgatctacccaccttggcctcccaaagtgttgggattacaggcatgagccaccacacccagactcaaagtggtaattttcaaactttagttattcatgtatcacctccatgtgttttttttccatttccaattgccatgctaactatttttcactattttatctttacttttgtaggtattataatttcatggttaaaaaatacaaattttattaaaaggtataggctaagatttattttaccagtcatcccaaacgtcttctacccttctcctcattgattataacagccattcttactagtttcttgtgtatacttttatatttctttttacaaaatcccagagaactcttttaatagctttttagtcctgtgaaaaccccactttttctttattcacattttacggaggctaaccatacaagagaataaccaagtagtaataggttgaagtttctcagcccagactttagaaggccttgagtcagtgcatctgactgtatgatcagtttaatgttaaacatatgtcccaaaatagactagcctgagcatgaaaggtagtcctaaagttcatattttattacttcatttttctgtatctgttatttctagagcataagcagtttgtatgaggttgagcataacagaatgtatgtatgctgagtgtgactttgaaggacaaaaattttgtgatatattagtccctataaaggaacttcgtagctcaatactctaccacctagacttgaattttatttagcttccttcattcctaatgtgtactgtgtcattttgggactgtggaaaccttggattctgatctagaccttgtttcaccccttttgctttcgttttgcaagacttggaggggrgacgggaacatcaaggactctgaaaaatgtgtggttgaggtgttttgcctcagatgttgggaggggttaaggtgcgggagaagatacaggctgagagagactgagcagacaacttggcagcagtcctggaagtgaaaacactcctggaaatagactggtgattctctgaagtctaccccatccccagttctcccacacagcagaggttgtctgactctgaaacaccagctctgtaagtaccatagtgccttcactctaatggagctatagccctgcctttcataggctgagacttacttaggaaactgaaatctaaggtatccaggttcttgccacacagttttgagaggctgacaagtaagtgtcttgagttgactgaacatcctgtgctggacctctccgacagtggaagcttgagtcagccatgctttagcaagggggtggggcagatttggggatttgtataaatcaactttatggaaccagggattaaggtacaggttaggatttgaacttggaatgaactaataaagagtagatatgtaaaagaaaggtgaagtgaccatgacccatcacccaggctgtgcctccttcaccagtgccaaataagagggtcttttatgagtaggactgtaaactgaggtctgctgtttatataaattagatgatggaatcagtcttggttagttagatagcacagttgaaaatgtaaggtccgaagaccccaaactttcccccataagttacaactggatttagatgctgacatcatctagatatggttttgcagccttaagaagttggcacttttactcgacccaaaccttactgagtcaggttgtcagaggggtgggcagtatgacctgattggctatagggatttatattccagtttagaaaagattttaataaaatatgcttgtgccatgtggcagcaaattcacatgcacataacctgactatacagtctccagacaaggcctctggaatgaatgtaagtattccgttaatcccagtataactcacactatgaatgtacaaatgttaccgtgggagctagcactagtttaaggggtagatgacccaggaaagttgcgagccagtgtattgtgactgtgatatggactgttggtggagtacataaatagaacattacctctgaccctgtatgtgygtgtataaattgattacaacagaatcccatagtaacatggaatttaagaaaatcatttgtgttataaggggactcctaagtccagataatcaaaaacaaaacacctgggattttctgaacttcttgccttcctgggcttgtactgggactcaatataatgtcacccatatgaagttctctatggaaatctataggaagtttaaaaatacgtgtatgagctaacatctataaaaatgttaagtgaataggcaaaaattttgtaagtgatattctaattgcagtttggaatgctatcacttataaaataattctttaacaataccataggtctttacaatataacttgttatcattctttgaatgatgtgcaaagagctatggcgctggacgcggtggctcatgcctattaccccagcacttcaggaggccaaggcaggcaaattgcttgagcccargagtttgagaccaggctgggcaacgtagggagactccatctctacaaaaaatacagaaactagtcagatgtggtggtgcacacccgtggtctcagctacttgggaggttgaggtgggaggattgcttgagcccaggaggtcatggctgtagtgggccatgattgtgccactgccctccagctgggtgacagaatgagaccctgtgtcgaatgaatgaatgaaaataaagagccatggctttgtctgtgtttgcaacataatacagactaatgttagtcttacccaagatacaataaaactttattaacacacagcaatattcctgaaaatggcttgtgaattaatggtttttaaaataaaagtgagatattaggctaatgaagatataatttgctgaaaatatcttagtgacttgaacaaacttgtatgaccctgacaagatgttatattagggccccaaattctttttaaattaaaccactcaggcagtgtaattgaggagaatttctttaacttgcatcctctggtaattgtttctgttcttattttcctttggcaattgtgtagatgttgaagatggtggagtgactcctctgcacagctggcagggtgcttgcagtcaggagcatgcattaggtggcccttgagggtgagtggagcaatctgcctgagactgttcattattgtaaagttttggaaaccagtgtcttcagattcacactcacccttgcttgtatgaagtcacatgacagttcacatttgagatggcataagaagggcattaacttcccaaattccctgtgcatcagtgtgaaagagaacccaaaatgtcctgtgcaggtctttcttgctccttcaagtggaagtagttcagttccatagattagggaatttttttttttttttttttagatggagtctcactctgtcacccaggctggagtacagtggtgcagtctcagctcactgcaccctcagcctcctgagccagctgggactacaggtgtgtgccaccacacctggcttatttttgtatttttagtagagatggggttttgccatgttggccaggctggtcttgaactcctgacctcaggtgatctgcccgcctcggcctcccaaagtgctgggattacaggtgtgagccaccgcacccggccaagggggatttttttttctcctttcagtttagttgccctaagtatgattataaaactatactttttctttaccctgccccacttttttctgcttctatgttttaaaaaaaaaatagccataacaggctttgctgccatagagcacttacatatccatgtttcttctattatgaaaggaggagtgttgcttggtagcagtagcggctgtgggtgttagatggcagatgggggactgcagggttgcagctgcagtcctgcaaatattgttaaaataaacttccattggaaattgactggtcaaatagagtgttgtgatgaagcagagctgaaagtctaatgtgaaaaagaggaaaagcatgtatctgagccatgtaaacttttatgcagaccagtattgatgtgatttcttggcagggaattggtgggctgtaagtctgagaggactcaagggaatgactggagaaaagtatcactaatagagtattttgatggaagagaaaacaattcctttatttattgtaagaatgtttcatgtcacaaactaatcttgtgtgaccctgtatatgtgccttactcaattaaaggtacatttggtggagggaatggctcacacctgtaataccagcaatttaataggaggctgaggcaggaggattgcttgagtccagcagtttaagatcagcctgggcatcatagttagaccccatctctacaaaacattaaaaaaattagctcggtgtggcagcacatgcctgttatcccagctacttgggaatttgagacaagagaatcacttgagcccaggcggtcaagtctgcagtgagctgtgattgtgccactgtactccagcctgggcaacagagcaagacttttttaaaaaaaaattttaaataaaataaaggtgcatcttacctttatcttctcatttgctgcagattcttacatgtgtatgtgatgaaatttggatgtgataggtttgcatattggatgctactttggcgtgcacttgtacactataaacagttttcttgaaactgcaaaagggccaaatgaatgtggatgattctcatcaggagagttgcggaaatttgtggggatgtgttttctaatgtagttgagtctgagacgtattcataatgaaatacattatttaacataaattatagtcttattttttctttatattactcagagcataatacttgttttgaaattatgtgtgggggcaggttttaccatgttaattcacttcaagtttgtaaagagagccttataaatttactataaaaatggggacttttgagatccacttatcttggtaatagttaactaggacttcttaaattgtttaactctgtacattcagaagaatttcttgtatcatttaaactgtagtactgttatttgctgttatttaagttctgtaaagtcacagaaaacactgaatcagtgcatatagaaccattgttgtttgcaaaatatggcattaggtccctgccagcctctggtcacattttcatcagtaaatcattatataaccatgtttcacgtgtgtttctttttaaagacactttaatgtacatttttgattcattaactttgaactcatggctagtatactgctatagctcatacctgaatgaagcttatttgatacgaatattttctctataaggtacatcacgagtattttctccgtaaggcacatcacaaccttcttgcacttaggaacactagacagcactttggcactgtgcataggagatattctcaacagcaaaatcaccaacaaaaagcacaaacttacaaaaagtatggcactaagtggagtgaagaaaggacatttgcttacagaataagagctgaaaaatgaaggaaaagtgcaccttatttgacctcagctgggaacgtgcccattgggcaactcaaagtttttgtcactctgacctgtcagcaaatgccaaaaaagcyctacagatttgaggtaacaaataagttttagcaagtgggcaacttttcaaatattgaaatccacgaataatgagaattgactacaagtagttttgccaaaaattgtaaattatggaataacctgtgtagtcacttaaatgcttgcagaatctggagaattaatgaraacttttgatgtggtataacatattaaaatgactttactgtaacatctttgatttaaataatgaaattaaccacatttgtataatgtcttataaaatttttatagtacttcaggtacataattaatttgctctgtagttgaaaaactatgattctgacagattaagtaagtgacttaccactgttgacctgcctaatatgttgtggaaatgaaactggagcccaagtgtttttattttttatttatttattttttctttcagacatgatctcactctgtcactgaggctagagtgcagtggcatgctcatagctcactgcagcctcgacctcctgggctcaaacaattttcccacatcagcctcctgagtagctgtgactacaggtgtgcaccaccacacctggtgaatttttaaaattttgcatagagacatagtcttgctgtgatgcccaggctggtcttgaactcctggccccaagcaatcctcccatgggcctcccaaagtactaggattacaggcgtgagccactgcacctcgccccaagttgctttcatttttaattcactcttaatttttcacctttttctagatagctagttcagaattattctagatatatacatcttagtaagtatggtgatttaaaattactttggacaactttaagtttactttttttaaaaaaggaattttcaagattgttaggtacctgcctgttttcaggggctttgatgacttattccaagaaaatggaattgtctgttgtgactggagtcatcactggattaagctgacaataaactactgttattcttcaagaaacatccatcttctgcacagaccaaagtagtgatttaatttgagtgcacagctcrgttgtactttgtcttgggatgtgaaaagccagaaagaatgtcactcccatagtgatatcactcccacagaacaataaggataaagacagataatctacacaatttcaatttttttaacctactagacagctgagattgataacatctaggtagtctaaaattcaaggaaaaaaaataggcttttccatgtggagaagagaaataagcactggctcatgtggtcactactttttcatcctacaaagagattcactagttaataagcctaggcaagggcacagtactccaatcaactttatagaaatgtattgttatggtccaaattgtgtccctacccccaagttcatgtgttaaagtcccaaaccccagcacctcagaatgtgactgaatttggacacggtgaagttaaaatgaggccttttggattggctgtcatacaatctgactggtgtccttataagaataggaaatttggacatacttagcggtatttgcacagaggaaacactgtgtggatacaaaaggtgactagaccgcaagcctaggagagaggcctcagaagaaacctaccctgccaacaccttgatcttgcattcttgcacttccagcctgcctaactgtgagaagataagtttctgtttaagtcatccagactgtggtattttgttatggcagccctagtaaactaatattttagcactcttaaagaattaagtacgtagagccaaacatgtaagataacccaaaggaaaaatgggagtagaagagaatggagataatgtaggaaggagaagtaaactttaaaaatattataattaatagaagagaagatactatatgtagaaggaataaagttttctaataaagtgatattcagaggacaaaaggacattaaaaggagagtggacattttaagatgtcttacatttttgaagataaagttaggagaatttcccaatgaagtagaaatagtagatatggagaataggagagaaaaattatacagtagaagataatcaatccaggaggtccaacatccaactaatacacagaaacttagagaacagaggaaaaggaagtgaaattatcaagcaagtaatactgagattgtcctagagctagacgtgagtgaatattgagatagaaagccttattaaatgtgcaataaagaagaaaggaattttcaccaagacatgtcatttagaaattcttatgcaccagagataaggagaacttgaaaactttcaggggaaacaacaggccacgttaatggttgggaaatctggatggtatcggatttctccgttttaacaaagaaaggagaaaacagagcaatgccttaaaaattctgaggaaaagtaattttcatcttagaattctataccaaaattatcaatcatatgcatgagtagaataaagatatttttatacatacagtgtcttaaagatatgttttgtctgctgtttctcagaaagctactggagttgtgtaccatgaaattcagggaattaataaatgaagaaggaaaatgtggaatccaggaaatgggatccagcagagagatgtgaagggaattcccacaatgactgtgaagtttaggctaatagttggctcagtgcctagagagtttatagtccagattaaaacagtcagaagactccaggacagtgtctaaggaaaacaaacaagcatgaagctaatatattatctgaggcgatacactggcgggaaggaagttttatagtccttttggaatgcctagggctgaattagtgaatgtacaccaaaaagttattcaaaaaacaaagacagtttataactttatagttaacaaaaatttgtgtgagaaagaagagatacttatatacatgaagtagctcaggtataaacaacttttatgataataataacacagtcatccctcagtgtctgtgggggataggttccagattccccacggataccaaaatccatggatgctcaactcatgtatggcaaagtattttttttttcttttctaagtgctgaggtttgagagaatttctccaagaagctcataaatacagcagtgcccaatcaggtggtctacagcttcagtaacacacctgtgtatacccaggtaactactggtcagctacaaatggaagttcagtaaaagcaattccacaaaggaccaaatttctatctaggcctcagatctggctatctggctagatcctggttaaaactggatatgtggaaaattacagtcaaactatgaaacagccccacccttatctcccttcactgactctcttttcggactcagctcgcctgcacccaggtgaaataaacatccttgttgctaaaggaacaaaaacaaacaaccaaaaaaaaactggatatgtggcctagccctccagcaaactcctaaaatattgcaaacctcagcgcctattaagaagtaacgactgttagcaagaattgggagacaagaagtgacattcggccaggcgtggtggctcacgcctgtaatcccagcactttgggaggccgaggtgggcagatcatttgagatcaggagtttgagaccagcctggccaacatggtgaaagcccatctctactaaaaatacaaaaattagctgggcgtggtggcacacgcctgtagtcccagctacttgggaggctgaggcaggagaattgcttgaacctgggaggtggagattgcggtgagccgagatcgcaccattacactccagcctgggtgacagagcaagactcttgtctcaagaaaaaaaaaaaaaaaaaaaaaaagacaaacaaaacacaaaaagcaaaagtgacattcatcttaacttccaaatagcctgggttagttttatgcctcttttaatgatgaagaaactgagggtcagagagccttaagtttataggtagaaaatgtcagagccagccccaaactcaggtctctggcttcccttccctagtcatgtctaccacccttcaaaaattgagcttatgctctcagcatccctgtggtggatagtgggctgtaggaccaaggaaggctagaagaagatgttggtctacacacttgagtggagatggtgaagaggggacctaggcccagcagtcaggtacttgcttttgtaaccacccaatgagttcaccttgcccactgcttagacagagcagatttctcaagacaagggaattacaatagagaaagagtaattcatgcagagccggctgtgcaggagactggagtttattactacccaaatcagtctcctaaaatggcatagtatttgcatataacccacacacgtcctcctgtctactttaaaccatctctagattacttataatacctaatgtgatgtaaatgctgtgtaaatagttgttatagtatattgtttaaggaataatgacaagaaaaaaagcctgtacatgctcagtacaaatgcagccatctgcagaactcatggatatgaagggctgtctacctaatgattttcccaacatgtgaggaggatagtgtgtgtatgactgccttaaaggagggatggaggacaagaatcagaaatgtggagggggagggcagaggattacactttgttatataacaaacctaagtgtttggcttttaaacttctataattatattcttttggaaaaatattaatactagtaaaggaagtagggctacactttagatagagtacattcagaagggagggcagttaaaatggaaggagagggaaggaggagtataggttgggtttgaagtactttagggagagagagaagaaaggaaaaatcaggacactgttgagacactccacgggtaccccagtggaggttatgtatatacatattaataaatattaatatgccccaaccattgtatttgtttgcagttacttgctccccagtcagcttgtgttcttttcagtgttgacacttgaagttagattagtagcagtcagggttctccacctatatgctgtgtttttcttgttaggtgcctgccatttcttgaaagccctttatgtttctaaggacttgtttttctttttcatgagaatgttcttgtcagagaccaagcgaagagacagccaagggggaagagagtaaagtgaaccattacatcttactgtatgtgtatgtcctttagcttcatgttacttagcttactgtatgtcctttagcttcatgttgtcaatgtaggaaatactactatatgctgttcatgttgttagcacacagtaaactgatctcttcttactctttgagcctacaaccataaaattcccttctatttcttattgtcttcaagcatttttaaaaaatatacatgattccctttgtgggtgcaactattatgttattgcaagaaagacatttcctagccctacttacagaaaatctgtgcatatcacaggtttccaggctattggcttacttggttttctttgttaaccttgatgtaacattccagtggcacctgattttgtctagaaatcattcccaagtgggtaaacatcatatatgtaacctcacccttgtaagcctgctttctttccctgtatgtcatggaaaaatttctgtgttaattggaggtggtttctggcctaattatgtttgaaaaaaaattgtcgaatggagatacatcttaagaaagagatgttgaaataattgcttgagtaaacatagatcaccatgaccttgtaatagtttcccttgaaattatttagtgaaagcaaatttaggcaattactgaaaaccagtgatcaaggaaggaaataaacagctttttttgtttgttttctatttcataggactatacagagcaccccacttaaatgactaatactaaaatttaaatttcaattattttttaaatctctggtatatatatatatatatacacacacacacatatatatataaggtgtttttgcttatgaagtaagacttttgtcagaattcatgtacttgtaaaattctaagttcaggatcataagaagtgagactttttgtgattatttggagcattttgtcagattatgctttcaatttccccattttagagtcattatctaattctactttataggtatttagtaactttgttctttcaagagtattatgaagtcattatatgtattctatcatatggaaagagaatattagtgaacaatgacttctactttgagactttgaacaccaagagaggcaggcctcagatgatcaaggtaatgttaattggctaaaaaaattgaggaatattttttgtgagaatatcaaggggaaaaagaggagacagggacatttatttatgattcatatcaaactggaaggtagttttcaattgtgactatacactaaagattgtcacttgattcacatgtattcaggrctyataaaactaagtcaycatacttagaaatggtttcatgctatcacggtgtctgtcagaattagcaggcaatatctcattataggaaattttaagtatattagtgattttttwaaaaatgtaaaattttgagattttaggatttggagaataactacctgagcccatcctctttgttgtgaattagcaatgggacagaagtatttgtaatatagtgagagaaactaggaaacaagctcactagggtgatattgaggccatgtaatacagaataatctatttcgggagttccttgcaaaggtataatagtaccagatctttaggaatgttttagtttttaaattttacttttcctagatacaatatctagttgaaattttttttatgtggcagttctaggagtactgtggatgcgtgggaaaagaggaatgtgaaaagcttagctcaacttaccttccacttttatttcttttaaatgtcacaaaatagagtttacaaaaatgttagctatctggggtcattttgaatagctgattatctagtagttttaaaattaaaagaaaatgttttattataaaagaaagaatatgcttagtaaaatttaaatctgtattatttaatgttacattatgaaatacattaaggtaattattttaatataaaagcatgtttgttttagaaaatacagaaataaactttttttgtagccccactacccagtgttaattattacactattacgatttgaaattggatttccaggctatttccctatgaagacatatgcttttattttctaaaagatcgtattttatctacctttttgtagtcttttgcctactttatatcatatttaaaagagcagcccattttattaaatattgttctgtggtataattttaatggctgcttactgttatattacataagtgaaccataatgtcatgtttaatttaaatgaacaaattctattttattaactaggtttattataaaagaaatatgtatattcatgttaaatccataatatattaaccaaacttctcttttgttacttacttctttttaaagggaaactgttctttttattttcttatttattataaactcatatttgtataatacacatagcttttgccttactaaatatataatattatataataatatataatataatatatattataaaaattaataatattgtattatataatatatattatatataataatataagttatattattatataatattattatttgtgagaatatcaaggggaaaaagaggagacagggacatttatttatgattcatctcaaactggaaggtagttttcaattgtgactatacactaaagattgtcacttgattcacatgtattcaggactcataaaactaagtcaccatacttagaaatggtttcatgctattacggtgtctgtcagaattagcaggcaatatctcattataggaaattttaagtatattagtgattttttaaaaaatgtaaaattttgaaattttataatatataatatattataaaatatatattatatattatattacatattatatattatgtaatataatatataatatattatatgtatatttattacatataatataatatataatattatattaaatatatatattwaatatatatatttatatattatatttataattattatatataataattattatatatataataattattatatataataatataagttatataatataatataatattatataatataccatatatagcatatatgtgcaatatatattatatattgcatatatattatatatattatatattataatatgttatatataatataataataatattattattattattattttgagacagagtctcactctcttgcccaggctggagtgcactggtgcaatcttggctcactgtgagctccgcttcctgagttcaagcgattctactgccttatcctcctgagtttctgggattataggcatccaccaccacacccagctaatttttgtattttttgtagagacagggtttcaccatgttggccaggctggtctcaaactcctgaccgcaggtgatccacctgcctcggtctctcaaagtggtgagattacaggcatgagccactctgcctggcctacttttatatttcagggtttatattatgaatttatattgttttaattatagctacatgtaaagctaccggaatatgtagaacatagcataagagtaactttggatttgactctggtatagttgttttagaacttactttcttgaaagacttcttgccaagggcttgctttttaatgattttgcctgtctcttttataacttaataacacatttgcagctacctttctctaaaattaattgatgcttatcccaattgttttattttttacctaatttctacacaattagtttcttttgattttgcactgttattcaatgcaatacctgaaagaaataagttttttttttttttttttttttgtcaaggctcacacaccagaagaactaatgataaatattctttgtaatcttctagaaattttagatgcatatataaatacatatatatataaataaatactgtttttttgcttttttggtagagacagtcttgctgtgttgcctaggttggtctttaactcctgggcccaagcaatcctcctgcctcagcctcccaaagtgctgagattatagtcataagccatggaacccagcccataacttctttaaacaaaaaatattatacaagcatgttcacactcacacacgctattaggcaacatgaattttcattttaagatatgttgtaagaatgatgaatgaggttagaagcacagtatcttcagctatgctgcttggaattgaaccccaattcccacgtttactatgtgtgacatcttgggaaagttatttcacatcttaatgtgtctcagtttcctcatgcttagcgtggtgaacaatacaaatgtctatctcatagagttgatgtgagctttcagtaaacttgtgtatgaaaagtacttagttattggcaaaatagagtcattgtatttagccgttacctttttatgtaagagaatataaatttattctaatatttttagactatcccatcttaatattactataatttattgatcccccattacaagccatcgtgttatttccctattttatattattgaaacaatgctgcaaagaccgtctttattattaggattttgtacttgtgaagtaaatatataggatgaagtcctagaagtataattcctgtgtcaaagactacattgcttttttttgtttttttttttkttgttgttttttttgagacggagtttctctcttgttgcccaggctggagtgcaatggcgcgatcttggctcaccccaacctctgcctcccaggttcaagtgattctgctgcctcagcctcccgaataggtgggattacagacatgcgccaccacgcccagctaattttgtatttttagtagagatggggtttctccatgttggtcaggctggtctcaaacttccaacctcaggtgatccacccgtctcggcctcccaaagtgctgggattacaggcgtgatccatcgtgcccggcccaaagactacatatttgaagtttccatgggtgttgctaaattgtccttcaggtttgtgagattgcttttctcctcctactctctccaatactaagtatcacttaatttttaagttttaataatatgataggtgatgaatgctaatttttgttttaagatatattgtaagtggagttgaatatttatttatatttttgagacatttgtatttttttctcatgaactacatgtccatgtaattggttcatttttctattggtttatcaatgtttttcatattgcttttgaaagaacactttgttgtaaaataaccattagctagttcatttgtgccatgaataattttctctgtttattattgacttctcttcctttatagtcatatagattgttccaatttttatgttttcagattcttatatttgttattttgttattgcttctgagtattatgtcattcttcaaaatatctttgccaacacaggatcacatttaaaaagattcactaatctgttcctagatcctcttgtaattttatttttacctttaaatcttagatctactaaaaatgtaggggaggaaaaaaaagtcatcttctgccctcttaagttcagagtctagaacccaggaatcaaactaaagacattaccaggaagaaaaacattcacttaatacatctgcatgggagttcatgacgaaatgtgactcagggaggtggttagaatttggggcttatataccaacttaacaaaaggtgataaagtatggagaggtaggctgggcatggtggctcatgcctgtaaagtaatcccagcactttgggaggctgaggcaggcggatcacaatgtcaggggatcaagaccatcctggctaacacggtgaaaccccgtctctactaaaaatacaaaaaaaattakcctggtgtggtggcgggtgcctgtagtcccagctactcaggaggctgaggcaggagagtggtgtgaacctgggagtcagaggttgcagtgagccgagatcgcgccactgcactccagcctgggcgacagagcgagactccatctcaaaaaaaaatgtatggagaggtagctagacaaaggaaaggggtttggggcttctgtggggcagagcaatgggtaacttgtgggaaagtaactagaaaatgtatagtaattaagagttgtttactaagatttgttttgcagattaggggtcgtctttctgatatggaagaggagaacaccttcacaaatggaaaaatatgtcatctttacgaaaggaaatttatgtcctggttttgtgtttatttttcatacagatcgggtctcactctgttgcccagtctagtctcaaactcctgggctgatgtgatcctcccaccttggcctccgaaagtgctgggattagaggtgtgagccaccgcactcagcctatgtcctagttttagacagaatgttgcaggtcacagaacaattgcctttagttaaacacagttcttagtctaaagtggcatattttgcaatggcctactctgattcccttcacagactcacatggtgaaagtaattatgtgaggatctagctttatttttcttcataaggttagcataatttcctaataccatttattgtataatccaccttctcttcattattttgacatattttrtatctcataaaccaaagttttatatatttgaatttggatctttctggactctctgtttcatcaatctgtctactcctacactagtaataacaattattgtatgtttacaaaactttaaattttctcttatatctagctgctctcccccaatactatttttattaaaaaatttttagtttgttagtgtgtactttttccaggcaaacttaaacttttttgtcatatttcaaaataaaaatagtatttgttcattattttgtgagaatccattggagtttctgagttcagtaggacttaataccttaaatagaacttaattcctgaggtaatcagaaatgagatattttctttcattttattttctctcattattgkatatatatgaaaatggctttaggttatgtttactagttttataacctgacttcttagttacactgctaatcttttccagtttattttttagttatattctttacaaattatagttttatctctttctttccaacgtttatgccttcattccaatgtttataccttttattttttttcttgtctgatttcacagaatgattcctttcaaataatgccattttacttttaaccttttagaatgactttattcaaaataagccacttgtgtaaatatagagttggcttttgatttttaatttagtctgaaattttctttccctcaaatatctgacttcagtaagcaatgattgttatgagataaatgtttgctcttaattatatcaacttctttttatttttttgtttctartaatcactttgttttctggttttcgctttgtggtctgtgtctttgttactttcacttaagtagtgatcttcaaacagttaatttatataatctgtgatttttaaaaatcagtagacttttaccgacatgttagtgaatatgaggatcttagtttacttccatttttttaatcccttgacttccccctcatctttttgacttttgttattttactgagttaaaagataatttttaagagaaaggaaaaatgtatctcttatacagatttaagagtgaatgcacattaaaggatttctttccatagtataatatgagggaactgtagaggaggaaaaaataatttttcctatatcctctgcattgttagctgcccccccaataacaaagacagattaacaagaaaaaacaaacaaacagaagtttattaatatgtacacctcttgtatataagggaggtatgtaagaaataatggtaaatctcaaagagatagctaggattcagatttaaataacatcttcagctaaaaacgaagaaaggttgtgtgtgaggccagttgtggggaggtgaccaggaaaagcatggtgaagagtaaggtttgttatgcagatttgagtcagtgccttctccattgataggagtctcttatgatttagtaattcttcatttcctgccacagagggagatactcttacaaatggagcttttcttcatagatctaagtttcccttacaaaacagtatcttctactctgttttttttytttttaattatacttttaagttttagggtacatgtgcacaacgtgcaggttagttacatatgtatacatgtgccatgctggtgtgctgtacccattaactcatcatttagcattaggtrtatctcctaaagctatccctcccccctccccccaccccacatcagtccccagagtgtgatgttccccttcctgtgtccatgtgttctcactgttcaattcccacctatgagtgagaatatgcggtgtttggttttttgttcttgtgatagtttactgacaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaatagtgccgcaataaacatacgtgtgcatgtgtctttatagcagcattatttatagtcctttgggtatatacccagtaatgggatggctgggtcaaatggtatttctagttctagatccctgaggaatcgccacactgacttccacaagggttgaactagtttacagtcccaacaacagtgtaaaagtgttctatttctccacatcctctccagcaactgttgtttcctgactttttaatgattgccattctaactggtgtgagatgctatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggtttgcgaaaattttctcccattttgtaggttgcctgttcactctgatggtagtttcttttgctgtgcagaagctctttagtttaatgagatcccatttgtcaattttggcttttgttgccattgcttttggtgttttggacatgaagtccttgcccatgcctatgtcctgaatggtaatgcctaggttttcttctagcgtatttatggttttaggtctaacgtttaagtctttaatccgtcttgaattaatttttgtataaggtgtaaggaagggatccagtttcagctttctacatatggctagccagttttcctagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagcctggtagaagttgactctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatccaaaaatcctcaataaaatactggcaaactgaatccagcagcacatcaaaaggcttatccaccatgatcaagtgggcttcatccctgggatgcaaggctggttcaatatatgcaaatcaataaatgtaatccggcatataaacagaaccaaagacaaaaaccgcatgattatctcaatagatgcagaaaaggcctttgacaaaattcaacaacgcttcatgctaaaaactcaataaattaggtattgatgggacgtatctcaaaataataagagctatctatgacaaacccacagccaatatcatactgaatgggcaaaaactggaagcatttcctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatagctagaaaacccccattgtcttagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcagtgaaataaaagaggatacaaagaaatggaagaacattccatgctcatgggtaggaagaatcaatatcatgaaaatggccatactgcccaaggtaatttatagattcaatgccatctccatcaaactaccaatgactttcttcacagaattggaaaaaactactttaaagttcatatggaaccaaaaaagagcccgcatcgccaagtcaatcctaagccaaaagaacaaagctggaggcatcacgctacctgacttcaaactatacttctactctgtttttagagcttctcatgtgtccgctgtttctcaaaataatcaatatgcaaaagaggcatgttttagggtggcattctggtctcctacagtcatatttttgggtggcatattctggtttcctacagaacgaagtagatgttataacaggttcagagaaagtcaaaacagcagagatttatatgagataaagaaatgtccagatgacttgcacatggaacaaaactatttttccatatggggtaagatgtcaattaaaacattatcaggcaggtcaatttacatatctgcttgttaactattgtttacaaagagttgagaaaaagctcaaagacaaagaataagactagaatcaattaattcagaagggtatgtagcttcatctattcctaacaaagcttaaaatcaagacctgaatggatcaaactttctgcataatttaaccacatcccagaaaaaaaagcttaaggatatttgtagaaacacaaaaatagccagcagtaacagggtaaaattcacaatatttcacattcattcagaaatttccaggcatgcaaagaggcagggactttaaaaagagcataacaaggagaaaaatcaatcaaaattgaccctgaaatgacataaatggaagaattagtatacaagaatattaaaatagttattttaactgtgttccatatgttttgaggtgctagagaaaaacgtattaggaagagatatggaaactatgaaaaaggtccaaatcaaacttctagagataagcactataatgaaaaatgagatgaaaaatgtactggatggaattaactgtgcattagacagtgaacaaatgaaggtaagtgaaatttaagatacagctatagaaactttccaaaattaaacagagagaataaaaatgactggggaggaactccctgaaaggtgcattagtaaaccatgaggtaacttaagtggccaaatatgtagtgacatcagcgggaatggtgggataaggcactctggaaatgctcctcttcataaaagcaatactggcaaaatggtcagtcaccttttttcagaattttggaaattaaccaaagtcttgctacaattatgaagcatttaaggaaaatgaccataagctctgtaagaacagcaaatttagtgggattttaatttgctctattacctttaccttctcccctgcccccaacaaacttcccagtgccatgatagccttgaaaccaacagcctgaaatcacggtgaaaaccaccaccttggcagccacttcagggggcttatagtattggattgccttaraaatcccattttcattgaattgtcattgtttgacctgtgtggtgattgtctggataaccccactcacaaagattatttttatttgacctgactcagtgctaacacgttgtttttttggggcgaggtgtgaaagaggggtgtttgtcataaatacttgctttacgtttctgctgtcttactagtagatagcagttaaaacgaaaaatagggctaaccaaaaaacttaataggagaagctggggaattagatgttcatatgaggtttgaaggaagttctgacacattcttgggaattcagaagacttacatgcatgtgtagagctgtgagcatgctcggaaaatacctaagaaggccctcaccttaggctgaccttgaggctctgtgtaagccagaagtggaggctaaggcagagttgtctgctgcctggtgcacatttaaagtgtagagggtagagacctggtgtgatgggtgattcctgtaatcccagcactttgggaggccaagtcaggagaactgctagaggcttggagtgggagaccagcctgggcaacatagcgagacactgtctctacaaaaaaatttaaaatgagcatggcatgggggcgtgtgcctgtaattccagctacctgggaggctgaggtgggaggatggcttgagccctggattttgaggctacagtgagctatgatcatgccactgcaccccagcctgggtgatcctgtctcttaaaaaagaaaaaaagtgtagggtggaagggatttctttttttttttttttttttttttgagacggagtcttgctctgttgcccaggcgaactcggctcactgcaagctccacctcctgggttcacgccattctcctgcctcagcctcccaagtagctgggactacaggcgcccaccaccacgcccggctaattttttgtatttttagaagagacggggtttcaccgtgttagccaggatggtctcaatctcctgacctcatgatccgcccacctcggcctcccaaagtgctgggattacaggcgtgagccactgcgcccagccgggatttcttttctcacccattgcaaggttcatggctgtggtcccataacaaaagacatattaacaagagaaaagcatatatattttgtatatattttatgtgatataggagccttcaggaatgaagacccagagaaacaggtaaatctgtgtatttttatggacagtcatgcagaactatgattggaggacaaaagggtatgatctaatgataataaactaggggaacttggcaatgtctgttttttcagattcttcttcttgtccctgtgtgacattccttgcccccggtatagggcaagacacctgtcacattacattcttcaagggagaagggagggagaaggttacacagtaacctaggtcttatggcctgtttcagggaggaatgtgaggaggggaaggttcaagtggcctcttgcttctgctgtttcctcaacttccaaggtgccatattttggggtagcatgtcttgaactttgtcaaaagtgtaccttaacacttcagagctctgctgcaaagactaggaaacatagtggttccaggtggttccaggtcgttccagcttagctaactgctaagctaatcaagcagagatttcggaggctccgtaccacagggaatatagactttagtgtagaagtctctaaacaaacaatctcaaccacctccacaataaaacagcagcaagaaatatatttgtaattgggttccaaaaagtagatgagggatgaaaaaatatttgaagaaataatgctgaaaaattgctgaattgggtgaaaacactaagttcacagatccaaggagttcaatgaacccaaccacaagaaaaatgaaaactacaccaagttgcaatcataatcacattgcttaaaatcagtgaatatgagaaattttgaaagtagccagagacaaagggaacattgcacagaaaggaataaaaataaagacgacagcagatttcttatcaggaatattgtatgctagaaaacaaggcaaagacatctttttaaagttcttaaaaaattgttcatacttagatagcatgtatatgccataggcatcagtttattaaaatagaaaagaacaatgtgttaccacttaccagtgagctaacacaaaatttaatgcccatgttgaaagaaaagtttagggaaaaattctgagttattggatgtagacagagaagtcagtctgttgctatttacataaggatgatatacctaagggcagagaacttagaaggacatgatgaaataaaaattaactttaatagtgaaatcttgaaaaaataggctaaacgtcactaagaaattatttttgccaagttttatctttacacatttttattataaaggattttgaacatagaacatatagtatgacaacttgggtacccaccatttagctttgtaaaattttaatttttttcatgcttgctttgtatttttctatttaaagaaatataatattacagacttagatttccacagtgttcactccctaatataaaatcgttttgtagcccttcccagaagtaatcactcttttgaatttggtgcttttagttaccaagcattttatattcttttacaacatattgtacttgttataaatggtgtcagataaatatactttgttgaatttttttattttgagatgtgtctttattgatacatgagccatagcccacttagttgtaatctatatagttagtacatgtattctattgtatgaatagtacagaatttgtaatcattttcttgttatggacattaagattgtttataattcatcaccatcgcaaaccatgctgcagtgagtatccttgtgcacgtttacataggcacatgagcaagtgtttctctgtgttgtgtgtctccatgtgaactagccaggttttaggttcgtatatgtatctttaccgttagtgtctgttgtcacattacttatcactgggccatacccaccctcacatgatttactagttcctgtttttccacattctcacccatactcggcctctccaatggatgtaaaatggaattcagtgttttaatttatattgcctattactagtaaagtaggaccctatgtcatgtgtttattaaccattagattttccttttctgtgaatgatgtgtttatatcttagccccatttttttgtttgatttttatttctcttatttatatgaatttgagagctgtctcataaaaagaggaaaacaagagatgagatcccactgtgtcgcccaggctaacccaaacttctggacttagcgattctcccatctcggcctctcagagcgctaggattataggcatgagccactgcgctcagcaaaaaagaaaaaaaaatttttggttttttttttttttttttgagtcttgctctgtcacccaggctgagtacagtggcacgatctcggctcactgcaacctccgcctgctgggttcaagcgattctcctgcctcagcttcctgagtagctgggattacagatgctcaccacaatgcctggctaatttttgtattttyagtagtgacggggtttcgccatattggccaggctggtctccaactcctgacctcaagtgatccacctgccttggcctcccaaagtgctgagattacaggcatgagccactgcacccagcccaaaaatacattgtgaatagcattttattagtatattctctcagtttataacttgtattttcacttggtatatgtttccttataatacaggagttttaaattttaatactatcataatggttaatgtttgatttctttttgttttaaaaatcttcctaagaccataaacattttcttgtgtaatttcatctaaaggttttaagagtttgcttttcagtttgtcttcaatacactaatccacttggaatttattttctgtatgacgtgaggtagggatataatttaatgtgttttttttctttttttaaatttattttattttatgtaagtaaccaattcctctcccccaaattttttccaaaataatattaaaatttaaaatagttctaaatttgtaggaaacctgcaaagatagtacagagaattcctatatactccacacccagtttcctcaattgttaacatcttatgttagaatagttttaaaatagactgtagtacatattgctctacacattgtagaagtggtttttatttttacaacaaaacattagggaattttagtttaggatttttatgtcttaacacatattttataggtagtttaaatcaaaacagggtgattgtgtcataaactttgacacaaatataagtaagcattttacctaaaaaagatttggggtgactgtgttataaattttgacacaaatataaataagtgttttacctgaaaaagatttggagaagaatcttaacttggcaaatgatgttttagtctgttgcctttttattgccaaaatatcttgaatttccttgcaacatttacagctatagagtttgttgattactaactaaggggactttgtagtcagttctaaattctagaatggggaaacagggaataaaggtttttcttaaaacctactcctagttttgctgcactaggccaagcactcttttgtttacttttattcttttctactgcacttcactgataaaatatgtatactaaaatttggagactcaaaagggggcatgtagcactcatatttgaaatttagtccaagatcagtgaaaatcacatcaaggaagatagtgaacataacttataaagtagttgctagtttagacaagaagtcagtgaaattcatgaaaatgctattttggttcagaaaagagagtttaggtcgggagcaagtggctcacacctgtaatcctagcactttgggaggctgaggagggaggatctctccagccctggagtttgagaccagcctgagcaacatagtgagacactgtctcaaaaaataagacaagtaaataaaagatggattttctaaaaaaaagaaagagagagagaaagccaaaagcataaggctgacccattttactgagtgttcaaattatggtaatttcattctgagaagccacctaacacacttagtgtagttgcgctacgattgtgaatctgccttctgtaatagtttctcactctttaagacacagaaataaacataatttagatatgggtgtatagcactcagatgtttacttttatctcatgagaattgctaacccgttttagatttctctttctctaatcaaatagtctcaatgttttatataaagataaatacttcagttttaagaattgtagcttactagaagtattagtctctataattttaaactacaaataaagtaaattttcttcattcacagtactatggaatctctaatatgggtcagtgtttttgctgggtcatgggcgtaatgcttgaagaactccctctgatggggaaaaagtgaaacatgatgaaatattgatagtaaaaggatagatgtctacatttaaccttgaaggataagtagttttttggatggataagaagaatcatgggccgggtgccgctggctcacgcctttaatcccagcactttgggaggtcgaggcgagtagatcacgaggtcaggagttcaagaccagcctagccaagatggtgaaaccttgtctctactaaaactacaaaaattagctgggtgcggtggcaggcgtctgtaatcccagctactcaggaggcagaagcaggaaaatctcttgatcctgggcggcagaggttgcagtgagccgagatcgtgccactgcactccagcctaggtgacagagtgagactccatctcaaaaaaaagagagagagaaaaaaaaaaaaaggaatcatgaaagggaattctgttcactttaagtagcttgagatcttgagatttctggagataccagtaagagtgtgtcagagagaagatgggaaataagaattttaaaaaataaaatcttgcaagatacactatattgtttgagctttattctgtggcttataagaagctcttggagggtttaaaaattgaaaccaagaaaaagaaatgttggctctttaatcagagtagaatcctaataaacaatttggtatgattagagtggtacttgagtagtagctgagaattgggatgtaatagtcaatataatttatcaatgagaagagcattcatcacctgggagaagaggaaagaaactcaagcttttaaagaaggtggaatatattggacctcaacctctgatttaaaatatatggtggtacccttataggagactccattttttttttaaaggaccatggtgttcagtattatgtgctttctaacattgaatttggaaagtttcactgaagttcatggcactgggaaaaccaccatgcaatcagggcagtttaaagatagtagaggaaaaatcacacccgtgattgcaaatgcttgtgttaactgaatattgttttggaagttggaagttcgagaagcctattgaacaatattttttttctctgactaattctgaactacttgagaggtaagacaaaagttagagctgtagagatcaaagtatccagttaaatactaggtaggaggttgttacacaggcccagtttcttgtacctaagggaccagccagacaagtaaatcacttttgcctggggtgatgtgagtaagtgggaggacctggaggcatacactaatggatatctcttcccttgaaaaataaagctgggaaaaggtgattgcttgtcttttagtcagtatttactgctgagactggaaaacattaatgcagtgataatttgctactctcaaatagcaggtttattgtaggtacagttttggaatttcaaagctgaacgtgatcttggagatcatttacttaactcccctcgtttttacagatgaggaagatgtgggcctaaaaaggtcaacttacttaagataacacaagtggaagagcagatcttctgagtcaccatgccaacgtctatttataagtaggaatgctaatgcattgctttttcaatagaaaattaagtgaaatttctcatttctattttcttatatagaaaaccaaaatatgagaatcttaaacacaataaagcaaattagtactccagctactttacaatgactactaccacttttacacatttcttttcaaatgctttttaatgcatacaatttatatgtgaggtgtaactgcagcatccaaattggaatacaagagggctccatctctttcatgtgaaaggactcattttgctgcttgtcttttttatagagaaccattctgaaagaatacaaggtagatatatcaagaatactctgtatctggaatttttttctaacataagctttgaatagctgtgtgaatgtgtacttctttccttgaatctaaaataagattagaccagatatggcaaatacgtttcttttgtccttcccttaaattgatctcatagttaactgctttggagattctgggaagatggctgcacttgcctcacattcttcacctggataatccaccacagggagcggagtcccatgccttgtggttcttttcatccctacttaggtaattgctcagctcccattgggttataacattctgcaactgtatattttagaagctcgtttttttttttctgaattaaactaacttataatattactgagttttacataaagttttattctttagactaatcaatatgctagaaccatctatagatgtaactcagggaactagttcttctgttgtcatatgacagattattccacacaaacacacatactaaaaaagccattgtgaactaagctcaggaaatttcaactgaagcatggtattattattattatgtttctcagcatgagcagtagttttccagaccctcagccaaatgtctgaaagaagataaagtacagtggactttcctataacatagtctgagaattaaaatcaaagtgtcccagtaactaagctgtcttaaatgggaagtgagatcttagattccctttgttattaaggatcaagtctttggtggtttttagtatttaaggtcaacactcactaatcctttttttgaggggtgaatgacagcttaactgcaaagcatagtttcagtttactgcctggcaaatacaagcttattaaaaaaaaacgcctgattttattttgcatttgaaatttatagaatacaaggtctttttgtatcatagtctcatcattgtaaacatcagttatcactaagtaaatgaacactggaagtgctattaacatatattttaagttaatatatagacaaatttgcttttatagtgtatggaaagacttatgcccattgatcattcatggttttgtaatgagcgtttttaagataacatttaccaaagctctatattttaataatccagaaaactataaagaaaataaaaaatcagccaggcacgatggctcaagcctgtaatctcagcactttggaggccaaggtaggcagatcacctgaggtctggagtttctgaccagcctggtcaacatagtgaaacaccatctctactaaaaatgcacaaattagccaggtgtggtggtgtgcacatataatcccagctacttgggaggctaaggcaggagactcgcttgaacccaggagccagaggttacagtaagctgagatcaccccactgtactccagcctcggcaacagagtgagactccatctcaaaaaaagaaaaagaaaaaaatcattcataatcttagcatccagaaattatgatgtctatatgtatttacataattgggatcatgtatgtacatactgatgtagttttataatcttttcacataccaaatatttgaatattttctgtgtcactgaataaccttatagagcatgatttttaggatacatctataagaatcagtatattccatcatatcaatgtaccacttctttaacccttcctttttgacatttagatggcttccaagtttttcctcttttaaatttttattttcttctttaagttctgttggacttgattttttttactttttaaagtaatgttgtgattaatgtcagtgtgcagaaatatttctgtatatctgtgatttcattaaactgttagaatctgttaggtcagcttatactaaagttttcaatatttttgtcccccagaaagttatgcctgttaaaattttattcacagtgtattagagtgagttggtctgtctctttgccttgttttaactcttttttttttttttttttttttttgagacagagtcttgctctgtcacccaggctggagtgcagtggcacaatctcacctcaccgcaacctctgcctacagagttcaagtgattcctctgcctcagtctcccaagtagctgggattataagcacatgacaccacgcccagctaatttttgtatttttagtagagatggggttttgctatgttggctaggctggtcttgaactcctgacctcaagtgatctgcccgtcttggcctcccaaagtgctgggattacaggcgtgagccaccatgaccagccttaaatctttgtagatgaaaaattacttatgtaatttaatttgcatttctttagttactagtaagtttgaatctctacccccttcaatttatggccctttgcagttgtgggggcagggcatgtgttgtttattctatgtaggggtgcttattttagttttggcatttggtgcgttaataatgcttttttttttttttcaaactaaagctgtgtggcaaggagagaaaagcatggttttttaattcatggacttgtatttcgttgtcacttatgtatttcctgtgtgtctttgggccaactgtctgtcatctgtgagcctgaagttgactgacctgccaaaaaagatgattatgagatttaaatgagacacctatcccagaagaatcactcgatggtagctgcacttctccttttcctcacctcctcattatcacctacctgttatttctctctttaggcatttttgaacagaattgaaggaaaacgccattcargtctgctatttgcctgtaaacagagtggatacaatctcactgaccacccaatagtcactgttaaaatcttttcaattcttatgatgacagctgatggatatacttttacattatatttagtgagaaaggagtggaaagagagccagcactggaacaggcacagccatcagaggagcagctttttcttgtctgtatcttatactacacgctttttttttttttttgattaaagactagttctctgtgttgcatttttatgccaactttagctgctgccagaatcttggatgccctaaataccagtgcttacagtggaagccagcagggtgkaccagacagtgaaaaagattcctttgctcatgttgtcagcttatctgaaatcttgaacagctgtttgaatgaatgaatgaagtacatattaaagggagttacagaacttccaaaagaactgcttttatcaggcagactccctgtaagcacctgttgagtagatcctctgtcaggcacaatgccaaattttggagatacagtggaagtaagacactagtcctgtgctgaagatggcagatttaaacaagaaaatagcattaacaaatgaaatgcggcatataagtacgaaaggactacaggtgttctagacaagaggatagtcatctaatattggaggatattgtcataggaaagttccaagatattcaagaaattgagacctataatttggaagaggttttggtttcttccaaagtgagagagtgaggcttaattctctcctgtattaaactgtgttgctataattgctttgtctatgtcagggtgacttgtaagaagcaaatggacatttgagtgcaactacacttttgtttaagacatatggcatatgtatttaccttcccgatatcaatatggcaggtggagatgacatgccatgccaacaggttttggtagacttgagttcttatacatgggatgatgttttgttttattttgttttgtttttttggctcgggagaggacaggcaccaacagatagactttctcaggatagaccaccatgactagaatgcaaaactgtaaaagtgactgctatattttaatcagcaaatctgccacagttgtgggacattaaagccctaattgaccctacatcacctaaagataggtgctgcactcaaggctgcaaagggagccaaccacttttatatatttacatatttaaatccattctccagcaacaattgaaatacttgtaagcattttaattcttcctgccggctctgtatttcaacctgaggacccaaataatacaatttcatccacaacagtaaagctaattacccttgactgtagcatttctaatacaattttattttagcatttcaaaatacatttgaaaagtaaattatgagttcttccaaactagattctctacttagtcacattaaaatgatcaaaaaatggaaacattataaaattttttgccaggaaaaacctacccatcaaaaggagagaagtctttttttatattgtctaccatatgatacaaaaattaattttggtaatattaacaaatgttccttttttggtaatacttsattcctgacataaacattacatctatgttattaagtcatgtcttctagaatacagcctgaactatgcataagacttctttgttttgaagttataaattttattattatccttttgtgagtttttgcctctcacaggtcacttttcttttgttcagaagtggttctgatttaaggcaccaaccttaaatgtttcactgacaattattaaagacacattgcttctaaaacattgtactgtgaacattaagtgatagaaagataagactctgcctcactccaaagcggctgatttatttgaataaaaactgtagtcacagataaatacaatatatagcataatgtaataaatctataggagagaccaacaaatatgaaagaaagcttagcaaacatataacaaaatagtaacaatttttggatgataggatgagtgaaaggaagagtagtgctaagtgaaggctggccatgtatgctggagccagatcttagaagactttggatgtctttctgcatgtttgaactatattctccaggtaatatggagaaacttaggaggactttttatgcccttctccatctccattagaaagtaatacttgctcattatacagaattyggaaagtacaaaaaagtatacaaaagaaatgtaaaatcattcgtaaattcattctctctcctctgtcactctactccatcccgtcttccagtgctgtttcctgacccacagtgatgtgattagagccacgctttaggaatggcacctagatgtggtgtatcataagttgcaggataacttattaggaatcttagtgtgcagagggaataggaaggagtgagtagaacaagaatccttttaaagatagaaacaggctgggcatggtggctcacacctgtaatcccagcactttgggaggccaaggcacgtggatcatttgaggtcaggagtttgagaccagcctggctaacatggtgaaattctgtctctactaaaaatacaaaaattagccgggcatggtggcatgcgcctgtaatcccagctacttgggaggctgaggcaggagaatcgcttgaacctgggaggcagaggttccaatgagctgagatcacaccactgcactccagcctgggcgacagagggagactgcgtctcaaaaaaaaaaaaaaaaaaaaaaaaaaggaacaaaaggcgatttttactgatttcatgtgggtgtgtaggaggagaagaggaagtttggttgtgtgattgactgccctttcaagcccctgtggccaaaaggatcctgttgtcctcaaacatgagaaaccttacagaagacagaatgggagacactataattttgctttggggtactttaaatctgaggtgctatcaagtcacctaactggtccagaagtatgaactgtcyatacagaatcaggaacccaggtaggaggtacagatgattgctgcatttgattttttgcttacagagcattcacctatttattttaataaagaaattaccagtttttctagtgtgttcttttatgtggatggtttctgaggctgtggtgacaactgatttaagaagcctatttacaaaaccatcagttctattaaaagatacatgaggtcaaagttagtgtgattcaaggtcagtgatccccagatttgaccattaatcctatactaacggaagtgatggcagcttttacttcaaaaacactaagaataatgagataacactgtcctcgacatgttttaacaaagatagttgattatcttgtttcctgtaaaggatttccaccctctgagtttttccaataagtaaggggaacatgagacagataccatttgtagatttagctgtatattgacattttcagtcatgatccagaattggtcaattacatatgactgcagttcctggagaagtctaaatggaagggacaatctgtaaggaaatggagtctttcctgctttttcagggtaacatgattattttttaacatggatcacagctgcccagaatgcagtaaagattttttgtgagtctaatcttaggtttacaagctcagccttgtaccacagcatcagtgtcctcatgtatatatgcattccctaacaattagttgtttgtgcttcaatcttgttttgaaggtttttttttcccaccatgtgatgtctggcctcagcttgaagagtttaaaaattaagcatattttactcctgacctttacagaaattaaaatttttggttgtactgtgtaggtctcagtgctagaaatgcttgctaaaacagtttttttaaacctctatcagcatttgaagcagtttgagattgtagaaaattgtgcaacctttgttttattatttgactcttacagatagtgctaaacctcaagtatgaattctctttatatgagaccagaacactgtggaaatacaggattttarataggcctttacaatgcatatattttacataatttcaccctaaaaatgtaacatgtatttggcaaaggaagggcttttgttgctgtcattctccctcatgtgttcctcttgtgcctgactgactctgcagggggaactttagttctcaggaccttggtttgctcatggccttctgagattgatgctgcctttcctctttttgctcttgttgcaaggacagtgcaatcatattcttgccttccttcttctgttgcacaaatgactggcccccctcaccaggatcacttggagaaaaatctcttagtattctgagagggcctagactcccactgagtcctccaaaaggactgaagatagaggtttcctagagcktctggctcctctctttctttttagtgctggttctctctaatcttctttgtaaactcccattctctgaaagacaaatgcttttagggactctgcatggcatgtggattttactcacaaaaactgtgtcccagagctcccctacctatttttctaccatctcttcctgttcattcactgctgtatgtagccttggccatgttggcttacttcctgtcctgttattgggttcttctgtcttactcctaccttgcacatgctactcttcttctcagaatgccttccacacatactacccccaacccgccttatgtttgctcacgctaaccattgcaggctgaagtctttgctttcggggtcacttgggaaatcctttcttgctcacctctcttcccaggtaggtttagatgtctctactgtgtgctcccatagcatggcccacatccctttattacggcccttatgttggttacaatgacaggtctgagattaataaagtttttatttttttccttttttttcctgtcacccagtctggagtgcagtggtgcgatcttgtcttactgcaaccgcctcccagattcaagcgattctcctgcctcaccctcctgagtagctgggattacaggcacctgccactacgcccagctaatttttttgtatttttagtagagaaggggtttcaccatgttggccaggctggtcctgaactcctgatctcaggtgatgcgcccaccttggcctcccaaattgctgtgattacaggtgtgagccaccgtgtctagcctcataaggtattttcaatactgagcatagtgccaaccagtgagctggtgcttaataaggatttgaagtaagaatcaatggctcaaaagagagagaaagtatgaagtgtaatttctgtatctgcagtcagcattcacaggctcagtagtttgagaaacctgtatttcctgctttgactttttcactatttcttaagtgctactgttcttttagtctctaaatcaaaaccatttcacatcgagatatgatacatacatatgtgtatacgtatgtgtatatttgaaaccaaaagttttgaagtacaatatgtcctcttactacttataatgaatgctgatgtttttctattctatcctttttaattttacttttctcaatgctcttcatgacctattagattgattcacaacctccttaggtcacagtcagcactttgaaaactactgctctaaattactgtaccttttctatgaggaagagttgaactgttggtgtatcagtcagggtcaaccaaagaagcaccgccagtagaagataacattttaagagatttaccaccaggaattggtttatgcatatgttgagtctggctatgaaggtctgaaatctgtagggcaggcagtgaagatgggaggctggaagcctcaagcataagttgaagctgctgtcacaggcagaatttcttttatcgtcaggaaacttcagctctgctcttcaggcctttcaactgattcagtgaggcccacccagattatttaggataatttcccttacttaaagtcaactgattttgaactttaatcgcatctacagaataccttcaaagtgacacttggattgatgtttgattaaataactgggaattgtagcctagtcatgttgacatatggaaggatcaccatagctttgtgcagtggcagtatcacagcaaatgaggtttatcctaggcgtgattatagctaattgaagacttttcccaatatcccgctgtgaggacttacaatacagtcggcattaacattttttggcagtctttatggagactgaataaaaataaataaataaaaaataaatgtaaaaaaaaaaaagaccatcatagtactgtgaagagcctggtcatcatccttttttatgtaaggagtaggaatccattttagtttgcccaccactttatatcacattccttttttcctctgcactaatgttaaccttcttaagatcctcacccacttatttggcctcatccgtgttttggcattctcttccaccaccctgggtaaatgtatgtacggttcctgggagttttacagaggtccttgtgttgagagcccctttcactttagcccgcagttgtttctgatgacctccttgaatgaacagttaagttcctttcaaggctgtttcattctgtttccaggtaaaatttggggcttgaggtactcttcccaaggtactcaagacctcagagtttaatgtttgcttttcatgatastctttaccccactctcccttccattcagaggtccagtcacccctgggggattttcatgggagagtgtaaacttctgtactggagaagcttaaaagtctcactttccattttcacgctcaagagaagctctcaaaccctctttggtgtgcccggcatccccttatccccatttcccctctgtaatctcaccatgtgtgcacacacatacaccttgtattggtcctctccatctgttttcttatttagacaatttagactaattttcctccatgggcttttagaaacacagtgctggcagttgtagtaaaagaagcaggaaggaccaactgctgagacacatgctagaacaaaaattgatttactaacttaacttgctgcatctgtaaaagagtgtttacttcttggaatgaggagtaagttatttcatctaggagactgtccactgcccccaaatggttgccaattgggttaattagttaaatgtttctgtgatgaggacacctgtccagtggaaactggaccaaggccaccaatttatttcatgctggccaccagttgtcagttagcaaaacatacgtctccagtttaaaactctggctgaactgaaagagaacattgctaatttctcatggatagttcaattgtttacaataaattgaaaaatactgaggaaaacatgaacatcagtggaatttcccagttctctgttaaaaaactcgctaatttaggtttaattgtcttagaatttgtccaaattcaggatgagctaagtttacatttatgaaggatttttttccctgattactttaatggcataaactatttttacaggaagaacttatttttaaggcttttctaggcaatactataccttaaaatttattaaaaatcaatgaaaaataatgtatagtaaccagtaagtcataaatagaagatggaaaaaagaccaaccattgcttgaaagtattcagtctcactagaataaaaatgaaaattaaaataaaaaaatacttttcaagtattttaacaacacatatttgccaataaatggtaccaattatgattgaattctatgttgtcaaaagcaagagacttaatcttatttcattaatatttctatatgtgtgaccttaataaaactctgcttatcttgaaatattatttcactaaaaatcttcatatatatgaaaatttaacttttcatatatgtgttacatatatattttacttatatatgtgtgtgtatgcatgtgtgtgtatgtgtgtgcatgtatgtatatgtaaaactttccacaaagtcaactgtagctattttaaatttgaggagtcgtggtggctcatgcctgtaatcccagcactttcggaggccgaggtgggaggattgtttgaccccgggagtttgagaccagcctgggcaacatagcaagaccctgtctctattaaaaataataataaataatttaaaaatttagagagtttgcatcctctgtatttgaggtggttggtgctattgataatacaaaaatacatacttgattttatcatggacttttgtatatgtttgaatatgaatatgttggggatacaacaatttactccaaataatataagaagaatactatggagatatgaattgagaggacttagtaagcagcgtaagttgtgttttccagtatctttaccacatacttctgaagactattttgctcacgccttcttttgtccttagataagaactgattctgaaaactatccctctttgtattgcataagggaagaaacacatgagaggtaggtaatatggaagatatgatggatgccactataagcagccatgcctaggttaccacagccttgtgtgaggaaaagctgggaagaagatctatgaccaccttggatggaaggtggtattcagtccccttcctgaggcccctaggcttttggaactgggcttagagcagaagaacagaaaatagggccttgacttgagattaatgcttttgacacatccccaggttctttgtctgatttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctctttgtctgatttattgtcattaatgttttcacttaaaatgaggtgaaacgttcttagttatattaatctcttggccccaaatcttgtgtttttaaaccaagacaggatctttgcaatccatagtaatagtgagcaagtgattcttttagatggtagcctggttaacataggctagtttatattgcattactaaatgatcctaatatcttctaacagatgtttacttctcactgatgttacatgtccatgttaggtcaaagggaagctccttgtattcagtatagtcactaaggtacttaaacttgtccatttccatcatacgtactttccagattccagaaatataagaagaaaaaaacactgaaaggtcttgcctccgcagtaaaatggctcagtcaagaagtgacacacaccaccactgcccagaacccattggcgagaattatttacatagccccaccccaaggcaacaaagggtaaagaaagaaaataccctttctacccagaaggagaactggaaatactgcttagcggcactaacatcttcataaatagactagtttacctttctttgggctagctcacatggattacagaagtgagcttactatttatatgaacaaatataaattgacctttactttctctttttttcccrtagttttgcaagaaaaaacttacttttatgatttttacatgtattaatctttacatttccttttcctcctttttgtacattaactgctgaattcagagtttgagtcattatgtggatttttggttgttaaggagagcatccrgcctgttaatgctctcaaatggggtatccctcagaaacctctccttgcaaaagtagcttatggatattatcttttacctgggtagaggggtttcagctgccttgctgacctatatttagtggagggcagtagactaagtgttttggtttggcatttataatgcctattagatgatttagatatgagaatgaaactagcagagtggtaaaattaactaaaagcttaactatctaaaaaacataataatatcttctagatagaaatatgggtcccagattatccattcctsaaatgctctataggattgtgtatttatgtggcaatattaaaaaacgtggaacagataacttgctataaataagccacaacttagaattcatgcttttagttaacttaccatcaaatgtaggtatgaatagttgaagacttgtcatcagagacacatagtgataagaattttgattaggtttcagagtcgcgattgaccctagaatccagcagcctcagtatcataatcgatcctaccttcttgcacataaaagcctgagctcagaaaggcccagtgagttggccaagcccacagcgtgtggcagcacaagttctcattgaccgctgccttacatgtgggccccatgcagtttcccctcaatattctttcctactgcagtcctagctaggttggctttttcttttctaagctaggagtttaagtatggaaataatgatattatccttatgaaatgctttaacttgtcaaaagtgtctctgtaacttgtaggtgttgtaaatctgcggtcttatttctacttacttgtaaggaagtcatattcctgactaccttgtcaaataccaaaaagttcagttttgcagccagagaatatcctgtttgaaagactttgtgatgactcattttatgggtcaacgttggtrggccacagtacccagatatgtgggtaaacattattctagagtctatgaagtatcttttagatgagatgaacatttaaagcagtgggctaaagcagattaccttccttaacgtggattggcctcatcaaattcattgaagaccttcatagaagaagactgacttccatcagagaagaggggattctgccagcagactgtctttggacttgaactgcaacattagttctttcctgggtctctggcctgcaggcctaccctgcagattttggatttgctagtccctactgtcatatgagacaattccttaaaatcaattttaatataaatatatatagtatgtataaaaaacacatataaagatattaattctatttttctggaaaaccttgacaaacgtaggcttccttgtgttgccgtttgaactagcatgctctctacctcccattatatagagtatgtttggttttttttcacttcttttttttttttttttttgagacagtctcgctctgttgcccaggctggagtctggagtgcagtggtgcgatcttggctcactgcaagctccgcctcctgggttcatgccattctcccgcctcagcctcctgagtagctgggactacaggcacctgccatcacgcccagctaatttttttgtatttttagtagagacggggtttcaccgtgttagccaggttggtctagatctcctgacctggtgatccgcctgcctcggcctcccaaagtgctgggattacaggcgtgagcccccacgcccagcccaacttcttgttctttagtaatccattaaaacactaggcttacaattagtgaaatgtactttttgtcctaatagactttgtcttatatatagcatgtgtattgtcctctgaacttctcgtgtaaaaatatgaaaaaccgtgggaactctctttacccttttctgccttactccctagattggttggtaaagagataatttgtgtaaagtgctatattgtctataatttaaagtactttggcatatataacataatatttatgggagtaactttgttttaggaccctttagttaattttctaggtatttcaatcatgaatccacacactaggattagtaagttattatttgaaagacactgattagaagcctgcacccagatattggtactttaaatctacacaagacaatgtattaacgttaagtatgctacaaataattggtgaaatgaatgatgttgaagatacaggggttagcyttagaaatattttatgtaactagactttgggtcaggcgaggcttgcagattaacagcttttggartaataacctaactagtactccatttgatcctgttttgtggtatgtaggattctggtgagtgatccacttagaaggttaaatgtatcctactgtagaatgtagttgcaactgctttaagtaaacctttcacacaggctacttttcaaaatgacttttaaggacagaaatctgggattttagagttttatgagataggcctatgagtctgttttttgcaccttccagttaagcaatgtttttacatgagcagaatttagtttgaaatttcttttcattgtaacatactccttatgttaaaagcttgcagaggagtagactaaagccctcagctgtttacatctttggagactaccagtgtttaccctaaattgtctgatgattataaactccagtttggcttacttcattttgcagcaagcacctaacatactcccgggcacacactggacaatcaatacactagataattctacctattgtcgatcagtgaactaaccttaatttgggggaagaaaaggaaagttgagattatacattgctctaaagctattagaatcctcctttgtgaggcttgccaggttggtttttggaatgttaatatgtggctatcttctccaggcttattgttagtttcaatttagagcttattttgcagagccactgaaatcatgtgaaggtgagtcagggttctgccaaggaagcttgtgatgagtgtaacctgtttgtggaagcatgtgaatgtttggcttatctccaggagcacactttgctagccatcatctgaaactcagcatgctaggacctggaacatttttcatctttgatgtgtcaggaagattttacagaacctggaccatagcctgaactgagaccgtgtggaagcattgtgggagattccttccagtcagtatttatagaatatgctgaatttatttagacctgcattgattaaagaaaatgtgtcataaagaagtgaaggaaataagtttttttcttattgttgaaaatgtattgctgctgttttgaaaaagtgttgtggttcaaactactgaaaatgtatataagataatgattctagttgaaatcttaaaataagctaatttttactttatttgcttttcatagccttgggttgttcgttcagaaatgtccttgctaaccgtgtttgtaaacttgttacccctgaaagcctgtctctgctgtgaagcagtggatgaggtcttgttttgtttcctttgatcgagaaaccagaatatcacttattggctctgaaacaagaagtcttaaatttaaacatcttttgtttacttttctcagtgaaataaaacaggaacaatgtgaaggtagcttgaactacaaaaatacatatatcttgttggtgttgaacattaggactcagaatgctgttggcctttagagttttttgtgttgctggaataccaggaggagtcatgctctgattattatctgattaattatccatttttttgtagagcaattaaggttaataaaaataatagaactattgtaagaaaatggaaagaatcaagatcatgtagatgaaagggcttcctggtcagagaaaacacagaaagcctggcaggccatgagccattgtgtaatgacagtgcattgctctagacataggtggggattttggcagcctaatctatgttctaatactaagtcagttatgcagatttttgcttaaagggcattaaacatcctagtgggtgatatattcaaaacatgtttatgaaagagagtatgaggctgggctcatgcctataatcccagtactttgggagaccaaggtggaaggatcgtttgaggccaagagatcaagaccagcctgtgcaatatggtgagaccccaatctctattaaaaatgtttttaaatttaatttaaaaaaagagagtatgatatgggtagtaggtatcaggggaaatattatccctcatattaccctgagaaagcttttcctctcccctcattgaaccaagcataattacatggactatttcattttattttcctaatactcttatggggataggcattattataaaaaccattttgtaaataaggagactgcgccttagcatggttttacaacttggcaagtgctacatagctagggaatttagggggctttaaattaggttaaaattgggaccataccaattggggatcgtatgaattgggaatatctttctctttatctgcagcatgctcttcagcttaacgatgtatgtatcttggggtcttccatgtcagtagagagatatacatctcttcaatcactgcattgaattacatatttgtatatatcatgatttagcaagccattttctctactggtggacaattaggcaatttcctgctttgggctattacagatagtgctgtaatgaacttcttttgaaatacatctttgtacacatttgcaagtatttctgtaaacacttaaatgtgacatgattatgtaaaagacatttacatttaaaatattgataactactttctagttatgctttcctcttcaaaagtatcctttttttctatatcctcacaaacactggatgttgtagtcttttttttgtttgtttttttgagtcttattatgtcacccaggcttgagtgcaatggcatgattttagctcactgcaacctctgcctcccaggttcaagcaattctgccacagcctcccgaggtgcacrccaccacgcccagttaattgttgtatttttagtagagatggggtttcgccatgttggccagactggtttcaagcccctgacctcaagtgatcggccctcctagatctcacaaaatgctgggattacaggcatgagccactgtgtcctgcctggatgtggtagtctttaaaaaaaatctattcttatggatgaatgcatagtatctccttgttttaatttgcatttgcttaatttttaataaagctgaacatctttatatcattaattggacattagtatttcttctttgttcaattctcaatttcctttacctacttatacatgcaattgtttgagttgataaagccctttatatattaggaatattcatgtttcatcttaatatttggtcatactttctgctaatctgtgacttttcttctaacttcattatggtatattttattgcctagaagtttttgggctttatttttaatcaaattatttatttcctttagaacttctaggatctgtgaatttctttctaacctgttagctaaacattgtcccaaattttcttttggcactttttatatatgtatatatttttgttctgaattgtatttttctttgtgatataaataggaatgtttttcagataggtatctaattcttttcataatttattaaatagaccactctaatttgaatagaaaaggagtggaacagaatagaatataaaaatgratctatcccagagctcaaactatattgccttaataagcgaagttttattatgtgttttgatatccactagggcctgattctacccttattctttttcaaactgcttgttagttttcacgaaaaatgtaggtaggattttattttttattgtcttgaattcataaattaacttagggtaaactgatatttacagttatttagaaatgtggatgtctttataatattaaggattttaatccagggaaataatatggcattgcactttcttcagggctttttgtactcatcacttagttttatagagagaaaaatgcttgtacatttatggttggtaattactaagtgttttattgttttgatcattttgttgtattttctaagtttttgtatataggtattgagttttaaaagttacatcgctttactgaactcttattagttctaatactttttctgttaaagctcttggattttccaagtaatcagttgtttaatctgcaaataacgacttctggcttttctttttcaataatttgcagtgttttctgcatgcctacttaatttacaagcctataagtaagctgaagatgaagagtgtattacattattttctttttctttttcttttcttttctttttcgtttcttttcttttttttttttttttttttttttttgagacagtctcgctctgtcacccaggctggagtgcagtggcgcgggagctcactgcaatctccgcctcctgggttcatgccattctcctgcttcagcctccctagtagctgggactacaggtgcctgccaccacacccggctaattttttgtatttttagtggagatggggtttcaccgtgttagcgaggacagtctggatctcctgacctcatgatctgcccacctcggcctcccaaaatgctgagattaaagaatgaaatggtggcatagtcatctgattgctagatgtctcaaaaattatacacagtatcattttccaatatgcagtcttactgttttaggtttgttttatttaatttcagaatactctcaaatgaactttataaactagcccgaatagggaagaacattctgatatcagagtgtttgggatcctgaaaaaaaaaatgttgggaaggagttatttatttgaaacagttatttcatacttactttatatatagacacacgcatacatatttatttacttactagtattagtgaaattgagtgatgttccagaatgaatactgtttaaaccattgttttgcagtcataaaccgggacctattagcagaagtagagaagtggtaaatattaatgaataatttccagtcatatctgccagtgatttccgggacgcatgagacccaggcccagctaactgttattttgtgtgtaaagcttgcttctataggcattttccattgcagtacactcaactatcaatgttttccaaaaaactatagatatgtgtatgtgtgtgtatatatattttggtctagggtcttatatttgaaatatatattccttctcttctgcagtcaaatatgtgaatttctgtttattcttcaagactcaggtcaaatatctttgccttcacaacttctttaccttctcaggaaaataaaaacaaaatagttggtatatgctgcttttatatcagttaccacattattttgtaggtgcttattttgatttctgtgtccttcctaaactgtaagctactagaaactattccttctccagtgcctagcacaatgtcaaacatgagtttagaactgtaaaatattgttgaatgaataaatgtgaataagtgattactaaaaatataagaggaagtgaaggatcaaaagagctgtctaagagaaagttgtaagtatgacaatgtaagaagaatattaggccaggcatagtagcttaagctggtaatcccagcactttgggaggccaagatgggaggattgcttgagcctgggaattcaagaccagcatgggcaatatagtgagacctcgcctctaaaaaaaaattttttttaattagctgagtgtgatggcatgtgcctgtaatcctagctactcaggaggctacagtgggagaattacttgagctcagaaagcagaagctacagtgagcctactactgcactccagcttggagtgcagagcaagaccctatctcaatgaaaaaaaaaagaagaagaaaagaaaaagaaaaatattagcatgggaaacatgctaatatttatgaatattatgaaaagataaataaaagcactaaccctatactatggaaatgtgcattttgatgcagtaaggtttactatggtgaagaaacatggtagagaccaaatagggatccaagtggcatgaggctatgaaaacatgttgaaagtcaagaagaaaacagtacccactcaggtacaaatcctacaaatgatactatttaagaagcatgtaccattaggagctacattatatctgcttctatatatgcgtatgtatttttggtttataggttaccatatatagaatataggaattacttgttttccaataatacaaatgtaaagtgtccatagaacagcagggccagctttgtaggaaatagacatgatttctttagtctttggccttcttttctgccttctgtttctactgcatctttttataaatattattttaaaatctaatcctagattttatgatttttgggggagcacagtttctttaggcacagtttagatgcataataattattgaattttattgaaaatgccagtgtctgttatgtatattaattggacttgatgaattatacatttatttctttcatatattttttcctgtattaagagagggattggacaactacttcagttccttttaagataaacatttcagcagaaataaggacaatcaagtttcttatggctatatctgaaggccacatttagttgtcttttaaatgatgtaggtaagaaataaacagcttcaatatcctgtttgctgtacagccctttagcgatattttcataataatttcataaaagtttcaatgagaattcaatttaaatgtatatgcaagtaaaatgagggatgacaaacaagagcccaggacagtgttagaatggaggtcaggttcagtgatcttatgattgagacagcattataatactgacaccctgctacttcagggctagtataggtcataccatgaaacaggttcagtgtaggtatttgcttaggtagcttcaagatggtttaccttagttttattgggaaacagcagagcgttccagctaatatgattcattctgattctataaaaggcgataaatattgctattcacataatgtgttctgaggctactttgtctcttaaatgattaaaagtggtactatcgcttacacattttaaaaattagtaagttacttttatactgactcaattttccttttcttaacatctcaattgattttaaagacaaaacagttgtttagaagaaattcatcacatgaatgtttaaacttacatagttttggatacctggcaggtttttttttttttctgtattatcatcttgttggcctcttactacaggttttcaacacatactccaatgaagactatgacaggagaaatgacgaagttgaccctgtggctgcttcagctgagtatgaacttgaaaaacgtgtagaaaagctggaacttttcccagtggagctagagaaaggttcgtgagtgctacagtgttaatatcattatgttgctatgttaataatacagrattatttttccaaaatgtagccttttttctaaggattggataaaattttaattctaacagaggatcttatttattaagtttcaaaaatagttgatatggattctgagtagatggtggattgaaagttttactcccaactgaaacccatctatcttagctggctgcgatggtggttaggatcagggaggtataagtgaggcctaatgctttgttggtattcctggaaagggctgctacagctgagagcccagaaagagctggtatatgagagcttggggcagatggtcgctttcttttgttttggtggataattggaaaattatggagatttttaataaaggcggtagaatccaaggaaatttaaatagtagggctacatcctctccccctctgaggggagaaggttgaaagagagcagggagaagagggagcagaaaggcttccttctgatttctctcccaggaatgacaccctgcctactgtagtaactgctgacccgtgggatcagagattaccaggtaagatgtaagatgggcacccaagaactgaactgtcactcagtgaacagagaaataacacctctgagagagctttgaaaaaaaaaagagtagaacaaacagatgatgacttgaataacaagaaaaaaagaaacaaaaacctacccaaggatactcaagcatggcttaaaaaaagacatttgcaaattatgcctctaacaaaggactaatattcagaatctatgtggaactcaaatactcaacaacaacaacaacaaaaagaaagaaacccattaataagtgggcaaaggacacgaacaggtatttcttaaaagaagacttacaagcagtcaacaaacatgaaaaaacactccacatcactaatcatcagagaaatggaaatcaaaaccacaatgagacaccatctcacaccagtcagaacagctattattaataagtcaaaaacagcagatgttagcaaggatgcagagaaaagaaaatggttagatactgttgggggaaatgtaaatcagtacaatctctggaaaacagtgtggagatttctcaaataattgaacatagaactatcatttgaccaagcactcccactactgaatatctccccaaaggaaaagaaatggtatcaaaaagagacttgtgcttgtatgtttaacagaatactatycaatggaaatagtcttggaaatagcaaagtcatggaatcaacctaagtattcatcaatagatgactggataaagaaaatggggcatgtatacactatggactactgtgcagctataagaaagaatgaaatcatgtcttttgcagcaacatggttggagctggaggccattatccctacatgaaataactcagaaacacagagttatttgctgcatgttctcacttataagtgagagctaaacagtgggtacacatcaacatacagagcagagtaatagacactggggactccaaaagtttacgagggtgggagggggatggggcttgacaaataaccacttgcgcacaatgcgaactattcaggtaaaggttacactaaaagcccagactcaccactatgtaatatatccatatagcacacctgcacatgtactcccctgaatttatacagatttaaaaaaagacgttcttgagcaacttagcaacaagaacaaatttcttgattttgaaatgaaaaatttcaccggaagaattgaaaaggatagttattgttgagacttaagttggcgatctagaagatgacgtttgagagatattccaaaaagaattctcaaatgacagagcaaaaatccaagaaaaatcatgaaagagtcccaatatataagttgtaggcaacagaagagaaaaacgacaatggagaaggacagactaataataatcatagaagaaaaatttcttgtccttaaaaagaagatctgaggcttatattaggaagaacttatccatttatgagtgagagggctaaataaccccaaactgatcccacacttaggcatagcctgggaaaaaatcctaatattcaaagataaagtgaaagagcttaaaaaattccaggccaaaaaatacccaaccaaacaaacaagcaaatatacttgcaaaggcaaaataattagactagcatcagactgtaacactagaagcagggagatgtagaaataattttacatgccactgagggtaaaaaggatggtgatccaagaatcccatatccatcccagaaagcatttacctatcctggtgaaagaaagacatctgctgctatctaaggatttaaagaacacattgcctacatactttatctgagtaattcactgtccaatttagcagggagggagtgaaacaaagagcagcttgttcaaaacagcaagggcaaggaaaaaagaggtgaaaactatgaagtattaaacatacaattgcttaaatgaaaaagtatgaagaatactagtcatattacaccaaacatgactgatggattactcctgttaaaagacactttcatttggagttaaagtgaattaaagagtaatgcttacatttttcatacattttaaaacataaaagccattcttagttcattggccatacaaacacagctgggccatcatattacttattttggtagtagcaaaaaaacaagaccaatccaaatattcatcaatggtagaaagggtctataaattgtagcatatctaggcaataaaatattactcagcagcgaaaatggaggtgccacacttcatgcagcagtatgtatgattcttaacatgatatcgagggaaagtaaaaatagcaaaccacagaagaaaccatttagtgtaatataattgcatttacttacatttcaaaccaaaaaaattaaatagcatattgttttgggatacacaaatgagtagtttttaaaaagtagtattaaaaagtagggaatgattaacacaatgtttagtataatggtcactgaggaaagagttgctgtgtcagggagggatatatagtggcttttgtgatgtcggtaatattctgtgtctttgtacatggatgtttgttttatttttatgctttaaacataatgttttgtagataaatattaaactcatttgtatgttgccatatttcatactaaaaattaaactagaaggtaaccaaatcaaatacaattattggagatttcaatatatttctttcagaactggacagatttatggacagaaaacaaaaatcaaggagtgggttaatataatgaactctatttcaagctgtattttaaaagaaaaagttttatcctttggaaaaatgttaaaggttcctttaatatgagaatttggaaattacataatacattcctaggtagatgtttgattgaagagaaaattataactcatatcccaaaccatcgtggaaaggattaaacttaaaaagtccgtctcaaaaaaaaaaaaaaaaagtctgtagcacacagcaaaacctttactcagaggaaaagctatatccttgatttctttctttaaaataaaaaacttgaaaagcaaaaaatggacctgtcttagaaatcaggaaaagtaaaccaaataaatcaaacaaactagcaaggaagagtagtatatgtaaaaacactattaataacatagaaaagaaaatctagtaaaataaggtaatacaaatccttttcattgaatacatctataaaatatatcaatcataatactgagtggagaaaattgaaagtaaacttatgcaaattaggaatggaagaaaaatatatagtgttactataaaagatcagtcagtcactgcatttctttgtcaaatgaggtgaatgcccagaaataatttatgtcctaacaaaatttgaattaccagaatcaactttagtaaaatagactaattgctatagaagaaactagaatgataactacagataaaacattaaaatgtcatcacaaccagatgattctattgtacctttaaagaatgcataaagccagtgttaaactattttagatcatagataataaaggaaaactcttcatttcattgaaataccatataagtttatacccaaaactaatatgctacaaaaaagattgctataatacaactacaattgtgaatatatattttaaaatgctaaatgaaataaaatatcaaatatagaaatagttgaagagaaaaggccaggtgcggtggctcatgtctataatcccagcactttgggaggctgagatgggcggatcacgaaatcaggaggctgagaccatcctggctaacacatgaaacctcatctctactaaaaataaaaaaaattagcccggcgtggtggcacgtgcctgtagtcccagctactcaggaggctgaggcagaagaattgcttgaacctgggaggtggaggttgcagtgagccgagaccacaccactgcactccagcctgggtgacagaacaagactctgtctcaaaaaaaaaaaaaaaaagaaagaaagactcattaggatcaaatggagttttagatacaaggatatagagtggttcattattcaaagattcatccacatacaatttaaaggaaaagcccttaaattttttaaatttcatgtcaaattgktatgaaaagatgtcaatttggtaacatttaccactttaaagaaagactgtaaattaacacatgatggaagctgcctaaatttatgcaaactataaatttacaatacctacagagaattctaattctaaattgagtaaacactaaagatattttaattaaaaccagaaatcaaatttgtaatgccctttaaatgaaatgaccagtataaataacagcaaataaaagatgaaaagcatcatcttttgctgatatattcatatccatatctatctagaaaaccaaattgattcaatattagatttggtaaaataatttgtggaggaagaggttacattcaagatatgtataaaaatcaattttttctatgtaatcacattaagaatttagaaatgaaaatgggaaaaatattttatttacagtagcaccaaaacaacaaaatatttattactaagaaaaacatgaaatttatctagataaaataataacatctttttgaaagtcatttctatttgaaagcaaattgaaagacaaaccatattcttggacaagaaggctccaaatagaactgccaacaaagttgggttgggagaggagaattgcaaaaaacagtattaaatttttttggtaaaatttaagtctggagaaatacagacttaagtatgaaaaggaatatgaatgacttaattttccaaatatctaaatataatgtaaagcttttgtaatcagaacaaattgtattcaaatggcaattgatcagtggaacaaaatagaaaatccagaaaaagatgttagtatgtgtgagaatttaatatatgacacacatgatatttcagcttagaagtaattatgtgctttataaattgttctggcataactgagaatctatctagaagaatctaaagttggataccttcattacagcataggtaaaaataaataactctacatgggttaaataataacatattaaagatgttgtaaagaaaatttaaatgactgcatatatcatctaggcttgtggcaggagagtcttaaccaaaatgggaaaccagaagttagaaaataagctttgggctccatagtatgacaatagtgtcttccataataacatagtccctctgtctttgccgtcattttatggctgttttgccttrgtgctttgcctgtccctaggaatgtatggagaggaagacagggtgcagctgggttctcgatgggtcagccacaggaataataagtggcctttaaggatgaggttccagacttcactcagagaaagctgtatgtaaataagatgctggagaacatcagtcttctggtctctgtgcgttgattgtgctctttcttgtattgcccttcagtcatcatgttgtccttgtaagtaatttgcattagaattgaggatggcttgagttaatattgctttttctgcaactggattttcagctctgcaaatctgagtaattttccagttaaaagcaatgagaggagcaatggaaggaagaaagagaattctaccaagacctgwgtctaggcagagaaaatggatttagaaaccaagaagtaattttcactcaagatagttgcaggaagaaattatttaatggtgtgacagtatggagatttcacatttgagaggagccttttgtacggtaatgagtatgggaaagtttgactcacagctctacattggcttgacatgtgataagttatactgaagagaaaccctgtgagtataatgaaagtgagcaagaattcagccagaatactaatacatatatacaccagagatttcatacaggagagaaattctatggtatttttctgcatggaagaggctacattgatcatctcttaaacaacacaagagcaatacactaaggggaaaaacttacatggatgtaaacactatgggaaggctttcagcaatcattcatccttcatcagtgtgaaaaaaaattcattttcttgagaaaccctatgaatgtgacgaatgtcaataagaattcagctatccgctaaccttatacacacaagagaattcatggtgggagagagaaaaaccctatgcatgtaaccagtgtgggagagccttcagcacacatctaaccttcatgtacacaacaaatctctgtgtacgaagattttaaagtttctgtggcgaaactttaaaactataatgaatgtagaaaatctttaacaagataaatcctcttgatgaaatcagtctttataccagagaaacaatttgaataaataggagaaatcacatgtatataaacttaataaatgtaatgaatgaggaaagtcttcagagattatttatgttagtcagcattaaagttttcacactaaagagacacctatgcttagaatcaatgtggaagtgccttcagctggggtttgcatcaggcagctcatccaggggaaacactgtaaagattcctctagcataccactgagcaaacaaatcacacttttgccaagtgacatcttttaaaacatatgtagaataaagatataagattgtcaggtgtacttggaaatacttcaggcataagttggttataagtagtaatgtatgagataaaccttcatccgaagaatactaattacaagaatcctggccaggcctggtgactcatatccataataccagcactttgggaggctgaggcaggagattgcttgagcccaggaggttgagaccagcctgggcaacatggtgaaaccctgtctgtacaaaaaaaaaaaaaaaaacacaaaaaattacccagatgtggtggcacatggctatagttccagcacctcggaggctgaggtgggaggatcaccagaacccaggaggttgaggctgcagtgagccatgatggcgccactgcactccagcctgatcaacagagtgagaccttgtctcaaacaaaaaaaaaaaaagaagaagaagaaagaaaaacagaaaaaatgcttaagaaagtgaaggttattgctgaaaagtcttttaaaagtgtcattctgttgagtatatggaccaatatttctttaataatccatcactgttgattagttagtatttttatgctgctagtaaagcatgattacaaagactttgaggctatcagaaaataaccttgaactttaactaaaacatgtggcacgcaaaatagtgtatcttttatatattcacagaaaggacaaatggaaatatggataaacgtgatttgtaagtgaattaaaaaaaaaagtcacacagtattgttcataggaccagtaaaatggaaataaaaatgtgaatacagaatggttggatacattatgataccatctcaccatgaaatattattcagtcattagaaataatttagagatatggacattgaggacattgatatccatgacttatcttttttttagacagggtctcgcagtgttgcccatggtggagcactgtggcatgatctcagctcactgcaacatctgcctcccagactcaggtgatcctcccacgtcagcccccaaacagctgggactacaggtgtgccccaccatgcccagctaatttttctatttgtagtagagacagggtttcaccctgttgcccaggcttgtcttgaactcctgggctcaagggattctcccacctcagcctcccaaagtgatgggattacagacgtgagccactgtgcccaggcgcttcattggtttttaaaaagtaagcagtaaagagaagtaggtataatctcatttgtgtaagcaaataagaaggaaaaacaagctatatatacatatatatacattcatatatgtctaagtatatgtatatattatagttgttgatgagtatatattcttgggtatagaagcacagaggaaagtactcaaatatactatctttttttttttttttttttgagatggagtctcgctttgtcacccagggtggagtgcaatggcacaatcttggctcactgcaacctccgcctcctgggttcaaacgattctcctgcctcaacctcccaagtagctgggactacaagtgcctgcccccacacccggctaactttttgtatttttagtagagacaggctttcaccatgttgccaggctggtcttgaactcctggcctcaagccatccacctgcctcagcctcccaaagttctgggattgctagcatgagccaccatgcccagccacatgtactatcttattaacatgaataaacaagtaaagaagaaaagaccatataaatgaaggaggaattccagatatgttatgatcagatttatttaaaattatatgtttgaatatgtgtactcttacgcctaaaataattcattgcattatttagagaatctaggttttaaggcagagtgactattcaataatcaarttgttaccttttcttgagaccacagtgaattaccaacagtagtagtaaaatgatgctaaatgcatgagccttttggaggatctcattagatacccttactgcgtagcttagaaaagaattctgctaaagcaagcatgttattgtcctatccataaggaaaaataaaattagaaacagcaagtaggtctcaccagctaattgcagactagtgtaaaacttaagttgtttcacctcccccctttttttctttttaatagatgaggatggtcttggtataagtattattggaatgggtgttggagcagatgctggacttgaaaagctgggaatattcgtcaagacagtaacagaaggtggtgctgctcaacgggatggcaggtaaattaaggactgttgttaataacttaaaatctttagagaactttcctggaagtttccttcagttgtagctttttgcttttgtttgttgattttttaggatagaatttcaggtttctcagatgtgaaaatctttaaacacttgaattattttctgatatgcaggcaaaatatctgctttctttaatatatattaggtaaatgagtgggcagatctatcagtctatacctgtctttatccattcatctatctggtgggaagtgggcagaaacatgggtgtatatagttgtaaatgtgtgctatggaggtcagcacatagtttcacttcagaaatattgaaagaaatgataatagttctggcatcttaaaaaatgacacatgtagatggtaagttaggaactctaattctgtattgatggtaattctgaaggtcagtgtttctccaaatatatttatgtaaaaacacaggttcttgggtgcacctaaacctgtagaattaaaatctccagtagaggggtctggcagtctgcaccttggataattctagtacacagcagagcatccagattatcactgttttgtcttagctttcataatctcaagctatttgtctgtctgtctrtctatctatctatctatctatctatctatctatctatctatctatctatcttaggcgaagattttgattaaccctcatacttggctctgatatatcaggttgaggctagaagcagaaggtggtgtcttagtttgttttgtgctgctatggcagaatacctgagactgggtaatttataatgaacataaatttatatggctcatggttctggaggctgggaagtccaagattaaggggccacatctgatgaggaccctccagctgagtcatcccgtggcaaaaggtgcaaaggccaagtgagagagagcaagaaggggcaaaacttgcttttataacaaacccactctcaaagaaataaatccacttccatgataatgacattgatctatttgtgaggccagtgccctatgacctaatcaccttttaaaggtctaacctctcaacactgttgcgttaaggatcgttttcaacatataacattcaaaccatagcagttggcaatataataaaagtagacccaaatatacgactgctaaattcaaagrrttattatgttgttttatgtacatttaatgaatagctttaaatttttttatgtttaagtatgtatcatttgaccatcttatcaagaaataataaagcatgttggaaagaatttgtgaatctgtgaggagacccagagcaccattttttttttttttttttgagatggcatctcattgtgttgcctaagctggagtacagtggcatgatctctgctcactgcagcctctgcttcccaggttcaagtgattctcctgcctcagccttctgagtagctgggaccacaggtgtggaccaccacgcccagctaatttttgtatttttagtagagacggggtttcaccatgttggtcagaatggcctcgaactcctgacctcaagtgacccacctgccttggcctcccaaagtgctaggattacgggtgtgagccaccttgcctggcccattgtttctgttttaatcctaaaaatgcatactgatacccacagatagttctcaaagagagctaaattgatttatgtaaatacaaaaccacaccttatatcttcttttccatgaggttagggataacatcttagttggtagccttgtttgtattcatatagcacttagcataatgctttgcatagagaaggtttgaaataaatcttttgagtgaacattcagctgtctacatttaaaacaaagaatgtggaatatgactatcttgtgtccyaaattaacttattaacagtcttcctccttttcagagtagttaaggaaataacctctttgcccctttaataaattatatataatgatagtagtatttccagttattaatttaccacctttcttccaagagagctaaaacttgtttgtaaaatatacctcatttcttattaagtttgatgaaaattttaagatcatgggaaataatgctacagttagtattcaaacatgcttaattgttatgaaccatccagaaagccaaaccaaagtacaacttgattaaaagaagaaaaagtcagaatattttgcattaatagccatgtaacagatgtcctgaaaaaaaaaagaaagaaaaataaaattttgcatttagtagttaaccagttcctgttgttctaaacatagacatatttatttttccttcaatcattttaaaattaggtttgctttctattaacctatttactaattatttattcttctacatagtttcattatttataactacattagaactctgctttaccagtcccagtgtacatttatttcctcagtccttttaaatgagtattttcctagtatactaatcctgttgttgttataataggtgcttaataaatgcctcagtgaatatattaagacatgtaacttgggccaggcgaggtggcttatgcctgtaatcccagcactttgggaggctgaggcaggtggatcacctgaggtccggagttcgagaccagcctggccaacatggtgaaaccccatctctactaaaaatacaaaaattagctgggcgtggtagtgggcgcctctaatcccagctacctgggagactgaggcgggagaatcgcttgaacctgggaggtagaggtggcagtgagccaagattgtgccattgagctccagcctgggggacagaatgagactcagtctcaaaaacaaaaaacaaaaaaaaacttcatgtgatgtaatggatagaatctttaagaaaatgtaactaggagccttcattccattccctctacttatcatctggggatattcaacaaattacttaattttcatgttatctacatcgcaggttgtggtaagcattaactaagtttgtgtgaataaccttccatagtgctattcatatatatgaaactgttcttgaaccaagtaagagtaagcttgaaacttaataaaaaaaatagttattatgggagaagcctcatggaaaactattaaaggtgtacaacataagtacagaatcaaaattttagaggtcagagaaactttagagtttttataatcaatacattttcttgtctattaataagaaaattgagggtggttgtatatgtgcatatgtgtgtgggtgtcagaaaatgacaaaataaaattattattacacttacaacagatttatatcttttaaattattatttccaccactactggtgtgttcatttgcacagtgtttactgtttactgatgtttactatttaaaaggtatcaacatacaaaagtgcagttcctctagtcaataatacattttaagttatgtacacttactgatatagaaaaatattccattaaggatttacaaaatagtgtgattaatatgatgcccttcttgtgtagggtatatattctatttcttcttttctctctctttgttcctttttgtccttatctctcagtcattctctttcttaaaaaacctaaaattaatatatacaaaagtgttgaatggctctagtgtatgggttttttaaaattttggctgatatagaatatctaattttgtagagaatatataccacttgtgtatagtttctgaattaaaactaaaaatgataagattttcaccccgaggaaattacttgtcagacctcctttattgacagaattaaagttctgggttagatgttctctaaggtagttccttttagccttgaaaggataagattctgtattattgttttctagctttctagcttgctttagattcttaataactctttctatttaagaaaatttatttcaatttaaactcagatttagtcatacctccttcaaggaatgttaaatgagcagacatgtatacatagaaagttttttttctccccctcctccctccttcctgcccccacaagaagccttttcattgtgatcgtttgtattcctgtttaaatggcttgtaaactctcaccacattttgagtagtttaaaaaatttgccgtgggtatttatcctcctgagtttatccagtatagttaaatagttaaaaagttttgacccttccttattctttgatattatctcttacattcaaaattttcttttgtcaagcttttcatgtgtgtactttatcctatgatgccttaaacttacagggtgctcaataaatatttgttgaatgagtgaatccttgtgctttagtcactttttattttttatttttagaggcgaggtctcactgtgttgcccaggctgacctcaaactcttgggctcaagtgaactccccacctcagcctcccaagtaactgggagtataagcgagtgccacagtgcggggcttttagtcacttttgaaacctttacttgggcttatcatttttctctgttttggttttgtgctaccttccttttacagagtagcttttaatttagttgaatgatatgatagccatttctatttcctgtttctaaatttttagtaaaataatattaaatacattgactattagtttttgttgtcataaatgtaatttttgggattgcacagaggacactttcacacactaatgattttccagtcctcattcatgattccataaagcaaaattagtttcataaaaacaattcaaaatgctgaattgtagagtaaatcacatggatggtaactgacaaaggatgttaataatgctgtgctaaattagaggcaaattaaaagtccattttggacacacgttgtttttgggtcctgtttttgtttcacaagcttttgctcatcatcattttcaatcactgtccttttcaattttattggaagagataccacatatgaaattaaggttctatgtagtttatcctcattcaagtttggtttttaaatgattttaattgttttttttcacatcttttgggtaataccaacatatacaatagattaaagagtcctattcttttgcttatcctgcagcaaattcaccccctcttaggacccatctttgcctgaagtacccttcagcctaagagaaccctggatggaaacttgttttaattgaatctgtcatggtcccctattcgatggtttcctctctgtgcacacactctcatgttagtcttctaataaaatattttgcctattcaccccttagatttgggctattactgctttgatatgtattttcacaattttcacatacatttaaaacttcagtatctagcattttgaggaagatctctgttgacctaagtacattaatgttgctccagctggtctccctgtcattcttctttggtggctttgttgacaaaagccccgtgaggtagggttattttttttcccttcccagaaacactgtgtcaataagtaactatccagtaacattaaacaaaccctagaaaaatccaatttatgtattttcattacccttatccctattgattctggttttcagattaagaattgcaggatctcagcaatatcacagtgagactgaagagcagtagtgttgtgcacttttgtttatggtaagcacatggaaactattgaggaactggccaggatgagatagtttttacaaactagccaggtatgttcccataaattccattccagtcgacagtatttccaggggaaacaggctatttcctctgctatcctggaaaactttggaaagtttagataatccatagaactggttattctttgtagtctgggatggtctgatacagaactctgtctaggtattcttttgtttttaaccactgagagtcttcccttgtcttttctgtgcttttcattacagctaagatttaagagagattatcagtgttactgttctgtgaggttgcatctaaaagttgtcttctcatgagataaaagatacaagcaaagtgggtgttagacaccagaaaatttttcccgtcacagtaaccatttttgtatttaatactctgctggctcatgttctagggagttgtaggagcaatctatagtgggaataaacctgaaccactgcctttttcatccattattcccctcatctctcacccaaccctctttacctctctttcctcttctcctcatttttagtttcttgaacttatctccaccttaatcatcacagtttacctccataaaaaggtaaattgaaaagcccgttatatagcaaactccatagaactccacttctcttcctccctccctctctcactctttttaaaaacgttaaagatggtttttatttcctcatttttttaattatcagattttcaaattttttctttaatgaatgtatcactttgaaatgagaaaaaaatttaaatggacacccttttgatgaaaatgataatcaaatagcatgaagctttctttgtcccccttaatgttttcagtattaaggtagacaggaagaactatgtagaatcagtattttagtcataggattcctctttttcacattgatctctgatctctgaatgcaaagagcaaatccagccgaaagtctatcgttactgtttctgttgcatggaatactttgcatcttgtatctcttctgtcttctttttttctttcttttttttttttaaacttttattttagattcaggaggtatatgtgcacttttgttaactgggtatattgtgtcatgctaaggtgtggggtatgaatgatctcatcacccaggtactgatcatagtacccaatagttaatttttcaacccttgtctccctctcttgctctcccctctattagttcccagtttcgcttgttgccatctttatgtccatgattacccaggatttagctcccacttataagtgagaatatgcagtatttggttttctgttactgcattagtttgcttaggatgatggcctccagtttcatccttgttgctgtgaaggacatgatttcattcttttttataggtgtatagtattctatggtgcatatgtgccacatttttctctgtctagtccactgttagtggacacctaggttggttctgtgtctttgctgtcattaatagatttgcagtgaacatgtaagtgcatgtgtctttctggtaaaatgatttgttttcttttggatatctacccagtaatgggattgctggattgaatggtacttctgtgttctttgagaaatctttaaactgcctgccacagtgactgaactaatttgtatgcccaccaacagcgtgtaagcattcccttttctccacagcctcaccagcatctgttgttttgactttttaataatagccatactgattggtgtgaaataatatctcattgaggttttgatttgcatttccctggtgattagtgatatggagcattttttaatatgtttgttggctgcttgtatgccctctattgagaagtgctgtttatgtcttttgcccatttttaaattgggttatttgtttttcacttgttcagttgtttaagttctttgtagattctgggtattcgacttttgtcagatgcatagtttgcaaatattttctcccattctgtagcttgtctgtttactctgttgataatttattttgctgtgcagaatctctttagtttaattaggtcccactcatcaatttttcttttcttttctgttttgttttctgttcgtttgtttgtttgtttgtttgttttgagatggagtttcgcttttgttgcccaggctagagtgcaatggtgcgatcttggctcactgcaacctctgcctcctgggttcaagcgattctcctgcctcagccttctgagtagctggaattacaggcacgtgccaccacgcctggctaatttttgtatttttagtagagacagggtttctaccatgttggtcagactggtctcaaactcctgacctcaggtgatccacccgcctcggcctcccaaagtgctgggcttacaggcatgagccatcatgcccggccttttgttgcaatttcttttgaagacttagtcataaattctctcccaaggccaatgtcctgaatggtgtttcctaggttttcgtctatgattcttatagtttgaggtcttacgtttaaatctttaatccatctggagttaaatttttatatacagtgaaagctaggggtccagttgcattcttctgagcatgactagttagctatcctagcactatttattgcatagggagtcctttctccattgcttatttttgtcaattttgtcaaagattagatgtctgtaggtgatagagtttggctgtgtccccacccaaatctcatcttgaattgtaagtcccacagttcccacatgttgwgggaggaacctggtgggaggtgattgaattttgggggtggaggcattcctacattattcttgtgatagtgaatgaacctcatgagatctgatgattttaaaaaggagagattctctgcacaagctcttctcttgtctgccgccatgtgagatgtgtcattcaccttctgccatgaacgtgaggcctccccacccacatggaactataagtccaataaacctttttcctgtataaattacccagtctcaggtaggtgtttatcagcagtttgaaaacagactaataccccacagaaaaagtggggtattgctgaaaagacacctgaaaatgtggaagcgactttggaactggacaacaggcagaggttggaacagtttggagggctcagaagaagacaggaaaatgtgggaaaatttggaacttcctagagacttgttgaatggctttgaccaaaatgctgatagtgatatgaacaataaggtccaggctgaggtgtcctcagatggagaagaggaacttgttgggaactggagcaaaggtgattcttgttatgttttagcaaagagactgttgtcattttgcccctaccctagagatctgtggaactttgaacgtgagagagatgatgtaggatatctggcataagaaatttctaagcagcaaaggcttcaagaagtgacttaggtgctgtcaaaggcactcagtttcaaaagggaaacagaataaaagtttggaaaacttgcagcctgacaatgagatagaaaagaaaatcccatttcctgaagtgaaattcaaatcagctgyagaaatttgcacaagtaataagtagctgagtgttaatccccaagacaatgggggaaaatgtctccagggcatatcagaggtcttcagggcagcccctcccatcacaggctgggaggcctagaaggaaaagtggtttcatgggctggtcctagggtccccatgctgcttgcaccctagggacttagtgccctgtttcccagctgttccagccttggctgaaaggggccaaggtagctagcgcttgggctgtggcttcagaggatgcaagccccaagccttggcagcttccatatggtgttgagcctgcaagtgcacaaaagtcaagaattggggtttgagaacctttgcctagatttcagaggacgtatggaaatgcccagatgcccaggcagaagtttgctgcaggggtggggctctcatggagaatctctgatagagcagtgtggaagggaaatgtggggtcagagcccccacacagaattcctactggggcactgcctagtggagctatgagaagagggccactgtcctctagacctcagatgggtacatccactgacagcttgcactctatgcctggaaaagccacagacacttaacaccagcccatgaaagcagctgggagggaggctgtaccctacagagccacaggggtggagcttcccaaaaccacaggaacccacctcttatatcatgtgacctggatgtgagacatggagtcaaaggagatcattttggaactttaagatttgactgccctgctggatttgagacttgcatggggactgtagcctctttgttttggccagtttcttccatttggaacagcagtatttaaccaatgcctgtacccccattatatcaactatctaacttgcttttgattttacaggctcataggcagaagggacttgccttgtctcggatgagatgttgaactgtggacttttgagttaatgctgaaataagttaagactatgggggactgtttggaagrtgtaattggttttgaaatgtcaggacatgtgatttggcaggggctggggcagaatgatatggtttggctgtgtcctcacccaaatctcctcttgaattgtaactcccacaattcccatgtcgtgggaggaacctgctaggaagtgattgaattatgggaatgggtctttcctgtgctgttgtcgtgacagtgaatgagtctcacgagataatgatggttttaaaaaggggagtttccctgcagaagctgttctcttgtctgctgccatgtgagatgtgcctttcaccttccgccatgattgtggggccttcccagccatgtggaactgtaagtccaataaacctttttcctttataaattacccaatctttgatatgtcttaatcagcagcatgaaaacagaatggtatggggcattatttctgggttctctattctgttccattggtttatatgtctgtgtttgtaccagtagtatgctgttttggttactgtagcattagagtatagtttgaggttgggcaacgtgatgcctcctgctttgttctttttgcttacgattgctttggctatttcagctctttttaggttctatatgaattttaacttttttttttttttgtctttcaggaggtaggtgctggaatctatctgaatttttaattttatatattttttctagttctatgaaaaatgacattggtagtttgataggactagtgttgaatttgcagattgctttggtcagtatggccattttgctgatattgattcttctaatccatgagcatggaatgtttttccatttgttgttgtcatctataatttcttttagtagtgttttatagttcttcttatagatatctttcactttcttggttagatgtattcctaggtatttcattttgtgtgtgtgttattgtaaatggaattttgttcttgctttagctttcaacatgagtggtattgatgtatagaaatgctactgatttttgtgcattgattttgtctcttaaaactttcctgaagttgtttatcagtttcagaagctttttggtggagtctttagggctttctaggtatagaattatattgtccatgaagatagtttgacttcttcttttcttatttggatgtcttatttctttctcttacctgattgctctggctagaactcccagtactatgttgaataggagtaatgagagtgggcacccttatcttgttccagtttttaaggggaatgctgccagatttctgcccatttggcctaatgttgactgtgggtttatcatagattggttttgttattttgaggtatgtttctttagtgcctagtttcttgaggttttcatcatgaagcaatattagattttatctaaaatttttccctgtctgagaagatcgtatggtttttgtttttaattatgtttatgtggtgaatcatatttattgatttgtatatgttgaaccaactgtcatggcttttgtagttcagtggtgggtgagaaacacacctagcagctcttttcccccacagtttggtgagcaggagggaggattccggtgttacatgaccccttcggtgccgcttcgccagctggaaatctctgcggccgatgtctctttgctcaggctcactgggttcacgctgctcacccgcccgctgcaggctgcacttggcttgcaccccagtctggatgctgcacccgccacaggatccacacttagtctatggctgggctgggtgtgcagcaacctgcttcggtcttgggtgctggcatctagacaagggtaatgtggtgacacccagaaactcagaggtgccagcaactgttgagccccaagtgctgttacagctctcacccagagagtcccaaggtctgagatccccaagaaatgttataccttcttcgtgttacagatcgtttgctcctgctgcctgcagagtggcaaattctgggttcttgtgccatgaccaagaagaattagatactcagacaccagagactgagtagggcagagaagaattatattgagcgacagaaggagatctctcagcagagaagggacccaagagcaggtagccctctgtgaggctgagtccaggatttttatgggctaataataggaaagtgcatgctgattggtccatgggcctgcctggaaaaagcaccattcaattggttaaaaggcatcaaggaagttctcattccagtcacgggctctatggactggtagctcagttttcagtctttaaactgtctttggcttgtaggtcgggtttcaccagggacctgtccctgtctgcctaggaatttgtctgcctccttatgctgtcattcatagcaaataagtagcagagcctgcctgtatacctaggatatctgactctagtgcttatacttaaataatatattactttatataatgtcattagtttttataatagactttaaggatatattatgcagtcgtattatatatatatatatatatatatatatgcacatcatttatatattgttttacgagtatgttgtttcaagatattggtgaggtaagcatttttacataaaaattattgttcatcattctttgaaatgaattcttaggaccagaagaccatgtccaggtgcattacattttatttgatttcattatttatttatttatttggagacagagtcttgccctgtcacccaggctggagtgcagtggcatgatcttggctcactgcaacctccacctcccgggttcaagcaattctcctgctcccaagtagttgggaccacatgtgcacaccaccatgcctggttgatttttatatttttagtagagacaggttttcaccatgtttcccaggctggtcttgaaccaggcagccatcctcctgcctcagcctcccaaagttctggggttaaggcatgagccacaacactcggccctaggtgcattaaattttaaatgctttaaaaacatatatgtttattgcagcactatttacaatagcaaagacttggaaccaacccaaatgcccatcaacgatagactggataaagaaaatgtggcacataggcaccttggaatactatgcagccataaaaaaagaatgagttcatgtcctttgcagggacatggatgaagctggaagccattgttctcagcaaactaatacaggaacagaaaaccaaacaccacatgttctcacttttaagtgggagttgaacaatgagaatacatggacacagggaggcgaacatcacacactggggcctgttggtgggtgggggtcaaggggagggagaacattaggataaatacctaatgcatgctgggcttaaaacctagatgaaggttgatgggtgcagcaaaccaccatgacacatgtatacctgtataacaaacctgcacattctgcacatgtattcactcttgttgcccagtctagagtgcaatggcgtgatctcggctcaccacaacctctgcctcccaggttcaagtgattctcctgtctcagcctcctgagtagctgggattacggcatgtaccactacgcccagctagttttgtatttttaatagagatggggtttcttcatgttggtcaagctggtctcaaactcccgacctcaggtgatgtacccaccttggccccccaaagtgttgggattacaggcatgagccaccacgcccggcctatgttagactcttgataagtattcaaacacatttgtgagtggaatgattccagtttcaggaaccaattttttttcttggcaaatttccttataactttagtttttaatgtttgttctattacttttcctaaaggcaattttcaataatctctagtctttgtgagggtcatattgccatttactttttttaaaaaacagtattatacgttagggctgatgactttcgttatttggaaaaacactgtgacttctgaatccatctattctcagtcttcttgttgctctcattttgttttatcttcactttaaagagtcagcagcccctcctcttaacatcaacctattttattcatacctttcttagcacacttatagtgttttttatagcttatcacactcctgtgtctctaatgcctgcaacacatatcctgtatatgcatatacacatatttacatgtatgtgtacatgtgcgtatttgtgtatgtgtatggtatccttaaacagagatcatgtcttatttaaatttgtatcccagtaactctctgtccttttgctatagtcaggatcaaattacttttgctaaattactaactggattattcaaccaaaccaatgaagcaagcatattattttccctatttatatttttccagcatttttgctatctttcttctgattagattacttagtcccttcagttgtacttatttcattgcattttatcagaattgacaggatgcttattttcagacattttttgatctagtttgttctttctttatttttgcccattaaggcaattatcaccttagttttcgttcacttctgatcattctatctattgatattgtacaaacctgtattttgcttttatttttttcttcccagtaaatactagctctgtacatatttgatttttaaaacttgttttcaaagtttttttataatctattatttagtattcctcttactcactcttaattttttgccctttaaaaaaatatttgccttctcaagtgctcttgccttattaaagttgcattattaatcctttcacttcatgaaagtatgtgacagtgattatctttctgtttgagagattaagctttcagctttactttttttttttttttttttttttttgctggaaagccacctctgttcatccttcaaatgccatggctcaactttaatttggctttcaaaatacaaagtatattataaattaaatatttgaaagataaagaatttcttcttgcctttatcttccgtatacgtccctaagtccaccaacttgtagtgccatgaaagttgcttggcaggattgccatttgtagtcatttgtcactcagaaacattgatgattattgctatcaaagaatatattgagtacttgttaattccatagcattctattttattttatgcataagttaaaaagaaataaaaggcataatttcatgctttaaggtagtctagaatcaacttataacacaaagtctctgctcctaacacatctttacacaacataataacttttataaagcaatacaactaaatattaaattatgtggttgggcacagtgacatgcacctatagtctcagctaccagggaggccaaggtgggaggattacttgatcccaggagtttgagaccagccttggcaacatatcaagaccttatttcaaaattaaaatcataaataaataaaatgatgcaagtcgtatataaacatgcacaaagatataaagttaaaaatggtattaaggtcatgtaacatttagtcaggaaagatgttttctagatagtctgagaaaataacattttaaatgatgattggctaggagaatatgtgattgtgggaaagagaatggcatatacataatgatggagaactcagcaggatatttgcttcttttaagtctcattaacaagtgtgtatcagaaatactttcctaatatttgacatcctaacttttgttccatccagaaaataaaaccacaaataaaaggaattctttcttttcctaaaatgtcttaataagattaggaaaacatatttattgctctgggtttagctataagacccaagaagtttgcactctgtctgcttaaagagaccttatacatcaagaaataccacacaatatctggtaatatgtaatgtaagtttgaggtattcagtgatatagaagaggttcaaaggttggaaaagatcataagcttggataggcaggtgacttcaaagagaagttatttgagctggaccttcaagaaaaggcttttgaaagggtagagaaaggacttatgggcaaagtttcataaaagatgcaagtctttttttttaatgtatctttttataatactttaagttctagggtacatgtgcacagcatgcaggtttgttacatatgtatacgtgtgccatgttggtgtgctgcacccattaactcatcatttacattaggtatatctcctaatgctatccctcccccytcccccaaccccacaagagactctggtatgtgatattccccttcctgtgtccaagtgttctcattgttcagttcccacctatgagtaagaacatggggtgtttggttttttgtccttgcgatagtttgctgagaatgatggtttccagcttcatccatgtccctacaaaggacatgaactcaaaaaaaaaaaaaaaaaaaaaagatgcaagtcttttcagagtgtggcttgccttaaagcttttagttaatgtgaggatgttgctggaaaaaaatcaagtcctgttgaaatgaaattaagggttgatggcagtaggatatttggcaggtaaataaatggaaacatacatgatgtttgtagaacagaaggctcactgtctttcagatgtgaaatttccccatattgatctgtagagtcaaagaaatcccaatcaaactctagcaggttttttgttgttcttgttgtttttggagaaattgacaagattgttctaaaatgcatatggaaatgcaaaggaccaagataacagttctgaaaaagaacaaagttagaggactgaccttatttggtttttcaagacttgctataaagcttcaataatcaggacagtatgccattggtatagaaatatagatcaatgtaatagaaaaaaagtcaggaatagatgaaaacatatagtcagttgactttctttttttcttttttttttttttttgagacggagtcttgctttgtcacccaggctggagtgcagtggcgcratctcggctcactgcgaaccccgcctcccaggttcacaccattctcctgcctcagcttcccaagtagctgggactaaaggtgcccgccatcacacccggctaattttttgtatttttagtagagatggggtttcaccgtattagccaggatggtctcgatctcctgacctcgtgatccgcccgccttggtctcccaaagtgctgggattacaggcatgagccaccgcgcccggccagctgactttcaataaaagtaccatgataattccattggaaaaagtatagccttttcagcaaagtgctagaacaattagatacccatatggagaaataaaaaattggaccacaaaccctgtttcacaccatatacaaagttaattcaaaattaattgtagatctggacataggtctaatattataaaagctctaaaagaatacagaggtgaaaatctttataaaatcatattaaacaaagatttctgagacaggacacaaagtacgaaccatgaaagaaaaaactgagaaattgaacttcattatatccaaattttcgttctttgagaaacacagttaagaactgaaaagcaaagacatagacaaggagaaaatattttcaaatatatataagaacttgtatccagaatatgaagaacactaataatgacaagaagaataaccactgaatgtttaaaatatggacagaagattcaacagccacttcaaagtggaaaacttatgactggccaatagtatgtgaaaatatattcaatgtaatagcaatgcaaattaaactttaatgagatattactgcacacctagtagaatggctaaagataagaatgctaacaatataaagtgctgacatggatacagagaagtgaaacgctcccttatggctagtgggaatgcagaatttcactgccacttaggaaaacagtttggaagttttttttaaagttaaatrtacacttaactttttgatccagcaattccactccaagatattttccaatagaaatgaaaacatatgtctacataaagtcttgcatgtgaatgacaactttattcataatagacaaaatcaggaaacaacttatattagtccattctcacactgctatgaagaaatacccaaggctgggtaattgataaatgaaagcggtttaattgactcacagttcagcatggctggggaggcctcaggaaacttatagtcatggcagaaggcacctcctcacagggcagcaggagagagaatgagtgcagagcgaagggggaagccctatacttataaaaccacctgatctcatgagaacttcctcactatcacgagaacagtatggaggaaaaccagccccatgattcaattacctcctatcgggtccctcccacaacatgtgaggattatgagattacaatttaagatgagattagggtggggacacaaagccaaaccatatcacaactcaaatttctattttgtgcttttgcctcatgtcttctgaatgagacttttgcagaaggtgcaacttcaggaatctgtgattttcaaaattgcttcatgttattctgttgcagtgaggcagtttgggaaccagtgccctagactatcttatccagtaaggtagggacgctgctaattcgtagagtacttttttgcaaatttggaaaaacatgccttttctggaaagatgcagtcttattgatgtatggcctggcagctagaatgaagactgaatttcagctttctttatattccctcatgtgggagctgtagttcattgtttcatgtacattacataaagcaaaacattaaaaaaaaaaaaaaaagaaaaaaaaaaccctgaagctttgactcccaacctcatcatgagtaagcttaatctggcagagtatttaagctagatgagtctggaattagcwagaagactttttgttttttgttttcctttaaagcaaatctctaatactactaccacattgctaccaaaggcattactacttagagctagaggaaaagtagaaagaggctatactggaagaaaataagagaatggctgagtagctcaaagtgaacccagctcttgctacttgctagaaagaaaagaagaaatgaaagtagaagtaggtggttgtagctccattcatttttccactgtaggggagtggagcgtaagctagagagaactagagaaggccatgcttttctaaatttctgggaagaatgactaacaaagggaaaaagtgattatggacctactgtatgagagaacagaacctctgtccctctaaccacatggatcaagtgggagaaggcatatatacagtattctagaatttttaatccactataatatttaatccattaattaattttcaatcaattataattgcttatttcactttatttttttgacagagtcctgttctgttgcccaggctggactgtagtggcataatcttagctcactgcagcctttgcctcctgggttcaagtgattcttttgcctcagcttcccaagtagctgggactacaggcatgccattgtgcccagctaatttttttgtatttttagtatagacggggttttgccatgttggccaggctggtcttgaattcctggtcccaagtggtctacctatctgaggctcctaaagtgctgggattaccggcatgacccaccacaactggccaggagatgagagtagttttagtttttatttttatttttttgagacagagtttcactctatcacccaggctggagtgcagtggcacagtcttggctcactgaaatcctctgcctccaaagctcaagcaatcctcccacctcagcctccagagtaactgggaccactggtgcacactgccacacctggctaatttatttatttattttttttaaagaagtggggcttcgccatgttgcccagtctggtctcgaactcctgggcttaagcaatccgcctgccctgccctcccaaagtgctaggattacaggcttgagccactactcccagccttaattagttttaatgaaaccaccacaataaacaataaaatattcttgaacttaactaacattcctattttctatgggtaaagtatttcagtcttatgcatggtgaaataagggtgaggtgaagtcagataagggacagataataaaaaaatttaaatgtcaaaaatgataatctaggatgaaaataccagaattaggtgaagacccagtgctgaagaaacttgaaaactaggccaagtgattagaaatatattttattggaatgatgaagctgatggtgtttcagataaaattgttctctaagatttatttttttacacctttattgatatgtaattcacataccatatagtttactcatttaaagtgtacaattcagtggttttgtgaatattcaagagttatataaccatcacaattcattttagaatttttaccacccaatatttttaccactcaaaaagaaaccccaaatccattaacagtcactttcctttccccccagctctcctctcccttctctgccataggcacaaatctactttctgtctctatacatttggctctcctggccatttcatgtaaatggaatacagtatgtggtcttttgtgactggcttttttttttttaactagagaaacgttttcaaggttcattcatgttgyagcatttatcagtacttaattcatttttattgcaaaataatattccattgacttgataataccacatttagtttattcattttgatattagttgatggatatttgggttgttttcacttttgggctcttaagaataatgctgcaatgaacattcatgtgatagtttttgtgtggacatattttcatttctcttgggaatatatctagtggtagagtttctgggtcatataataactatgtttagccttttgagcaactactagagtggtttcataagcagctgagtcatattacctattcacgagcaatgtatgagggttccaatttctttacatcctcatgagcgcttgtttttatctctttgattattgagtgggtatgaagtatttcattttagttttggtttgcatttccctggtggctaatgatgttgaacatttttttcatgtgcttattggccatttttatatctactttggataaatgaatattcagattctttccccattttaaaattcggttgttttattattgagttagagttttttatgatattctggacagaagtttcttatcagatacataatatgtaaacattttcttttaacttatgagttgccttttcactttcttgatagtttccttagaaacataaaatattttaattttgatgaagttcaattcatctagttttttttgtcacttatactttgatctcatatcctagaagactttacatattctgagatcataaagatttactygttcatcttcctctaagagttttgtagtttttagtctttcttatatttaggtctatgatccattttagttaattttgtataaggtgtgaggaagggatatattcatagcttcattcttttccatatggatatttagttttctagcatcattttttgaaaagactagtctttttccattgaatgatcttggcatccttgttgaaaatctgttgatcataaatataagtgtttattatatggacaagattaatttttttaatgagtgatatgcagaatgaatttgaggaacacatagagccaatgataatgagatgagttagaggaagtaccattgtgaaactgtatggacctaaaccagtgaagtttgttgggtgatacatgtaaagagacaaagctgaattattatgtcttcagtatgcattttgtgtatattatgtgttatatatattatttatatttccattataatcattccttctcttttatccaatgacttaatattatgttattatttcatactaactggactgtgtgaaatgaatttgggaacagaggagtctcctgtaagtcttctcagctgtgaaatatccttgaatatcccaaggaattctctgaagattggagtcctggccctctttgttgaatttgatttagcacattagggttagaccaagttacttgtattttatatagctgcccatattattccaatgtacagctctggaccctctggctttttataatcaatttctaatgaactgtcgtatcttcctattagttattagttgcttagctttctggtgtcatttgtgattttcaggtatcatctcttgtttttggtctggtttagtctttattggcattccatagctgccaggccattctgccttgctagaagacaaatattacaatttttttctttttttctacttaaaacctcttagatatcataagaccatagatctcagacttattatactgattggtgagatctgctctcagagtggggcccactgtattttaaacacgtacccccaggtaattctgatatagatggttagaggaactctgctttcgagtgtttctaagccaatttgttattttggttgcaaggatattagaggtgattttattggtatttaccctaccgagtcagtagtgcctaaatcctaacattcagttttcctccttatgaaacccctggcagaggcccatgtgagaaaggaatcttggcttagtaggaggctaagagctaatacattattacctgggctggtacttcctgggcattattatctagcaagtataatagacgcaggtctggtcacatgaattagctaatattttatttgacatttcctagttctacttcctgtcccaaatcgtcttttaatttttaatttgtttttttttcaggcttattgaagtataattaacaagtaaaaattgtgatattttgatgtgcatatacattgtgaaatgagtgtatcattaacatattcatcaagctaattaacatattcatcagctcacatagttaatttcgtgtgtgatgagaacatttaaggtctactctactagtgaattataagtacacaatatgttattgttaactatactcactatgctatacatttggtctccagaatttattcatcttataacagaaagtttctactctttgacaaacctctccccatttgccccactccccccagtccctgataaccagccttctactctgtttttgtgtgtttgactttttgagatgccacatatatatgagatcatgcagaatttgtctgtgtctgacttatttcacttagcataatgtcttccagattcatccatgttattgcaaataataagatttccttttttaaggctgaataatactttatcatgtgtgcgtgtgtaaaatcacattttctttatccatttatccatcaacagacactgggtttttttttccatattttggctattgtgtataatgctgcaatgaacatggaaaatactgattccacatagtgattttatttcctttggatatattcccagaagtagattgctggatcatgtggtagttctagtttaatttttgaggaacctctatgttgttttctattatggaatgtaccgcggcacaataaagtccacatatgacaagcccacagctaacatcatactaacggtgaaaaattgaaaacattacctttaagatcagggataagacacagatactcttgccacttatcaacatagtactggagtcctagcctaataattagacaagaaaaagaagtaaaaggcatccagacgggaagggaagaaggtaaactattcctgttgtagatgacatgacctgattaaagaaaatgctaaagcatgcaccaaaatttgttagaactaataaataaattcagcaaacttgcaggatcaactttactgagtggacaacgtacaaaaatcagctgtattttacacactaacagtgaactacctgaaaaattaagaaaacaatcccatttccaataacatcaaaaagaataaaatactttgtaatatatttaactgaggaagtgaaagatatgcacactgaaaactgtaatacattggtgaaagaaattgaagaagacacaaataaatggaaagatacctcgtgttcatggattggtagaatattgtagaaatgtccgtactagctatcccagatctaaatatgtaataaacatttcaagtattcagggaaataatacaatgccacttctttagaggagatcacctaatatttacaagtagaagagctaagataaaacagaaaagagtaccttctcaccttttcatcactgatgctgtctgcagtgaatatattgttagtggtgaagaccaaactatattaaagtttaagggatgcaaataagcatgagaatgagcatgggaaaccagccccaaaattcagtcttcaagattcattaaaagttaaaaccacaaaaggcagaaaaagaattgaagacaaacgttggaagaaagtacaaaggcaaaaaatagaaaaaaagtagcaaatattgtagatattagtcaatatttgttacttttgaatgtcagtggtttaagtacatcagttaatcactttgaatgtcagtggtttacatgcatctactaaaagacagaaattgctgggcatggcggctcacacctgtaatctcactgctgtcaggccctggtgtgtgatgttcccctccctgtgcccctatgttctcattgttcaacccccacttacgagagagaacatgtggtgtttggttttctgttcctgtgttagtttgctgagaatgatggtttacagcttcatccatgtccctgcaaaggacattaactcatccttttgtatggctgcatagtaatccatggtgtatatattccacattttctttatccagtctatcattgatgggcatttgggttggttccaagtctttgctgttgtgaatagtgctgcagtaaacataagtgtgcatatgtctttacagtagaatgatttatatcctttgggtatataccaagtaatgggattgctaggtcaaatggcatttctagttctagatccttgaggaatctccacactgtctttcacaatggttggacaaatttacattcccaccggcagtgtaaaagcattcctatttctccacatctgctccagcatctgttgtttcccgactttttaatgattgccattcttactggcgtgagatggtatctctttgtggttttgatttgcatttctctaatgaccggtgatgatgagcttgttttcataagttttttggccacataaatgccttcttttgaaaagtgcccgttcatatcctttgcccactttttgatggggttgtttgtttttttcttgtaaatttaagttctttgtagattctggatattagccctttgtcagatggatagattgcaaaaattttctcccattctgtaggttgcctgttcaccctgatgatagtttcttttgctgtgcagaagctctttagtttaattagatcccatttgtgaattttggcttttgttgccattgtttttggtgttttagtcatgaagtctttgctcatgcctatgtcctgaatcatattgcctaggttttcttctagtgtttttatggttttaggtcttacatttaaatctttaatccatcttgagttaatttttgtataaggtgtaaggaagaggtccagtttcagttttctgcatatagctagctagttttctcaacaccatttattaaataggaaatcctttccccattggttgtttttgtgaggtttgtcaaagatcagatggttgtagatgtgtggtgttgtttctgaggcctctgttgtgttccattggcttatatatctgttttggtaccagtatcttgctgttttggttactgcagccttgtagtataatttgaagtcaggtaacatgatgccttcagctttgttgtttttgcttaggattatcttggctatatgggctcttttgtggtttcatatgaaatttaaagtagattttcaaattctatgaagaaagtcaatggtagcttgatgggaatacattgaatctgtaaattactttggacagtatggccattttcatgatattgattcttcctatccatgaacacggaatgtttttccatttgtttgtgtcctctcttatttccttgagcagtcatttgtttttctccttgaagaggtcctccacatcgcttgtaagttgtattcctagatattttattctccttgtagcaattgtgaatgggagttcaatcatgatttggctctctgtttgtctattattggtgtataggaatgcttgtgatttttgcacattgattttgtatcctgagactttgctgaagttgcttaccagcttaaggagtttttggactgagatgatggggttttctaaatatacaatcatgtcatctgcaaacagagacaatttgacttcctctcttcctatttgaatagtctttatttctttctcttgcctgattgccctggctagaacttccaatactgtgttgaataggagtggggagagagggcttccttgtcttgtgtcggtttttaaagggaatgcttgcagcttttgcccattcgatatgatattggctatgggtttgtcataaatagttcttattattttgagagatgtgccatcagtacctagtttattgagtgtttttatcatgaagagktgttgaattttatcgaaggccttttccacatctattgagataatcatgtggtttttgtcattcrttctacttatgtgatggattatgtttattgatttgcatatgttgaaccagccttgcatcccagggatgaagccaacttgatcatgatggataacttttttgatgtgctgctggatttggtttgccagtattttattgaggatttttgcattgatgttcatcagggatattggcctgaaattttctttttttgttgtgaagagtcattttttagaaaatattttgacctcattgaaaatgaaaatagatcatgttaaaaattttgggatgctgtaaaagcagcgctttgagggaaattcatattattgaatgcatatatattagaaaagaagaaagatctaaaatcagctatctaagcatcttcattaggaaactataaaaaggagaggaaattaaatccaaagtaaggagaacaaaagaaataataaaaattagggcagaattcagtgaaattgaaaacaggaaatcagtagagaaagtcagtaacaccaaaagctggttcttagcaaagatcgatatttttgataagcctctaaccaggctaagaaaaaaagagagatgacacaaattagtaatattaaaaatgagagagaamaattcactgtggatggcatgggcactaaaaggacaataaaagaatattatgagcccctctgtgcccacaagtttgacaaccaagatgaaatagaccaattttttccaaggtgtaaatctgtcaaaactttacaagaatcggcaatctgaataggcctatatctagtagagaaattgaatcaatatttaacaaccagctgggcacagcagctcatgcctgtaaactcagcactttgggaggccaagatgggcagatcacttgaagccaggagtttattgccagcctggccaatatggtaaaaccccaattctctaaaaatacaaaaaaaaaaaaaaaaaattaacaaccttcaaaaagagagaacaacacagggccaggtggatttactggtgaattctgcccaacacttaaggaagaaagtgtaccaatcctctcctatctcttccagaatataaaagcaaagataataaatacttcgtgttccattctatgaggccaccagaactctaacaccaaaatcagacaaaaatgttacaagaaaagtaaactatagattaatatctctcatgaacataaatgcaaaaacaaatatatatcaatatgtatattgatatatacaaatatatatcagtaaaatattaacaaatcgagtccaacaacatataaaaggaattatatacagagaccaggtgggatttatcccaggtatagaaggctggttcaacattcaaaagtcaatgaatatagtccatcacatctgcaggctaaagaagaaaaataacatgattatatcagtagatgcagaaaaaagcatttgacaaaaatcatccatttatgagaaaaactctaagtatactaggagtagagcagaattttctcaacttgaaaaaaaatacctacaaaacacctagagctaacattatatttaatagtgagaaactaaaaaactttcctgctaagattaggaactagacaatgatatcctttcttacagttattttctagctaatgcagtaggataagaaaaataaatgaacaatacacagatttggaaggaagaagtaaaagtctttgatcacaatgacatccttgtctatgtataactgttcaaaaatagagtaaaaaacctctgaaaattgataagcaattatagcaaggtttcagaatacaagcttattatacaaaagtcattcattttcctatataacagcaatgagcaagtagaattggaaattaaaaacatattaaaattcatttctgttaacacccctaaaaatgaaatacttaggtataaacctaataaaatctgaagtctgtatgaggaaaactacaaaactgtgatcaaagttttgaaataattaataaatggtaagatattctacattcatggataagaagatgtcagttcttccctacttaatctaaagattcaatgaaatttcaatccaaatttcagcaagttaatttgtgtatatcaacaaattgattctaaagtttatatggaaagacaaaagacacaaaatggccaacttaatatttaagggaaataacaaagttggaggagtgacattagttgacttcaagacttactataaagcttcagtaatcaagactgtgtggtactggcaaaagaatagacaaagagatcagtggaacagaacagaaagcccagaaatagacccacataaatatactcaactgaaccttgcaaaggagcaaaagcaatacattagagaaaatacagtcttttcaacaatagtactggaataactggacatccccctgccaaaaaaaaaaaaaaaaatctgaagaagtaccttacacccttcacaagaattaactcaaaatgaattgcagacctaaatgtaaaatgcaaaagcaaaactcctaaatgacaacacagaatatctaggtaagcttaggtatggcaatgactttttattttttatttttgagacggagtcttgctctgtcgcccaggctggagtgccgtggcacaatctcggctcactgcaacctgtgcctcccaagttcaagcaattctcctgcctcagcctcctgagtagctgggattataggagtgtgccaccgtgcctggctaatttttttgtattttcagtagagacggagtttcaccgtattggccatgctgatctcgaactcctgaccttgttatctgcccgtctgagcccccaaagtgctgggattacaggcatgagccaccgcgtccggctggcaatgattttttagaaacaacaccaaaggcataatctatgaaagaaataattgataagctgcacttcttttaaatcaaaaacttgtgttttgtgataagtagtgttaacggaatgagaagagaagctatagactaggacaaatatttaaaacagataaaactaataaaggactgttatttaaagtatacgaaaagctcttaaaacctaaataataagaaaactataacttgattttaaaatgctcaaaagacctgatcatacgtttcaccaaagaagatatacagaaaacaagtaagcatatgagaagttgtttaatatcatgttatgagagaattgctatttaaaacaataatgagataccactatatacctgttacaatagctaaaattcaaaacactgacaacaaatgctgacaaggatgtagagcaataaggtgtctcattcattgctagtgggaatgcaaaatggtacagccactctgggggacagactgacagttctttaatgaaaataaacacactctcatgatctgacccagctgaaaacttttgtccacacaaaaacttacrcatagatgtttatagcagttttatttataactactccagtttggaagccaccaggatgtcctacactgggtgaatgtaaaaagtgtggtagatccagacattggaatattattcagtgctaaaaagaaatgagctgtcaagccatggaagacatggaagaatgcatatcagtaaatgaaggaagctaatgtgaaaagcctacatactttataattcctattatctgactttcttgcaaatgcaaaactatggagacagtaaaaagatcattgtttgccggggatttggtgggagggagggatgactaagtggagcacagaggatttttttagggcaatgaaaccattctgtatgatactataatggtggatacatgtcatccatcatacatttgtcaaaacccrtagaatgtgcaataccaagagtgaatgcttatgtcagctgtgggctttgaacaataatgatgtgtctttaaaggtttttttttttttctgtaatatgtgaaccactatcatgtaagatgttgatgggttgatggggggagactgtgcatgtgtgcagacaggatctatagagaagctctccaaatttcccacttaattttgttctgaacataaaaaaactctacaaaaggaaagtttattaatttccaaaacaggtaggagaagggtaatgttactgtaggaagctttgcttatttataagtttgtttttattttttacattaataaaggaagtgataatgtcagcacatagtactgagaatctttttttttttttttttttttttttttttgagactgtgtctcactctgtcaccaggctagaatgcagtagcacaatcttggctcactgcaacctccacctcccaggttcaagcaattctcctgcctcaccttcctgagtagctgggactacaggtgcgtgccaccacgtggggctaatttttgtatttttagtagagacggggtttcaccatgttggccaggrtggtctccatctcttgacctcgtgatccacccgccttggctttccacagtgctgggattacagaagtgagccactgcgcctggcctgaaaatcattctgatgagaagcataatctcttaaaatcccttaataagagaatgctaaataattccaggtaaattgttattttgatatgtaatctattctatgtttacattaagttaatattttacagtaaagatccatgcattcttctttctaatttatattataaggctttcaaagttgagtgaattgtgtcaaatttttaacccatttacagcttccgttttgtcccatatgttataaatcaaggcaaataaaaattcttatttaaaccttcctctcctcactatgtacgctcaagtttttgtcctcattttgtttctttttaattctggagcaacctttcactttatctgagaactaaaattctgtccyttttcttgaaaaataaacatttatcctattacatcacctacatagttacactttttcttaaaactgtccctgctaaaatagactcagttacccatattaccattgttaattaacttgtatttaaccttctctggtggataggaacttgataataatgcctatcatgcacaagcaatttaggtgactaggaaatatcattctctacagccacacccttttttttttttttttttttctttgaggcagagacagtctcactctgtcctccaggctggagtgcagtggcactatctcagctcactgcaaccttcacctcctgggttcaaaccgattctcctgcctcagcctcccaagtagctgagactacaggcacctgccaccatatccggctaatttttttatttttaatagaggtagagtttcaccatattggccaggctggtctcgaactcctgacctcaaatgattcactcacctcagcctcccaaaatgctgggattacacgcatgagccactgcgcgcccagcctcacatacattatatttatgtcttcaagtgacaagaatgagcacattcattaacatgatataaaatcatggtaacatcgtaacattttaaggtaagaagtagagttgtatattgtaagcgctatgcttgctattcaagatcttgaagttaagtacacaagaatcttagaaatcacatttcagaggacactaaaaaatgtaattattgatataaaacattgttagaatcatgattcagttcagtcaaacagttttacttttttatcattttaagctttaggtatggatatcattagcttatctgatcaatacactattatcagaattttaagaagttcaggttaactagtattttctgaaaacagaaackcaacatccctacaaaattatggagaaaacacagctatgtatttcagacaaaatttttaaatcagtctgatttgtccaaagaatcagtttttagctttaaatttttaaacagtttttaattgataccttatattggtacatatttatgtggtacatgtgatattttcttacatgcatcgaatgaggagaattgttgttagttcttgcttgaaagtttggtagaatttggcattgaagccatccagtcctggacatttctttgttgggagactttattactgagtcaatctcattacttattattgatctgttccagttttttatttcttcctgattcactctcagtaggctatatatgtgtatctagaaatttatccatttcctccaactttccagttcattaagatttagttgcttataatagtctttgatgaacttttgtatttctgtagtattagttgtaatgtctgttttctgtttctgtttctgattttgtttattttgatcttatccttttcttggttgcttttttagtgtccattttgtttaattctagtttttattatatgtttccttctactcatttttagttgtggtttttttctttgtatttttttttatgtagagtttatgggtatcaactttcctcttagcactgcatttgctatctaccataggttttggtaagttgtgtttccattttcatttgtttcaataaatttttatatttgctgcttaatttcatcattgatccagtgtttgttcaggagcatagttttaaattttcttgtatttgtacattttttaaaaagtttctcttgttactggtttttagttatattccattgtggtctgagaagatagttgatgtgatttcattttttaaaaatttgttgaggcttgtcttgtggcttaacacatagtctacaaagattcacttttattgcatgaatttagattcgtaaattaaaatctttctaagctgctagcagatcctttaagaagaattttttccctaaattactagtacatttgaagttttctttagatattactatagattcatgaacttcttatactatgtaaaccaattatatcttagctccttaaaattcagagacttctaaattttatttattaatactcttcttaggaaaatacttcatacagaatgagagagaatgacttctgagttatagcaacacagagaaaattgtagctttaattataacaatctctgcaacagattaagtaatcaaggaaacaccaaaatacactgttcaagatttcaaaggattattttcccttctagtagttataaaatgttttatgaaattatttggatacacaaatagagaaacaaagaatttaaaaaatgcaactctcattccttgtcatgtctcatatgaaggacaagaaatccctttaatcttaacagaggtctttaaagttcagattataaaattacattcccaattattaatgcatgcatggggattatcattatcatcattatcatcttctagtggaaactatatccagaaccaaaatggtgaagaactagaaaagaaaatgaaaaattcaaaatttaaagaaaaaagccaacttgtagtagactagcatcacagcaaaggtacagttctattgccttttttttctttttttctttttttttttttttttttgagacagagtcttgctctttcccccatgtaggagtatagtggcaggatcatggcttacttcagtcttgacctcccagtttcaagaaatccctccacttcagcctcccaagtagctggacaaaaaacacagcacatgccggcacacctggctaatttctgtattttttgtagagatgaggtctcgctatgttgcctatgctgatcttgaactcctgggctcaaacaattctcccaccttggcctcccaaagtgctcgattgtaggcatgagccactgcaccaggactctattgctatttgagaatcactttgaggagaaagaaaagtctctcctcctaaacagctcctgaagtacatttctgtgctatcacagtttggttggctttatgaacccactttagtgtctcagtggatcctccaaaagtataacatgttaaaattcaaagaatttaaatggtgacttttgtaaatataaaaagaaaatatatcaaatattttattccacttcctaattaagtagaggactagtgagattataaatacagttcaaagtgcattttaggaactagtttcttaaagacaagttaatgaattttatcttagaataatatagctaagttacatacaatctatttaatattttacatgacaataaagcattattttggggattatcttttttaatagttgaaaatattagaattttccaggttaaaaatctacaaattaataaagaacttcactatgcctagtgtcacaagattcttgggatattgtttttctggctggtgatgtctttgcccaagtcttgcttaggcccgctgggtttgttctgcctacctggcctggcaggctttacttggctgacactactggcctggatcccatacctgccaagggtaagtcaggcatggagtggcaaggggtgtgtgagggagcatggggttcagccagtgtgcaatcggacatgccggctgctgcaatggggcgggcagttacaggtgctggcacaggcactgactctctgtgaggctgtggccagaccaggtgcactgcaggaagcttccccagctggcaccgggaaatgcagtggcacctggaagcttggagatactaggcaccacaggaccccaaagagggagtcacagccctggctcagggagctcccaggtctgggctgcctgagaaggcacagatcttatctccttctctttgccctcaatgtggcaagcagggggcatgtttcagtcctgtgttatagctcttttagctctgccatttggtaggtcccgagttcttgtcctgcaactaggaagcatgaggtacagagccaagtggaggatgagcgagatgaaggggagctttattgatcaatagaacagcacacaggagacctgcagagggtagctcctttccacagccaggatgttccaatgagagttcagctcctagcagaaaggagaccctggagagggaagctcctcctagcaggcaggtcatctcattgtcttcttagctctcagcagagaggtggccctggagtggattgttccactctgcagctggtagtctcgatgtctctgcaggtttctgaagctctcagcagagaagaggccctagaatggatagcttctctcttctgctggttgttgggacatcttctgctgtcagcagaaagggtagctcttctctgcagctggtcatccatcatctgctctgctctggctgagcctggggcttttataggcctattagaggggaagtgcatgctgatcagtccatgggcagccatgggcagatccaggaaaaaccaccacgagtttgccctccaaatcagcactgccagtcctgtccccaggcttcaggccttctctcagggatctgccctcttctgcccaagtatctgtctgcctccccctgctgttcatggcacatgggcttgaccccgatttgctccaagatgggagcaggtgcccacagcagggagaagccaagcagcgggagcaggcacttctgagcctgcaggggcaggggggccttctcagctccccctctccccccccagagtgcagggatacctgggtctgcagccgcaatatgggctgctcccttgaccctagggaagtggagctcctggtcccccaaaagtaaagggaagctccattctgcagccacagctcgggcacctgcagcccttcccaggagggttaggctcctgcctcctccaaggaggcagaggcccaggtctgcagctgcaatttgggcagctgcagctgcacccggggagttcccaccccacctcagaaggagaagggcttacgcttgtcccctgctgcctggagctccatggagcatgtatcctcggcagcacctccctgctgcagtcggcgtgatggcagcggcaggccgtctggagtggctgctgctataactaggatctttaatcagtagtaaacagtgaatcaaataagtaaatttcccttaattatccttatgtggatctgttaatgcattcatatgacattgaaagaatatgttgccctacttttgaccttatttccaagctttgaataacttttcttaacatttgggatcaaaatgtgatttatgccactcttacccaggggtgcttatggtaacactcaaattttctttgaagggaaaagtcaatacgataaagttgtcagttctccccaagggaatctttaaaatcaatatgatttcattaaaactccaacaaatattttcatattacttggtaaataaacccaaaactaattaggaagagcaaaggatcaagaatgactcagacaaatttgaagaaaatgaaccattttaggagaattgccctatgaaatgcaaaaactagttataaagctttattagctaagacaatgtagcattgatgcaaggataaacaaagagataaatagaacctatagggaacctacaaacatgatgatgcacatttgaaaacttgacatatattgcactacttaactctgggggggaaatggactctattaaatgttgtttggccagttgtttatacatttgaaaaaaaataaaattagattgccaacacatattataattttagaaaatttccaggtggataactgcctraatacagaaaatcagaatgttaatgcattttgaagaaaacataggcccaaggcagtggctcacagctgtgatcctagcactttgggatgccaaggcaggaggatcacttgagacgaggagtttgagagcagcctaggcaacatagtgagaccccatcccccacctccccaaaaaaggaagaaaatatagaatctttttataaactttgggcagaaaagtacttcttaaacaaaacacaaaaaaatacctacttacaaatgtggatatactttagaaaattattttcctctaaaccaccatgtttcaaagatatataaaaagacaagctacagatagggtgaaagtatttgcaatatgtttaaggaaatattaatatccaagatatataaagatatctcatttaagttaataagaaaagtcactcaacccaacaacaacagtgtaacaaatgggtaaaagaaatgatttgacaatttgtggaagtagacaggtgacttacaaacatatgaaaaaatgtttaccygcactagtaatcagtgaaatgcaattgaaatcacattgtaatatctttttacagctgtatgattggcagtacttaaaggatctgagcataccaagtattcctgagggcatggagatttgttaatgtctaataaaattgaaaatgcttataatcttttctttgactcaggaattttatttctgggtatatatcctggagaaaactcattcatgtgcataaggaggcatgtatgaagttgactattacagcaatattttattatacctaaattggaaaacaacacaattgtccagctgcaaaataatgaataaatacattttggcatattgataaaagatgatactatatagttgttaaaataaattaggtagaattacagttataatagtcatggttaaatctcaaatgtaatgctgaatgaagcaaactaagttgcaaaaagagaggtatacatcataatttttgaaaataaacgattgtatgtaaattatgcctattcatgcatatatatagatcctgtttcaaaaaatccgtagaaaggtcaaacactttattcttttattattattattagtattatacttcaagttctggggtacatgtgcagaacgtacaggtttgttacataggtatacatgtgccacggttgtttgctatacctgtcaacccatcatttaattagtgtggtgattacctctgtataagcaatgaagagaataaaactagagacaaataataaatgggcttcaacttttctgtaatgtgcttctttagaaaaaatatgactcgggccgaccgtggtggctcacacctgtaatcccagcattttgggaggccgaggcgggaagatcacaaggtcaggagttcaagaccagcctgaccaacatgatgaaaccccatctctactaaaaatacaaaaaaacattagccgggcttggtggtgcatgcctgtaatcccagctattcaggaggctgaggcaggagaatctcttgaacccgggaggcggaggttgtagtgagccaagatcacaccactgcactccagcctgggtgacagagggagacattgtctcaaaaaaaaaaaaaagaaagaaagaaagaaagaaaaaatgtgactcaaatatagcacaatgctaggattttataaaggtgagtattgggtacatgaaagtttattatctgtttgactacatttctcatgtttgaagtatttcattatgaagaataaaaatgatatatataaaatatatatagaaatgtaaaagtattatacaataaacagtatcaatacatacaatgctcataaacataagtatgaacacacacaaaaacacttgtatgtatatgtaagtatacagatgcacatgaatgagcattacatatttgaagtatacaccttgaatgggaaggattccctgtaattcctggttaagtttttccttagggaagataggtgtgttgtgagactaggtattaggcccaaagcatatttcatctggatctcttatgttttatgtacagttattaaggacaaaaatgatataaatatgtaaatatatcatttgcagttatcaatttttgtgataggaatatgtatgtttggtaaactgaatgtctccatttagtattacttgtttctatcctttaaaacagtctttatttttattttttttttcaacttgtatttttgattcagggggtacatgtgcagatttgttacctgggtatattgtgtgaggctgaggtttgggatatgaatgatcctgtcgcctaggtaccaggcatagtacccaatatttagtttttcagcccttgcttccctctcttcctttcccctctagtagtccccagtttctattgttgccgcctttatgtccatgagttcccaatgtttaacttacacttataagtgagaatgtgcggtatttgattttctgttcctgtgttagtttgcttaggataatggcctccagatgcatccgtgttgctgtaaagggcatgatttcattcttttttatggctacatagtattccacagtgtatatctaccacagtttctttatctcatccaccatttgtggacatttaggttgattccatgtctttgctgttgtgaacagtgctgcagtgaacatgcatgtatcattttggtagaaaggtttgttttcttttgaatatatacccagtaatgggattactggatcacatggtagttctgttttaagttctttgagaaatctttaaactgctttccacagtggctgaactaatttatattcctcccaatagtggataagcattccctcttctccacattcttcccagcatctgtttgttttttttttaactttttagtaatagccattctgactggtgtgagatggtaactcactgcggttttgatttgcatttctctgatgattagtgaagtggagcattgttttatgtttgttggtcatttgtatgtcttcttttgggaaatgtctgtttgtgtcttttgcccagtttttaatggaaatagtctttttaaaacattaagtgtttgactaagatctggggcttctatagtcatccctgggaatccacaggtgattctttgtaagacctcagtggataccaaaatctgccgatgctcaagtctcttacagtatagtatagagatagtatttgcatataacctgtgcacatctttcaaatagtttaaatcgtctctggattacttctaatatgtaatacaatgcaaatgctgtgtagttaagttttttactttgtactttttattgtattactttttttattttttcaaaatattttatatccacaattggttgaatccacaaatgtggaacccactgataacaggaagcagaactgactgtatgtaaaagatagattttggatcaaaaagagtatcttaaaaatcacatattttgtcaactgatttgttggaaatgattattacataaattaattttttatgtaatttatgtgggtaattttttcctctttctaaagaatacaagtcaatgaccagattgtggaagtggatggaatcagcttggtgggtgtgacacagaattttgcagcaacagttctcagaaacaccaagggcaacgtcaggtaaatacgtgccttctaatatacaccatgttgttactttagttgaattttaattttctatagtttaacctgcaaataaatgtaattacaatgacaattttacctgaatagtaaaactttgcttttagttttaaatattttcacctttattwtaattagttcatgaaaatagaatttaaaattacaaatcatagtattttagaaagatacaaaaacaagcacttgtcttcatatctttctaaaatactatggtttccaggaagatataatttctagttaaaacctcaataaatatgaattaggtcccaaatctttttaaggaaaacagttatacaatacttgaaatgattatacatatattcaattttctgtgttttttagacaatcaggttgaataaagataagtatattttttaaatgtatacattcttttaaggaatcagccatgaccaatgtttgatgaattataacttttccaacttaatgcacttagggtgcattttttttggaccttgaaatttatattcaaacttgggattgtgaatattgtatattggaaaacaagtaagaagcagtttagagctagttgaagtcaaggtttgaaatcaggtcttttttttgcttataggttacttatttatcttcagtattgcttatatcatatacttttccatacatcttgtgtaagaaacattaaggaaacattatttagtatgtgtaatgatgaaaatggttgggtgttctcattatcaaaatgaaactgctaaatattctgaaaatattaatgagttaacattgctatacaggcagtaacattaggatattattgcagtatgtctaattttgctgaagcatgatttaagttttagactttaggctttttcaactgtaaatcatcttctaatgctaaagggatgccttaaggaatattacctaaactacttctgtgggcgctatgttgatgtttctagaatatccacagtcctgagaaaagaatgtaaaataattgcaaaactgtgtggtgctctctgagttgtgtgggtgggcccattcagtaaatgtgattgtctttttgaagatcactatgtgttcttaagacagcactttcccatgtctgtatagaacttggttttgaagctgtccattagactttaaagtaaattttaaaatgaaataggtaagatatacattcaactcataagaacatttctcagttggaaaagaatttgtagttacatgaaaccatagccatcccttttttcccctctgttgactgcgtaatcttgtgttattattttcagccttgtacaaatttcaaaagtcttcaaatgtcttcttaactggtctgtctgttttcacattctcacttcctcagtctgctctgttcatcattactctcatggaaggacataattacagtttttaagtaaatgaagggctatcatggaaaaagaaattgaccttattctgcttaactctagtacaggttgagtatcccttatgttaaatgcttgcaaccagaagtgtttccgatttcagattgttttggcatattaaaatatttgcattatatacttagtagttgagcctccctaatgtgaaaattcgaaatctgaaatgctctaatgaatatttcctttgggtgtcatgtcagtgctcaaaaagttctgagtgttctgaacattttggatttcagatattttgatgtgggatgctcaacctgtataaacttccatgtgcaggggttttttttgttttgttttgttttttgtagttgttattttttgagacagagtcttgctctgtcacccaggctggagtgcagtggcgcagtctcaactcattgcaatctctgcctcctgggttcaagcagttctcctgcctcagcctcgcaagtagctggattacaggcatccaccaccacatccagctaattttgtatttttagtagagacagggttttgccctgttggccaggctggtcttgaactcctgacctcaggtaatccacccaccttagcctcccaaagtgctaggatcacaggtgtgagccactgcgcctggccccatgtgcaggtttttgtgtggacataagttttctactgggtaaataccaagcatggagcataattgctatatcatgtggtaagtgtatgtttagttttgcaagaaaccaccaacccatcttcaaactggctataccattttgtattcctatcagcaatgagtgagagttcctattgctccacatccttgccagcatttgttgtcagtgttttggattttgaccattcaaataggtgtatagtggaatctgattgctttaatttccatttacctccattgtccattaatatttacaactggtaatgaaaagtttcatgttaatatgatttgtaatcctttatagtattttctttttttacctcttttggatttttttctcttataattgggcttttgtaatttttatcagactgtaactagatctgtgtttgtttatttggttttgtgaaattctgcttgggattcaatctgaagacttggatttcagaaagtttctattatgctttggttatttgctttatttcttctgcattgtctttggcctctcttctcaaaccagtattaaatggggcttagatttcctgggcatatcctctagaatcttattttctctcaggatctccatctgtttgaatttttgctagtataagagtttctttaattttctcttccagattaccatggttttttttcttttcttttcttttttttttttttttttttcaggcatggcctattttaactgttccatgctttattctctattttctgtttttatttctagctccattctctcttcctagagcttaagaatagtatatccagcttcctacttgacatcttcatatggcattctaaaaggaacatcaaatttaatatactccaagtattatcctttatttgtgccattccctgtcttctgccccactttcctgctttgcccccttcccccaaaaaactccatgtcacatgacatacaattggctgcttctaccttatcaagtctcagttcaaatatcaattcttcaatgaatgagcttttctcatatttatgttgtccaaactcaaattcactctatctcaattaccatgttttctacatagcattcatttactgatcctcttctgatcctctccacctggttattgactttcttttgggttttctactgtattgattcctgtctagtctgtatgataatttgaatatgaaagtaatgatctgtgactttttaggctaggttataaaaggcactgtggctttcatcctgctcttttggatcaccagttttagggaaatgtagctgccatatcaggaggctttcaaatacccttttgaagatgcccacacagggaagacgttgggcctaccagcagccagcactaacttaaccagacatgtggggaggcacctttgaagatcttccagccttactaaagcattcagatacctgcagcttcagctaacaactggttgaattttgtgagaatcaccaagccacaattgaacagacaagccttccttgaattcttgactcacagaaactatggaagatagtaactgtttataagttttggggtaatttgtatcagcagctacaacttacacatattttggtacctgaatgtgggctccagtttaacaaaaactgaaaatgtgggagtagctttgggactggactgttagtgaggctggaaggactatgaggagagtattagtaaaagccaaagagatcttacagtgattgctgggagaaaactgatggtctgtgaggaggaagctggtgagggcttaaagaagaaaactataaatgttattgaaaattgggtcaggcgcagtggctcatgcctggaatcccatcattttgggaagctgaggcaggtggatcatctgaggtcaggaattcgagaccagcctggccaacatagtaaaaccccgtctctactaaaaatatacaaaattagccaggtgtggtggcacatgcctgtaatcccagctacttgggaggctgaggcaggagaatcacttgaacctgggaggcagaggttgcagtgagccgagatgcaccattgcactccagcctgggcaacaagagtgaaactccatttcaaaaaaaaaaaaaaaaaagaaagaaaattagaagaaagagtatcttcattatgtaataacagaacatttaacaaaacttacctctagtaatatggaaagtagaatattgactgggacatttaactcataagatttctagccattgttgaaagtgtcactagctgctttttgctgtgtataagtaaaatttatgagaagatagataagctaaaggaagaactgttaaaaataaagcaagttaaacaaactagaaaacttagacaaactggataaatttctggatacatatatgtagcctaccaagattgaatcaggaagaaatagaaaactggaacagaccaataatgagtaacaagattgaatcagtaataaaaattctcccaacaaagaaaagtccaggactggatggcttaaatgccaaattctagcaaactttcaaacaagaactaacaccagttctcctcaaactattccaaaaaattgaagcagaggaacttctccctgattctttctatgaggcaagcattaccctgataccaaaaggagataaggacagaaccaaaaggaaaactgcagrccaatattcccaatgaacacagaggcaaaatttctcagcgaaatactagcaaaccaagtccaacagtacattaaaaagataatacaccatgattaagtgggatttatcccagggatacaagaatggctcaacatatgcaaatcaataaaatatgctacatcacatcaacagaatgaaggacaaaaaccatatgatcatctcagtagatgcagaaaaaacatttgataaaattcagtatcccttcatgatgaaaaccctcaacaaaacacgcatagaaggaaaaaacctgtattagtccattttcatgctgctgctgaagacatacctgagactgggcattttacaaaagaaagagatttagtcaacttacagttccatgtggctgggggaggcctcacaatcatggtggaaggcaaggaggagcaagtcacatcttacatcttacatggatgacagcaggcaaagagagagtgcttatgtagggaaactcccatttttaaaaccrtcttatctcgtgagacccattcactatcacaagaacagcacaggaaagacctgtccccataattcaatcacttcccaccaggttcctcccatgacatgtgggaattgtgggcgtaacaattgaagatgagatttgggtrgggacacagccaaaccatatcaatacctcaacataataaaggccacatatgacaaactcacagctaacattgtattgagtggggaaaagctgaaagccttttctctaagagctggaacaagacaagaatgcccactttcaccattcctattcaacatagtactggaagtcctagccagagtaatcaggcaagagaaagaaataaaaggcatctgaataagaaaagagaatgtcaaacggtccctcttttcagatgatgtgatcttatagctagaaaaatttgaagactccacgagaaaactcttagatctgataaaacaaattcagtaaagttagtcacaggttacaaaatcagcatacagaaaataagtgctgtttctatacaaaaataatgaactagctgagaaagaacacaagaagacaaccaaatttacaatagttaaaaaaaaaatacctaggaataagtttaaccaaggagatgaaagaccttcacaaggaaaactacaaacactgatgaaaaaaattgaagaggacacaaacaaaacaaagagcccatgctcatggattaggagaattaacgttgttaaaatgaccacactccccagagcagtctactgattsagtacaatccctgtctaaatatcaatgtcatttttcacagaaatagaaaaaagatcctaaaatgtgtaagaaaccaagtacggctcaaataccaaagtgattctgtgcaaaaagaacaaagttggaggcatcacattacctgacttcaaaatgtatcacaaggctttagtaaccagaacagcaagatattggtataaaaacagaaacacagaccaataaaacagaatggaggacccagaaacaaattcacacctttatggccaactgatttttgacaaagacaccaagaacatacattggggaaagggcaccctcttcaataaatcatgctgggaaaattgcttatctatttgcaggagaatgaaactggacccttatccctcactatatataaaaatcaactcaatatggattaaagactgaaatgtaagccccacatctgcaaaacaactagaaggaagcatagaggaaacacttcaggacattggtctaggcaaatactttatggctaagacctcagaagcacaggcaatgaaaaaaaaaaaggataagtgggactatattaatctaaaagacttctgcacagcaaaggaaacaacagagtgaagagacagcctgttgaatgggagaaaatatttataaactatttgttcaacaagattctaatatctagaatattaaaggaactcaaagcaacagtaaaaaagcaaaaatagtctcattaaaaagtcggcaaaggatatgaatagacatttctcaaaataagacatagaaatgactgatatatgtgaagatgctcaacatcagtaatcatcagagaaatgcaaaataaaactgtactaagatatccrcttaccccaattagaatggctgttattaaagagacaaaaggtaacagacgctgacaaggatgtggagaaaaaggaactcttacacaccactgctggggatataagttaatacagtcattagggaaaacagtaaggagacttctcaaaaaactaaaaatagaactaccaaatgatccagcagtcctgctactaagtgtttatttaaagaaaagaaatcagtatatcaaagagatggcagcatctcagtgtttattgcagcactattcacaatagcagtgatatggaatcaacctacctaagtgtccatcaaaggatgaatggatttttttaagtggtatatatacacggtgaaatactattttgccataaaaaaggtgaatcatgtcatttgtagcaacgtggatgggaactggaggtcattatgttaactgaaataagccagacacagagagacaactatgacatgttttcagtcctatataggagctaaaaatgttgatcttatagaggtagagagtagaatgatagttaccagaggctgggaagagtgtaggggtgtgggtgggcggatgaagagaggttgcttaaaatgtacaaaaatacagtccctagaagaaataagatttaatgttcagtagcagaaagttaataacaatgtatgtatattacaaaatagctagaacagagcacttgaaatgttcccagcacgtagaaatgataaatagtagaggtaatgaagactccagataccctgatttggtcattatacagtatagcatgtaagaaaatgtcacttttatcccataaatatgtacaaatgtttatatcaattaaaaaatttaaaaattaatagaacttaccctcaaactaaatgtagctctgatcccacattcaaaagccttaaaagcaagcctcagaaagatttgttttttagtactttaattgtcccagaggaatactcaagaatacttattgtattacaaaaaatatctttatatctggcatgcagtcaacaatttctgggcatgcaaagaatgaggaaaatatgagccacaatcagtggaaaaattaattgaaacagatccagcaatgttagaaataaaagcagtagatgaaaacattaaaatagttgttataattagatttcaaaaatacaataaggtagcaaaagggctgagtatgataagtagatacagaaaagataaaaagaaggttctactccaacttctaaaatgaaacatatgtgttatgaaatgtacattggatgggataacagattcaaatatgcagaagaaaaaattagttaattttaagacatactacaatagaaagtatcaaaatttaaacacagaaataaaagacaggaaaggatgaacagaacttcaagaggctgtggcataattataagctactaatatacgcttttggaatctcagaaggttagaatgagagaggtgctagaaaagataactgaagagataatggctgaaaatttttcaaatttgatgaaatttttaagatttataatatcacagatccaagacattcaagaaatcccaaatagaaggaatatgatgaaaactacatgaagagacatcataatcaaaatacttgaaatcagtagtaaagaagaaaattataaaagcattctgagaagaaaggcatattgtgtacagtgaaccaaagatgagaatacagtagactttgcagtagaaataatacatcaccaaggaaagtgaataataatttaaaagttttgaaagaaaaattggaattttatactcaaggaaatagctttcaaaattgaagatgaaatgaagaccttctatacagaagctaaaagaattcattacctggagaatactattataagaaatgtcaggggaagtctttaataatgtaaataatataaaacgaaattctagacctacasaaggaaatgaagagaaatagaaattatgtgggtaaatataggctacttcattttttaaaaaattatttaaaggattattaactttttaaaacaaaggacatgactgtgttgtttgagatttataatatcgagaagtaaaatttagaacaatagcatgtcggtttttatgacaacatggaagtatacttttgtaaggtgattatgctgtgcatgaagtagtagtatattacttggagacagactgaaataaattgaagaggtatgctataagacataaataaacactgaagaaaccccagcaaagagttataccaataaagagttatacaacaaggataaaacataattataaaagtactttatccaaaaaatgcaaaaaagaaaaagagcacaggggaacaaaaaatgaagagatgtatagaaaactaacagcacaatggtagctttaaacccaaacttatcaggaatttcttaaatgtaaatggtctaatgaccaatttaaaggcagagattgtcatattatatttttagaaagtaagtctcaaataggttaaaagtaacaggatagaaaaaatgtgtcacgctagcattaatcaaaagagcactagtgtggttatattgatattagacaaaataaattttaaaagtcagttttgaaaacataaagttagtaaatctttagtcagacttgtttgatataaaaagaacaaagacacaagttagaatgagaaggtgtaattacatattccacagatactttaaggattaaccaatattatgaagaactttatgccagtgaatacaacaagttagactaaatggttaaattttatggaagacagtgctatgaaaaattaccaaagttcactcaagaaaaaattgtttatgtgtatacatgaagatgagtttagatttaagatcctcttaaaaagaaaattgtttgtttcactggtgaatcttagcattagatggagaaataataccaactcaacatatactctttcagaacatagaagatggtatacttctcaactacttttatgaagccaatgttgctatgatagtataatttttaaaaggcattaaaatacaaactatcacaaaccaatattcctcatgaatgtaaatacagaagtccaaattggattataaatccaatagccaggtgacatttattgtttgaatgtatggttgatttaatgtttatgaatcaacccatggaatttttcttactgataggattaaggtaaaagtcatttgttcttctcaatagatgtagatttttttaaaaaagctctcaggaaacttgaaatagaagggaatttcctcaatgagataaataggatcttagtgaagcctgcaactaataacattcttaatggtgaaagacctaatgcttttctcttggtattaagaacaatgcaaatatctctaccctcaccacttccattcaagattgtaccagaggccatagctaattcactgagacagtaataactaattgaaagcccatagaatgaaaaggaggaagtaaaactctttattcacaggcaatatggtcatttatacacagatgaccatgaagaaaatcctaaagtatctacaaaagatgctacttgaactgataactgagtccaatcatgttatagaagatgaagttgtccaatcatgttacagaagatgaagttgatgtgcagaaatcagagtgtatatactatcaacattaataattgaaaattcagattgaaaataacattgatgacagcatccaaaatattaaatacttaaaggtaaatctaacaatatattgcagacttccacacttaaaacaacaaaatattgctgacagaacacaaagacaatttaaatgagggaagaagtagaccatgttcaatgtattataatattcaatattgttaagatttcaactttccctaaattagtctgtagattaaacataaccctagtaaaaattttagaagattattttgtagatgttattgttaaaaaaaatttcggaggactttccctgcctgaaagcatcactaatcaaggcaatctggttgaggtataagaatagtaatatagattaatggatcagaatagaactttgcagtgcagacctgcgcagatatgaagaattgatttttttttataaaggtaccaaggtaattccgtggaggaaattatagttaactcaaaaaatggggctgaaaaaattaaatagtctcattgaaaacaaaatacaaaccaaaaaatgccttgaccttcatctcacagtatatataaaaattaacttagaactgatcacaaccctaattgcagcagctagaacactaagatttctagaaaacaggcaaaaatctgtaattttagatttagtgaaataactcaggaatagaaaatcaaataccttatattctcatatataaattggagctagacatgggtatccatggacatacagagggaaacgctgtaggtaatatacactggggactctaaaagaggagaactggaggaggatgaatgttgaaaaattatctgttgggcacaatgttcattgttaaggtgatgagtatgctagaagctcaaaccccactactaygcaatatatccatgtaacaaatctgcatatataccctctaaatgaatgaaaaaaaatttttaatgcaatataacaatttaaaaatttttttagggcacaaaagcaaaaagtgtaagaggaaataatgataaactgcgtcaaaatttaaaacatttgttacaaaatacccttaagaaaatggaaaaacaagccacttaagaaaatggaaaaacaagccacagaatgaatatctgtaaaacaattttctgataaagaactcttgtaattcaataagattattataacaactatataatggagtttttaaatgtgcaagtcctattaaaatgtacaaatcacttaaagagacagttcatcaaagtagatataccattaaacatgaaatgctgcttaacattattagttattaggggcaggtaaattaaatccacaatgaggttctactgtacacctgctaaaaaggctgaaattaaaaagactgataccactatgcattgataagcatatggactgaggttcacatttatttgctgatcggaatgcaaaatagcacaaccactttgcagaacagtctggtagggttttccaaagttaggcatacacttataccagctagcaattccgcacctcggtatttactcaagaacaataaaaacatatatttatataaagactcatatttgcatattcatagcagctttttcataataactaaaaactggaaacaactcaagtgttctttaactgataaatggatatacaaattgtattatatcccatataatgaaatatttcccagtgatatgaaggaacaaactaccaatcctttcaataccatgtatgactctcaaaaccattatactgagtaaaagaagccagatgccaatagcctgtgtactgtttgaatacatttgtataaaattctggaaaatacaaaactgtgctaatagcagatctatgattgctcagaatcacgaagggagggaattgtctgcaaacaagaaggaaggaccatttctgaggtgatgaaaatgttctatattgtgattactgtatttcttacacaactatgtatacatttatcgaaactcctcagattatacaacttaaatttgatcaattttaatgtatatagattgaactcagtaaaactgaattttaaaatgtgagataatagctatcgttaacttaaaaagcaccatacgaattgattattgttgatagtgatagtgatgtgaaaaggactgtgtctctttaacaaaggcagatgtaatcaatgtgaatttcattagcaatctctagattttatggttctgtgtacttttacttttaaaatattattattgactttttaccagaaaatattttctgtacaatttcttgcatctaatttttttatcaaacatgaatttgcaacataatttttgaaaactcatgtttcttgagtctacagctataaacaggaccttgcctgtcttgttgaccactggcatagttggtgtacctattgttgtgtaacatattactataaaattcagtgacctgaaacaactaacttttattacctcatggtttctgtgatccgcttcccagcgaactcatttgggcccctctgccaggcctctcacaacatgaaaactggcttctccaaaaagtcatacaagagagtgcccaagatgcaatctgccatctttttgtaacctaaaatctgaaatgacatcccgtcagctctgtattttatttgataaaagtgagttaatatgtccagcctacatgcaaggatagataattacattcagacttaaataaaaggagtcaaggatcacttgggtctatgttagaggcagcctatcatagtacggatcaataactagttggatggatggatggatggatggatggatggatggatggatgtggagggatggtcagtcaggcagacagatgatgggcaaatagattaatgctataccacaatataatttaatttatgttgcatacccaacttaatcctgaaaaacttgagactatttaggaaagattgaccaggatggtgagaggtataactattttccttctatatataaaagttaaaatattctataaccctttgcctttaaaaaaaaaaaaacttaaaagacatggtaataattataaagcatttgaaaaagtgaactctggaaaaaggattagatttttttttaactccagacaatcattctagtactgtcagcaatttggcaaaatttgatataagacagagattttgtttcaatttgaagaaattttcaatgatttatatgtttgctcttcagtgtcattcacattaaactttaaatgctttcaagaaactatctgctacccatgatcaataactatgcattcatttcacttttatccctagcatatgggtttaataactttgacagggaaccatataacttctgatggtcataattttctaggaattataacaatagaaaataattaatctgagggtcttaaatatttatcttttttggaaaaggttaaaatacataaaagaaaatataggctgggatcatggccgacaggaggcaggactagattgcagctctgacttggacagacagagcaggatgtgtaggctctcatcatgaattttagctccataacgactgcaggaataatcagaaaacccgagaggacccacagaccctctgaaagaagcagatttctcctgcaggacccaggagacaccccaaatattttgctagtatccatggctgagagacccatagatggttcacatcacaggactctgtgcacacaacccccagtaccagcccggagcctggtggatttgctgggtggctagatccagaagagagataacagtaactacaacttcactgttaggaagccatatccacaggaaaagggggagagtactacatcaagggagcacccatggcacaaaagaatctgaacaacagccttcagccttagacctttcctctgacagaggctacccaaatgagaaggaaccagaaaaccaactctggtaatatgacaaaacaaggctgtttaacaccgcccctcccccccagaaaaaaaatcacagtagctcaccaacagtggatccaaaccaagaagaaatccctgatttacctgcaaaagaattcatattagttattaagctaatcaggaaggcaccagagaaaggcaaagcctaatgcaaggaaatccaaaaaaaaaacaatacacgaagtgaagggagaaacattcaatgaaatagatagtataaataaaaaaaccccaaaacttcacaaaacactggacacacttatagaaatgcaaaatgctctgggaaatctcagcaatagaattgaacaagtagaagaaattcagagcttgaagataagatcttcgaattaacccaatccaacaaagacaaagaaaaaagaatatgaaaatatgaacaaagcctccaagaagtctgggattatgttaatccaccaaacctaagaataatcagcgttcctgaggaagaagacaaatctaaacgtttggacaacatatttggggaaataattgaggaaaacttcccaggccttgctagagacctagacatcaaaatacaagaaacagaaagaacacctgggaaattcattgcaaaaagattatcacccaggcgcattgtcatcaggttaactaaagttaagatgaaggaaagaatcttaagagctgtgagacaaaagtaccaggtaacctgtaaggcaaaacctatcagattaatggcagacttctcagcagaaaccctacaagctagaagggattggggcccaatcttgagcctcctcaaacaaaacaatgatcacccaagaattttgtatctagtgaaactaagcatcaaatatgaaggaaagatacagtctttttcagacaaacaaatgccaagagaattcaccactaacaagccaccactacaagaactgctaaaagaagctctaaatcttgaaacaaatcatggaaacgcatcaaaacaaaatgtcattaaagcataaatctcacaggaccaacaaaacaaaaatacaagttaacaaacaaacaaaaaccagggtacacaggcaacaaatagcatgacgtatggaatggtacctcacacatctcaatactaacattgaatgtaaatggcctaaatgctccactttaaagaaacagaacagcagaatgggtaagaattcaccaaccaactatctgctgccttcaagagactcacctaacacataaagactcacataaacttaaagaagcagaaaaaggcatttcatgcaaatggacaccaaaagygaggagtagctattcttayaaaagacaaaactttaaagcaacagcaattaaaaaaaagacaaagagggacattatataatggtaaaaggctttgtccaacaggaaaatatcacaatcctaaacatatttgggagctgcacacctaaaagaggagctcccaaatttataaaacaattactgctagacctaagaaatgagatagacaacaacacagtaatagtgggggacttcagtactccactgacagcactagacaggtcatcaagactgaaagtcaacaaagaaacaatggatttaaactataccttggaacaaatagacttaacagatatatacagaacattccatccaaagccacagaatatacattctattcaacagtgcatggaactttctccaagatagaccatgtgatagaccacaaaatgagcctcaataaatttaagaaaattgaaattatgtcaagcactctttctgaccacagtgtaataaagctggaaatcaactccaatataaaccttcaaaaccatgcaaatacatggaaattaaataacctgctcctgaatgatcattgggtcaaaaatgaaatcaagatgaaaacttaaaaattcttcaaactgaatgacagcagtgacacaacttatcaaaacctcagggatacagcaaatgtggtgctaagaggaaagttcatggccctaaacacctacatcaaaaagactgaaagagcacaaactgatcatctaaggtcacacctcagggaactagagaaacaagaacaaaccaaacccaaacccagaaaaagaagggaaataaccaagatcagagcagaactaaatgaaattgaaagaaaaaaaatacaaaagataaatgaaaagttggttttttgaaaagataaataaaattgatagaccattagcaacattaaccaagaaaagaagagagaaaatccaaataacctcaataagaaacaaaacgggagctattataactgacaccacagaaatacaaaagatcattcaaggctactatgaataactttatgtgcatacactagaaaacctagaagagatggataaattctttgtaagatacaaccctcctagcttaaatcaggaagaattagataccctgaacactccaataacaagtagtgagattgaaatggtaatttaaaaattaccaacaaagaaatgtccaggaccagagagattcacagcagaattctatcagacattcaaagaagaattggtaccaatcctattgacacaattccagatagagaaagagggaaccctccctaaatcattctatgaagccggcatcaccctaatatcaagaccagaaaaggacataaccaaaaaagaaactgaagaccaatatctctaatgaacacagatgccaaaatccttaacaaaatactagttatccaaatccaacagcatatcaaaaagccaatccaccatgatcaagtgggtttcatactagggatgcagggatggcttaacatacataagtgaatagatgtgatacactacataaacagaattaaaaacaaaaattacaagatcatctcaatagatgcagaaaaagcattcaacagacttcagcattcctttataattaaaactcacagtaacattggcatgcaagggacatacctcaatgtagtaaaagccatctatgacaaacccacagccatcataatactcaatggtgaaaagttgaaagcattccctctgagaactggaacaagacaaggatgcccactctcaccactccccttcaacatagtactggaagtcctagccagggcaatcagagaggagaaataaagggcatccaaatccataaagaggaagtcagaagtgtcactgtttgctgatgatatgatcatttacttcaaaaaccctaaagactcctccagaaaactcctagaactgataaaagaattcagcaaagtttctggatacaaaattaatatacacaaatcactatctcttctatataccagtagcaacaaagtggagtatcaaatcaagaactcaaccccttttacaatagctgcaaaaaaaaaaaaaaaaaatacgtaggaatatacctaaccaagaaggggaaagacctctacaaggaaaactacaaaacctgctgaaagaaatcatagatgacacaaacaaatggaaacacgtcccgtgctcattgataggtagaatcaatattgtgaaaatgaccatactgacaaaagcaatctccaaatgcaatgcaattcccatcaaaataccaccatcattcttcacagaattaggaaaaaacaattctaaaattcatatggaaccaaaaaagcctgtatagccaaagcaagactaagcaaaaagaacaaatctggagccatcacattacctgacttcaaactatactataaggccatagtcaccaaaacagcatggtactggtataaaaataggcatatagaccaatggaacagaatagagaacccaggaataaacccaaatacttacagcctactgattttcgacaaagcaaacaaaaccataaaatggggaatggacaccctttttaacaaatggtgctgggatacagattggctagctacctgtaggagaatgaaactggatcctcatctctcaccttatataaaaatcaactcaagatggattaaggactttaagagccaaaagtataagaattctagaaaataacattggaaaaacccttctagacattggcttaggcagttttgggtttcatgaccaagaacccaaaagcaaatgcaataaaaacgaagataaatagctgtgacttaattaaactaaagagattttgcacagccaaagtcacagtcagcagagtaaacagacaacccacagagtgggagaaaatctttgccatctacacatctgacataggactaatatccagaatctacgacaatctcaaacaaatcagcaagaaaaaaaatcccatcaaaaagtgggctaaggacatacacagttctcaaaacaaaagaagatatacaaatggccaaaaaacatgaaaaaatgctcaacatcactaataatcggggaaatgcaaatcaaaaccacagtgtgataccaccttactcctgcaagaattgggcataatcaaaaaataaaaaaactgatgttgactgacatggatgcagtgatcatggaacacttctacactgctggtgggaatgtaaactagtacaaccactatggaaaacagtgtggagagttcttaaaggcctaaaagtagaactaccatgtgatccagcaatcccactactggatatctacccagaggaaaagaagtcattacatgataaagatacttgcacacacacttttatagcaacacagttcacaactgcaacatcatggagccaacgcaaatgcccatcaatcaaagagtcgatatagaaactgtgatatatatatagatatatctatctatatatatagaatatatatagaatatatagagaaaatatatagaatatatatagtatatagagaatatatatagaatatatagggagaatatatattccatcatatatatagaatagagagaatatatatagaatatatatatagaatatatagaatatatatagtatatatagaatatgtatggaatatatagagagaatagagagaatatatatattccatcatatatatagaatatagagaatatatatattccatcatatatatagaatatatatagagaatatatatattccatcatatatatagaatatatatagagaatatatatattccatcatatatatatagaatatagagagagaatatatatagaatatatatatattccatcacatatatatagaatatatatattctgtcacacatatatattccatcacatatatatagaatatatatattccgtcacatatatatagaatatatatatattccgtcacatatatatagaatatatatatattccgtcacatatatatagaatatatatatattccgtcacatatatatagaatatatatatattccgtcacatatatatagaatatatatatattccatcatatatatatacatatatgatagaatactactcaaccatataaaggaatgaattaatggcattcacggcaacctcgatgagattggagactattatactaagtgaagtaactcagaaacagaaaaaccaaacattgtatgttctcactgatatgtgggggctaagctatgaggatgtaaaggcataagaatgatacaatggactctggggacttgggaaggttggggtggcaagggataaaagactacaaatagggtgcagtgtatactgctgggtgatgggtgcaccaaaatctcacaaatcactaaaggacttactcatgtaaccaaacaccacctgtaccccaataaactgaaaaataaaaaaataaaaatgtatatataggctaggtgcagtgactcacacctgtaatcccaacacttgggagccaaggcaagagggttgcttgagacaggagttcaaggctgcagtgagcaatgatggcaccactgcactccagcctgggcaacagaatgagaccctgtctcaaaataaaataaaatataaatgaatgacacatgagttttttaatagatatgcacgtttatatttggatatacacctggatgtgtaatttctatacatggaagcttttgtttcttttatatttacttaagatcatttccatttgaaatgcaataaacctcaaaatgtttttactttatttatatcatttcattgtttttgttgccactatagtacaaggggcaattgagaatttcactttttattagagcttttagttttgtgattttgaataataaagtgttatatgcagtggagggcagtgagggaatcttcatattcatggaaatcatccaccattgtggattttgtacttattcctaagactaccgcttgccctaagatgagagaagcaactactatggattttggatcatggatgttagatctccttaatgttgaatatatcagaatggccaacaaccactgttgagagaaagagtaaaaccagcaaggatttcaaaaaaactaattaaatgtgattttgccttgatgaggcattttctggtgtcactatatacagattaacattttgcaaactacctttttaatgttcatatacattaatatttaaacctaagacatcaaggctaactactaagcagagaaatgttrttcctggaagggatgtagtatttttggaaaatatcttaagtttatgcctgttaaatagtgtgtagttcttgaagtagcatgtgttaggcaatttttttttttaagaattcaactttttgtttacaatgaaatatagcatagaaaaatactctttcttttttttttgagacagggtctctctctgttacccaggctagagtgcagtggtgcaatctcggcttactgcagcctctgcctcccaggttcaagtgattctcctgcgtcaccctcccaagtagctgggattacaggcactcaccaccacgcctggctaatttttttgtatttttagtaaagatggggtttcaccatgtttgccaggctggtctcaaactcctggcctcaggtgatctgcccaccttggcctcccaaagtgctgggattacaggcatgagtcacccttcctggcaaaaatattcttttttttttttttttttttgagacagagtcttgctctgttgcccaggctggagtgcagtggcacaatcttggctcactgcaacctctgcctcccgggttcaagtgattctcctgcctcagcctcccgagtaggtgggactataggcgcccaccaccacacatggcttttttgtatttttagtagagacggggtttcaccatgttggccaggatggtctcgatctcttgacttcgtggtccacccgcctcgggctcccaaagtgctgagattacaggcgtgagccacagcgcccagccaaaaatattcttataattagtattgggttagataggaaattcatttcaaagaactaatgcctataattaaatttaaatatttcagatccagctttctttattttaaaaattttttattttattctattttattttatttttaaatggagtctcaccatgtcacccaggctggagtgcagtggccagatccagctttcaaaagcaatcatcttcatagatgaatttttaaattttttaatgttaagtatgtagtaaggtatattaatctagctctcaatatagaaaggaaaaatatgtaagaatatgcagttacaaataaggagcaagagyttggttgtctaggacttttaactcttaactactgtcagcaaactagtgaaagtggctggagttaaatttaccactacatgctcatcgaaatcaagttaaatattaaaaagctatcaaattcagagaaaagccatttaatataatcaaacagaaacaattaggcactgtgcttttctaaaacactctaggatcttgtgacccatagttcacgagggtattccaatattcaagtataagttgtgtgcatctgtttttattttttagagatatatgtttcaggtattaaatgtacatacaataaatatttgtttgaatgaaattatttgttatataagaactggtaactatatcctggtgtagctttttcatttaaaaaaattatttcattttatttatttatttatgtcagtagttttgggggaacaggtggtgtttggttgcatgaaaaagttctttagtagtgatttctgagattttggtgcacccatcacccaagcagtgtacactgttcccaatgtgtagtctgttatccctcatcccactcccacctttcctcccaagtccccatagtcccttataacgtttttatgcctttgcatcttcatagcttagctcccacatataagtgagaacatatgatgtttggtttttcattactgagttactttacttagaataatggtgtccaactccatccaggttgctgcaaatgtcattattttcttcctttttatagctcagtagtattccatgctgtatatatatgtaccagcttttctttatccactcattgatagatggcatttagggtgttctatctttttgcagttgagaattctgctgcaataaacgtgagtgtgtgggtgtctttttcatataatgactttcttttgtctgtgtagctacctggtagttaaattgctaggtcaaatagtagttctacttttaagtttttttttttttaatttatttatttttattatactttaagttttagggtacatgtgcacattgtgcaggttagttactccatactgttttccattgtggttatactagattacattcccaccagccgtgtaaaagtgttcccttttcaccacatccatgccaacatctatgttttttgtcttttaattatggccattctttcaggagtaaggtggtatcacactgtggtttcggtttgcatttccctgatcattagtgatgttgagcattttttcatacatttgttagccacttatatatatcttctttgagaactgtctattcatgtccctagcccacttttttatgggattttttttttgtcttactgattggcattctctatagattctgggtattagtcctgtgtcggatgtatagatggcaaagattttctcccactcttggggttttctgtttactctgctgaaaacattctttgctgtgcagaagctttttagtttaattaggtcccatctatttacctttgtttttgttgcatttgcttttggattcttggtcatgaactctttgcctaagccaatgtctagaagagttttttccagtgttatctagaatttttatggtttcagatcttagatttaagtctttgatccatcttgaattgatttttgtataaggtgagaggtgaggatgcagtttcattcttctacatgtggctttccaattaccccaacaccttttgttgaatagggtatcctttccccacttcatgtttttgtttgctttgtcaaacatcagttggctgtaaatatttggstttatttctgggttctctattctgttccttttttctacatgcctatttttataccagtaccatgctgttttggtatagccatgtagtataatttgaagtcaggtaatgtgatgcctccagatttgttctttttgcttattcttgctttggctatgcaggctctttttttgttccatagaaatttttaggattttttttttctagttctgtgaagaatgatgatagtgttttgataggaattgcattgaatttgtagattgcttttggcagtgtggtcattttcacaatattgattctaccaatccgtgagcatgggatatgtttccattcatttgtgccatctatgatttccttcagcaacgttttgtagttttccttgtagagatctttcgaaactccctaaatatttttttaggagggtgaggagctgttgtaaaaaaggttgagttcttgatttgattctcagcttggtcgatattggtgtacagcagtgctactgatttgtgtacattcattttgcatcctgaaatcttactgaacttatttgtcagatccaggagctttttgaatgagtatttagtgttttctaggtaaacgatcatatcatctgcaaacagcgacagtttgacttcctctttaccaatttggataccctttatttatttcttttgtctgattgctatggctagaacttttcagtactatgttgaatagaagtggtcaaagtgggcatctttttcttgttctagttctcaggaggaatgctttcaacttttccccattcagtgtaatgttgtctgtgggtttgtcatagatggcttttattaccttaaggtatggctcttttatgccaattttgctgagggttttaattgtaaagggatgctggattttgtcagtgcttttcctgcatctgttgattatatgattttgtttttaattctgtttatgtggtgtgtctcatttattgacttgtatatattaaatcatccctgcatctctgatttgaagctcacttgatcatggtggattatctttttgatatgctgttggatttggtttactagtattttattgaggatttttgcatctatgttcatcaggaatgttggtctgtagttttctttttttgttctgtcctttcctggttctggtattagggtgatactggctttatatgatgatttagggaggattcccttcttctctgtcttttggactagtttcagaaaggttggtaccaattattctttaaacacctgacagaattcatctgtgaatccttctggtcctggacttttgttgtagttgttggcagtttttaaaattactatttcaatcttattactcattattgatctgatcagagttttcatttcttcctgatttaatctaggagggttgtatattttcaggaatttatccatttcctctagattttctagattcatgcataaaggtgtttatagtagccttgaatgatcttttgtatttctgtggtattggttgcagtatctcccatttcatttctaattgagcttattcggatattttctcttcttggttagttgcactaatggtctatcaattttgttcatcttttcaaaaacccagctttttatttcattgattttttgtattttttgttgtttgtttcaatttcatttagttctgctctaatgttggttcttttcttctgctgggtttggattttgttctttctctagttccttgagttgtgtccttagattgtctgtttgtgctctgttggactttttgatgtaggcagttaatgctatgaactttcctcctagcactgcttttgctgtgtcctagaagttttaatatgttgtgtcactattattgtttagttcaaagaatgtttaaatttctatcttgatttcattgttgacccaaagatcattcaggaccagattattttatttgcctgtatttgtttagttttgagggttttttttgagtcgatttccagttttattcccctgtggtctgagagggcactggatataattttgattttccttaatttattgagacttgtttaatttattaatttattggtctatcttcgagaattttccatgtgctgatgaaaaaaatgtatactctgcagttgttgggtagaatgttctctaaatatctgttaagtccatttgaagtccattattttgttgactttctctcttaatgacctgtctagtgctgtcaggtgagtattgaagtcccctattattgggttgccatctatctcatttcttatatctagtaataattgttttataaatttaggagtgctgcgttaggtacatacatatttaggattgtgatattttcctgttggactagtcctttcatcattgtatgatttccctctttgtcttttttaactgttgttgctttaaagtctgttttgtctgatataagaatggctattcctgattgcttttcgtttccatttacatgaaatatctttttccacccctttaccttaagtttatgtgaatccttatgccttaggtaagtctcttgaagatagcatatacttggttggtggatttttaatccattctaccattctgtatcttttaagtggagcctttaggtcatttacactcagtgttagtattgggatgtgaggtactattttattcatcacactagttattgcctgaatactttgtttgtttgtttgtttttgtttgtgtgtgtgtgtgtgtctgtgttgtgttttgktttttttttttttttgagacagaatctcactctgttgcctaggctggagtgcagtggtgcaatctcggctcactgtaacctctgcctcctgggttcaagtgattctacttcctcagcctcctgagtagctgggattacaggcacctgccactgcacctggataatttttgtagttttagtagagatagggttttaccatcttggccaggctggtcttgaattcctgacatagtgatccatctgcctcagcctcccaaagaatactttgttttttcttcattgtgttattgttttataggccccatgagatttatgcttcaaggaggttcaattttggtgcatttcaagggtttgtttcaagattcttgtagtgctggtgtggtggtgatgaattctctcagcatttatttctttgaaaaatcctttatctctccattttgaagcttagttttgctggatacagagttcttggtttgtaagtattttgtttgaggatgctaaagttaggaccctaatcccttttggcttgtagggtttctgctgagaaatctgctgttaatctggtaggttttcctttatgttaccactttatgttcctttaggttaccgcttgcttttgcctcgcagctcttaagattctttccttagataacctgatggctacgtgcctgggtgatgatctttttgctggtggtcatctttttgtgatttatttcccaggtgttctttgagcctcattgtatttggatcctcttcctcctcaggaacaccagttattcttaggtttggctgtttaacataatcctaaattttttggagggtttgtttattctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcctgcctcggcctcccaaagtgctgggattacaggcgtgagccaccgcgcccggccgggtttgtttattctttaaaaattatttgtctttttctgattgggttaaagaccttgactttgagctctgaagttctttcttctactcattcaattttattgtcgaaattttccagtgcctttttttatttctctaagtgtgtacttcatttccagaagttgtaattgtttttctttatggtatctgtttttctggagcatttttcatccatayactgtattttttccttaatttctttaagctggttttcatctttctctggtatctacttgagtagtttagtaatcaaccttctgaattctttatctggcaaatcagagatttcttcttggtttggatcccttgcgcatgttatagaatcttgttttgccacattaccagaattacttttccgattccttctcatttgagcaacctgtttcagtggaaaaatatggaactcaagggctgctgttcagattcttttgtcccatgggtgatcccttgatgtggtacatttcttctttccctagggatgggacttcctgcaagccagacttcagtgactgttattgctcctctgggtttagacacctagcagggttactaggctctgtgttagtgctgggaaatgtctgtaaagaatcctgtgatgtgatccttcttcaggtctcccagccatggataccagtacctgctctggtggagttggcagggctgtgaaatagactgtgtgagagtccttggttttagacacgttgaggatgctggctttcttgaatgctggttatgccagcagtaaagttgtcacgtggacacactgagaaccactggtttgctgggattttgcaggcagtgaaattagctgttgtcttctccctccttggaacaggattgttctgtcatgagttgctgtaatgtcctaagttggtcggcctccatccaggaggtggcgctttcaagagagccccagagtttttggcctgtctttcagaacttgcagtggcttgccacttctttcaaagcatctgtgaattcttttagttttcctggtacattcctgtggtggttcctggattaaaagtccacattgtgagtccccacacattgttctgtctgtccaagtgggagctgcatgtcagccctgtctcctgtctgccatcttgactccacaatcagctttttcatttttactgaaacttaattccacattgagagtttttaaatttcagcattgaataagtgccatttttgactagtatataaattttattaaaacaactacatctgaaaaataaggaattcataaattatcatttttataacctctcgtcatttacatggaacatgtagaatctttatgacttcaatttagtaaattgtaaatacagtttaattgttgtttaacttgtatttgacagcttaccaaataaactaatgaaatgaatcccacgtaatctagatacctacactccaaagaacagtacatggatatttcttggcctgataataaatgaaaagaaaggaataactgatgtatctgccttgacttattgtatctcaacatgaaggggagagagggcagttcttagtgaaataatgcacattaaaacaagataaaaaattttaattgacataatgattgcatatattgaagtggtacataattatgttttgatttataatgtatagtgatcatatcatggtaattagcatatctatgatctcaaacattatcatttctttatgttgggaacattcaatgtcctcctagctatttgaaactctgtaatatattattgttaactagagtcatcccacaacggtatagaacactagtatttattccttctatatagtggtaattttgtccaaggtaattttgtttaacacaataaaaaaccatgctaaaaacataaaccttaattgtagattttagttttggtattgtattatttggcgatgataagcttagaaaaaatacttaatttttaatttaattcattagattttgtttctgttaatttattctttatagctaaaagataaaaagatcacactattttactatcacacattatttttgtttgttgaagcaaagaaaaaaatttagaatgtgacaagagaaaatattattaatcttaaagaaaatttaagttttaaaacaggctgattcaacacatgttgtcagttcagtttcagacaatgtataagatatgaatcatagttgtgcagaaatatcaattgatttggtcacacatatttaggactgattattgctgactattgttatatttttgaaggttttaaaaattcaattaaagtgattatatagatttatactttaatatttcagtggcaacagaaattttggttttcagagcacatctgagattaaagattttatccttttcctatggttgactcataaaaaatcaactctattttcaatactgtgatcaaataaaagggaattgggacagtgtgtagagtaagtacttttttttcatcatttcatcgtgtttattacctgctctcagattgcccagcaaagatattgtaacagtgtgcgttgtaatcaataagtaatgtataaatatgcagtttcaccatggcctcagcactattaaattttattattttaatttattattttattattaactggatagataggaaatggcatctctattttcttttcaatttaatgttctttgcttactagtgaaaagatgatacatgatctattgatgttgccaccaaagtttcagaacagtctataggaggtacttttaaatgcatttggccttgtctagattaaaacaacagcttacatttattaaacactcactaagcaccagatacttagtttttttaaggattatataatatttgttctggttagtatactcattttacaactgtggaaacaaaggcttagaaatattaatacatccaaggtcacagaatcagtaggtggtatttatagtttggtggatttgtcccatcaaagttggttttcccttttacttaccattttaactcctaagttgtactatcatagcatacccatactctgaattcataactgaaataataaccttactttaaattttacattttctgctgaattctctttatgctagttgcatatataatcttacaggacatatttataaagacagcttaaaatagaccagacacttaagaacgtataggaaggtaatttgaatgttacagatttttcaatatgggagattttatcagtttcatcataataacaatagtgcattcaaattctttcatgtatgtaccacatcttattcttttatcactccttcagacacatgaggttatatactgatctccacatgaggaaaatgaggcaggggactgttgtttggttccacttctgtgtgctttccatctggatcgtacttatcaggatgacattctattattgcaaatctgtgctttaaatttattggattacaaagctttaaagatgtgtggatctgggtgctataacactgctcaaaatagctgcctgaatgaagagatatatgtactttaacattacacttttaaaagtgagtatatttcatgagatgaattgtctgtcttatgcgcaattataaatcatttctatttcataagactgtagagtgattttgaatacaaagcaatattggacaaatagcaaattatgttaaattgtagggcaaattgagaaagcgaagctgtgattttgagcaactgtgccttcatgatttaaaatgcaactttcttatgcagtatggaacaattcttatttcctctcaaacttctattataaatgcatttattctttttaattttagcttcacagataattctggtttggaattagggatctttttttgaggataggaagaaatttgcaaattatatttgagttttgatttattgtgataattgactaatttattatataacctgttataatctgaactatttaaaaataattttctgctttaaaatctctcacagggtctttcttaagacactttcattcacctctggaaatagcagcagtagtttctaatctttggctagcagataatttctaaaatcatttttctttctccccgaattgtagtttgagtagcacttgtctttcagagaaaatgaactttattcctattagaaaaactgttaaactaaaagatctgacaacaacattcttgaataagtttaaagaatttatggcttaaattaatctgaattctaatttaccttttaccttgagcttggctgctgttttcaatttatatgcattttatacattaactgctaccctcaatytcctgtcaactttgtagtaagtgatactctgtcaaatgctactctatgatgcatttaaataaagataaaaggtcaatctaggcttttctaaagttaccattctaggatataagcttctgaattgctttgtatttgtatcattagacgtaatttctgacatttaaaaatttaccaaaaatgtaatgaattcaaggtagtcattatatgtctatggattctttaagcatgttaaagactttatgtatctttaaccataaaaaacataatattgctaaataaaattattctgtgtatctctaggcagtctagaactcatattctagaattctagatcagcagtgaacaaagtgaggatgtctactcttaccccttctttttaatatatgttggaagttttagccagggcattaaggcagtaaatacatagacaaataaatagacagataggaaaggaagaagtaaaatatgtatttcttcatagtagatgtgatattatatatcaaatgattctaggaaatctgcaaaggtactaggattaataaatgactttagcaaggtcgcagaatacaaggccagtattcaaagatcaattatatgtctatactttaaaaacaaataaccagaaacagaaatttaaaagccagtatcacttacaataccaaaaaaaaaaaaaaaatgaaatacttagaggtaaatttaacaaacattttttaagacctatatactgaaaaccatagtatattattgagagaaagtaaaaatctgaatgaatatagagatacaccatgttcagggatcagataagtcaattttgctaagatgtcagttctccacaaattaatttagaattcaaagcaattctaaattaaacccaatgggctttattttagaaattgacaagctgattttaaaatttatatggaattgcagaggaaaaacaattgatacagagttagaaaactcacaccacctaaatatttattatatagtaatcagagaagtgtgttattagcatatgatgttgaaacaattcattatccatttagaaatacaaaaggaaactccacccttaccacacatcatacatggaaatcaatttacaagatatcatagacctaatataaaagcaaaacataaacactttaaggagaaaaataggagaaaatcttagcaatcttaaatcaggcagaggctttttagataggaagcaaaagccatcagtttttttttttttttcttgagacagggtcttgctttgtcacccagtctggagggcattggtgcaatcatggctcactgcagccttgacctcctggggtcaagcagtctccccacttcagcctctcaagtagctaaaactacaggtgcatgccaccacacctggcttttttttttttttttaagggacgggtctcattgtgttacttaggctgatcttgaactcctgggctcaaacattcttcccaccttggcctcccgaagtgctggggttacaggcatgagccaccgtgtccagcatgaatatttataacaaagtgataaattagacttccttgagagatacaatttaaaaaatgaaaaagcaagccacagactaggacgagttaataaataaattaaatgcataaacacctacatgtatattgtgtatgtttgtatatgtatattgaacatacatggacaaggatatgtgtcaagaatatataaagggccaggtgcagtggctcatgcctgtaatcccagcactttggggggccaaagtgagaggatcacttgaggccaagagttcaagaacagcctgggcaaaacaatgagatgtcatctctacgaaaaattataaaatgagctttgccaggcatggggcacatgcttgttagctactcagaaggctgaggcaggagaattgcttgagcccaggagttctaggatacaatgagctgtgatcatgccactgcactccagcatgggtgacagagcaagactctgttttaaaaataaaatacacacatacgtgtgtgtgtgtgtgtgtgtgtgtatgtgtatttttgtctataaagaacaattataactcaataatagaaagacaacccaattttcagtaatgggtaaaacagttgaaaagatatttcactgcagaagatatgtgaatggtcagtaagtgcatgaaaagataatatcatcagtcatcagggcaatggaaattaaaaacattatgaaataccacaagatacctactagaatggccaaaatttttaaagacagtactaagtgttgatgaggatgcaaagcaactacagcttttatgcattgctagtgggaatatgaaatgatactattactttgaaaaacaatttgacaatttctttataagttaattatacatttaccatatgacttatcaattccattatttgtctaaaggaaatgaaaacttatgttcacataaagacttgttcacaaatgtttatagtaactttctttataatatcaacccaaatgcctatcagtagaaaaatagataatccaaatgtggtatattgaatacaatggaaaactatttagtgataaaaaagagcaaataactgatacttacagcaacatggataaacctccaaatcattgtggtgagcaaaacaagctagatactctaaaattccatttttatagaattctagaaaagattaatataggcccaggatgaagatgacttactggaaaggattataaggaaatagtttgggttgatggaaatgttctgtatcttcattggtgtggtaattacacgtttacatatgtatcacagttattgaactgtacatttaaaattcatgtattttattgtgtgtaaattgtacctgaataaagatgaaaaaggtagtatttataaattctattaataattgatttccaaaggaaaataacacaaaagataagtgaacacttaaagataatttcaaagtaaatcttgcttgaaactatataaaagtatttattaaaaggcaattaattactaacatccaagtgtgaaaattttgacctttagtgtattgtgcagaaaaattgtggtatatttcatttaaaattgatcaaagacagcaacatacattaatcagaggaaagcatcaattaaatgtagaaacaagatttaaacaaagattcatattaaaataatgataagtaatacttagaaactgcatcctagagacacattattcgtatttttagaaaaacagaaacatattagtgtgaaaagatgttaaaaaatgaatattaaattgttgagcacaacacattatgttggcaacaatataccataagtgactgtagcttgcaataaggaaatatcttacttgtttttctctttaggctttttttataggcattaataacaaatatttcctttcctcccttatttattgaaccacaccccttctcatactatctttccccccaaaggaagtgaattaattcactacctcttgttattacagtttttcattttaaaaacaaraaacacttaagttttccttttctcttatttcaaagttatatatttagccacctgagttatgctatgcgtcaaaatgtttgttgttgttgttgttgttggtttgagacagagtctctgtcacccaggctggagtgcagtggcgcggtcttggctcactgcaacctccgcctctcggattcaaacgattctcctgcctcagcctccagagtagctgggactacaggtgcgcgccaccacgcccggctawtttttgtatttttagtagagacgggattttgccttcttggccaggctgctctcgaactccggacctcaggtgatccacccacctttgcctcccaaagtgttgggattataggcttgagccactgagcccagccctcaaaatgtttttgaagtaatttttgttatagttacacaaatgcttctttagttcaatggtacaggaaattatgagcttgcttctattttgtatggcatcaaaaatgtgtaaagtactgcagaatgggttacgtatattacatcttctcttaaaatgataatttttatggtcctttacttttttcccccttcttttcctttatgagctgtgtccctaaaaatcactttaattgcacatctaagctttcttctcacccaagaaaaccattttgaagtacgtaggtgatattactttcttgaggcttgatggaccctgctgagatcaaacctgtttacttttcttaaaactcctttttgttggagagtcttaaatattagtctttgttaacctttccacagatttgttattgggcgggaaaaaccaggacaagtgagcgaggttgcccagttgataagccagacactggaacaggagaggcgccagagagagctgctggaacagcactatgcccagtatgatgccgacgatgacgaggtcagtagtgcttgcaaagattctttttcccacattttctaattcatgaaactctctctactgtataacagtatgacaggttttatgcagtttcttgaggaaggtgtgtccacattgaactaaaattctaccttagaaaagaaatactactcgcatctgatatacgcttaagaatcaagtcatggtatcctgtttacagtatgaagactgtggacacaaataagtcttatcttttgcactattataaaggaagtcatagaaacagaaaaggataaaaacacaaaaatgtgaataatgtcatctttattggtggaattgggtgattttctctctctgctttatattttttcaatcttttccaaatgttctacaatagtatgtaatgcttttccaaaaaatcagtaaacacacccatacacaaacaaatatacatagaaaagtactaaagattgctgagtgtttccagtgtctttttcccccaggaagaaaaagttctttggatctgcttactatgatttgtgctaacataatgcagaacaaagctttccactagcacatgttccatagagcagatacatattggaataattttacatcctgctttctgtaaaagatcaagtaaatgaatagaagctaacccccaagtgaaaacagctctccagaacccttgtgtgctgtaatataatacagatgctggtctatttctaatgtctttgaaatgtacattgatataatgggacaacatgctttattataaacacgtttaaacattcatrtgtttcatattggtgtgtcaaaagatccatcaacaatttaattgtagtattttatactccataaactagtacatattcaggtaaaacaaatattcttcattccagctaatataaccacagtgaaacttcatgtattcaaccccttcttatctgaatatataatttttcagaattttgctttctagccaggatatagatattaataaacagacattcaaatattttcacatatttttaatctgagatgttttaatcccaatgtatattaagatctcatgaatatgtggtataatgaggatatattctccacttatagcagaaaattagaggtggtatatccgttaacttttgatcaaagaataatatattagaaatcctttaaatgaatgaattagactcttagaacttgatttaatttattttcttacttggtgagtccatttgaaatggcaagtatattttcattacactgagatattttgtatgaaaaatgttctcttgaattttcaaactaaaaaagggatttcctcaaatattttgaacttgtatcttacctggttttcaattctttacattagtattttgtattttatcagagacactgatttgcttttgctgcaagcttattctgagattgtagaatcattttctgcaggtttgatttttgcgtcctcactgtgctaggatttttggtcttaggttcaggggagtacagtgacatcaagtggtggaaggggacatggccaggctttctagtctgtgtgccttggtgtctttggcatgaaagcacagggattgggctagatcacaaaattccttccagcttctaatgttccatgaatatgaaataagacatcaagtctaacaagcagagggggcaaagaaagaagatagtcacatttttaaggcactccaagtaaaacatttagatcacagaccacacattttctgcaggtattttgaggcgctgatcacattcatccccaaaagttgatataaaattttgctctttttttttttttacgacacagggtcttgctctgccacccaggctggagtgcagtggtgcaagcatagctcactatatccttgagctcctgggctcaagccaacctcctgccttgcctcagcctcctgagtagctggggcaacaggcacacagaaccacatcctgctaattaaaaaaaaaaaaattttttttttatagatgaggtctcactatgttgtccaggcctgtcttgaactcctggcctcaagcagtcctcctgcctcagccttccaaagtgctgggattacaggtgtgagccaccctacctggcccagatttttctttaacttgataattggaatagatggaaaaagaatagtttttacttgacatttatacttaggaatgtatcacatcttaaatggaagattgtttatagattttttttgtttgcctgtttttgtaaagtaatcagagttgtcacctgagcagatattttcaggggcaaggaaattaagtaaatattcagtggcaagcactttgcaaggtgtctttcttacatgatctcatttaatctttaatgcagccagaagagattttctttttttccctagaaatgcagcaactgaggtttttttctagtggtacatccagtagctggcagagttgaaattggaataaagtcttgctggctccaaagcctggactctttgcaacacactgtgctgtttttgagtagcatgtaagaacactcctgcagacacagaataactgggtaacaaaagatgttaagagaattactgtttgcggtgatggagtttaggttctatgattctttgttctgtatttctaataatagggaaatcaagtctttggataattattttctctatgcaacagtccataagaatcatctttatagagtttaaagagaagaataattgagtactcaaattttttttaattagtttagctttaagttaaactgtttttctttctgcaagttgtagaagtaaaaacgaggtgcttgctatgttactccaagtaactcactttatggaaaaaagtcaaggagacttctcctttgtatctgtctctcatcctctgtgacttgggttttttccctttcttgtatgttacacactgcctcaacaaaacatgcccagataaaaccaactgttaattttcagtgcataggagagatgaaagctgtacaaatagtgaaaatccactccaatgttaaaacttcaaattgtcacttgattcaaattcttttttctaatgctgaaaaaattattaaatggattgatttgagtgctttttccctattttctatttactctctgtctttctttgtgaatgaagaataaaatgtccaagaggcataaaggaaatgagaagaacaaatattggatagctaatggataaatgctccttgaataattgagttaatttcatatataattgaacaatttattgattaatatatctttgttaatcagtcacttggtttttttacttttatgatttatagaatcatcttgtgatttcaaagttagagttatttttatttgacagtatctcctgtgacattccctgcaccagccaggaaaacctccatttagatacagaacaaccaagttcatccaactgatttccagagccagctcttagtcagcattttctgctgaaggatagatagcttctgtttttgatcaaatcatccaaagttgattgtaacttggaacttgtcacattgacagagggtatttgcttgcttgcattcactacatggaaaacatcacaatgggagaaatagatcctgaaattataaacctacagtggagctctaaaaactatattgagaaagattaccttacaatatattgcttatgcttagacatatctgtttcaatgctttaggaaattataagtcatactctagtagaatttaagctatgtagataattttcaaactatttaaatttctgctttttctgtttttttcttcctctacatctttagaagggtttaaaataagcaaacagccaattttattttaatttgcatccctgtttttgtttactctctgttaaacattctgattaaaaaaaaatgttaaaatggctctgcctaaaagctgtagaataaaaaggaggatcctatttaagaagagggagatgaatatttgaacaattgaaaaattttaaatgtatatctgaatatatctgtgattcatgatttaatttctgtttaatcgaagtattgatcacttgtttttttttttctttctttctcttttcttttttttaataatctgaaaggttgccatggaggatttcaataaatctctcagacaatcagcactatttcatgacactcggggggtatgataaatttttcaactagaatttaactttttagtaacatttaatctcttgtcatactccaccactatcagtttgtagccttttagtagtgagatgatgtaattatggtatatattttgtgtagtgtgtatatattatgagtattttttatttaagagcattatgccgtttgaaatgctgcaggcttagactggaaatacagtatgaactagtgctatattccatttttgagttagaaaataggtatggtcattgaaattaaaataaagtattacactttaaaaattatgattatttggcttccttaaatattcttttaagatatagtatttgttacattgtaaagtcttagctatagatagcatttcaaagtctccttaggcagtagttcataagaaggttaatcatcactccagaaactgaagccccttctatactgaagcccctaaaatataatttaatctttctttcataatttgttttcattactggaaattaatatcattataacaatattatagcaactttttttttagaatcttttaaagtattgaatacagtttagagtagctgccctcatgggtatggttttttattgcttgtgttagcatgtcataattagaggcaaaaatataatggaagctttggtttgcataagtattaaaaggtatacaataatataatatttatgttataaaaagtgttagagggataacattaagtttgactcatactgtttgccattcctagttggaaacagcttgtgtgtgtaaacaagagaatgcaattattatggttggccttttaataatgtgaatataataatgtaaatagactttatactgtatctataatactgagaaaccaagagtgtgggcattttttaccaacatgccgcaatattgtcttagtacttaacagtgtgtattacagtaagcactgggactcagtgtttttcaatcctttatcaggctgctctctgcggtgggggttaagccttctttaatattttttgtcaaccattttagaacactgtggctgaattgcaaggaatgtctggcaactgcaataacaataacaactattttcttaaggtttgttttttggtttaaagtaatgcttacctgtactttcctgcttcatatgtaaaattaaatattctttgtgtcttattaactatctgtatgttctgaagaacttctctagagtgatgtgttttgtgcattgaataatagtttgaaaataatcattcaaaaaacaattctgaaacatagcatatattttaggtataggttctgcaatttagactcatttcttaatatttagccatggatatttttaacccctaacactttaaatatcttgtgattcaaattaaagggaaaaagcaaatgtccaacagcaggtctgtatgatgtttacacagtaataatgcacatagtgatttatactgtctgtaaatccagtacttttttagaaaataatcttttgatacaaaattcttgatttctcaaaacactaaatatatctttaaattatagtagtatttagttgcatgatttatatggtagacatatcaaaatatctaaaatatcaaaatatctaaaatgatactatactttaaataataaaataattctcgttatgtttagttgctgttaatatagatagcagtgcttaaaaatggaggttgagtgtatgtaaaaggcaggctgatttatggcaattagaggaaactgaagaataaaggaaatatatttaacagcctgttcacagactccaatttggtctaatctctaaaatcattaaatttaattatatcctttgttttatgatccccaaatctatagcaacagtcattgtcaccaaagccaagaatcacaaggtgcttggaaaacattccgtttaagaccctatccatatgtgcactggcctaagtagtgtatacacatgcttaacacacacacacaccacacacacaccacactcacaccacacatacccatgcacacacaccacacatatccacacacacaccacacacacaccacacatacccacacacaccacacacacacaccacactcacaccacacatacccacacacacccaccacacatacccacaaacaccacacacacacaccacacacacaccacacatgcccacacacacatcacacacaccacacataccctcacaaccacacacacaccacacacacgacaaacaccaccctcacacaccacacacaccacaaatacatacacacctcacgcccccacaccatacacacaccacatacccacacacgacacgcacacaccacacatacccacacacaccacagacgcacacaccatacacaccacacacacgccacacacacacacactcactctgatcccacggggtagacatcctcctgtacttgaaagattctctctagaaatattcttcatatatggagatgttattttttaatacactgtgtacagacagaaagatgggtaaaggggagatacaggttaggataggaaccttcatctaaacaatgtcatctttttgcagatcattttctttgatttaaaaaaattatgatgcaaatgatttgaatatattttccttcccactgccacattgtgatattatttactcatgagctagatacgaaataccaaataaactttatcaaattcttccatgtaattaaatttctctgaaagtgtagactttgtactccctagaaacaatgctagaacaattcaatattacaatgatgaaacacagagtttgcagtgttaaagagatgtcatagaaactaccacaaatgacagtatttttctgactttaaaaacatatattttattagttgaataatttaccaaaacattctaaaatgctaaaagacatagtgagagacggatgcctgggaaacagacttactttcccaggggccatcgggatcccctggattttctatgccttttgtttcctataccttttatggtgtctagtacactgactctgttgcccttgtatgtcagcttaatcctgtgcacctttcagggttccatttaagtttcatctccttcacaaagcattgctgggctagtggtcttttaaaagtgtgtcagtagcactgtgtgtatctctttctgtcattatttatccataaattccccccattagcctgtaatctcttcaatgacaggtttcaatgggcttttgcttgctacagcattttaattgtcttgagagtccatgaatttgcaagaagaccctatctctatcacactaaaccacaatcttcttcatgtaaaaccagaaaaaaaaacaaacgtgcatattttagcccttgaaaacctttgggaatatcaaaatagcaacttggtgactcacagtaacatgccttctttttagtcataactgaataaacctgcagttgaaacagaatagtcaaaatggcctaaattacaatactgcatatatgtccttatctccttcccaatgtattcacttagaaatagccttaaatcatagaaacatattttctatcacagaaacacatttccatttgcaataaaaactgaatggtgatgtggccaaggactgagatggtaaagctgctttatcatggagttttgccaggcttgataaaagatgttaaaaactctaattgatttctgaagtttcagttcctaaagggatttttttaatggatttattgagataaatttgacatagagtgaaatgcacagatcttaaagatataattttatatattatcattacatagctccatttaaatattaactttaatgagtaataatttacatacaataaatgcactaattttaagtgtatttaagttaatggtttgatgagtaaccaccaccataatcaagatacaagacatttttattacctcaaatagttaccttagggaactttgtagtcactctcagcctgagacaactattcagtctgctttttgaaactataagttaatttctccaattctagaatgtaattagaataaaagcacaacatacttaattctagaatataattacaataaaagcagaacatacttttcttgaactgcttctttcactcatcataatgtcataattatcgttaatgcttaaatgttatgatgatactgtaattggtattgctttgagttatagtagacaaaacccagggtccacctgatatgggatgcctaattaggaaacttcatcataaagctggaaccccatggactacacctttctgtaaggtgaaaataaatctatcaccccagggactgcatggaaaattgccagtgtcaaaccttgggtgctgagtggaaaagccaaaaaaattttttctaacaaattatgatcacaagtagccttaatttatgttacttttcagaagaaaaaaaaaagcatatctttccttgggcgttcatctttactcaaagaaaaaaagttaaagtttcgagaaatatgagttgacggtttcaaggtacaaagttcgcaggaaaataaagcaccatgagtaaaaaacagcagaaaatagaagaaagggagggaggaaaagaaaaaaaagagaagaaagaaaataaatataaggtcaaaatcattttattatcaattataccaaactagaacaaatatctccaattgcatataacttattccagaagacagaaaaacaaaagtagtacaactttgataccaggaatgcagtaaaactttgacagtgtgagatgtatgaagtaataaaacataactttggtaccaaaagctaacaatgatgagaaagaaaacttataggtccatcccattcataaaaacaatgcaaaaaggtcctaaacaaaatattagcaaaccatatgaagcaacatataaaagagataatatatcatagctasgttgggtttagccaggaatgcaagtatggtttaacattggaaaatctgtcactttttatatttgacaytgtactggaaggcaagtaaaagaaattaaagaaataaattgtaaagaaatgaaactgttattcacatatgatgagattgtctatttaaaaaatctcaaaaagtacctatagataagttattagaaataatataaagttatagcaactttgctgaatacataattaatgtaaaataaaacatctatttcaatatgtctgcaaaccaggagaaaacataatttataagttaccatttacaagacttcaagacataaatgatagggaagagcttcatagagaaaaacaaaattgtattgagatataccaaagaaagtgtataaaataggacaaagaaaccttgttcatggattggaagattcagtaactgttgatttggtgcaattctagtaaaaataatttcaaaagatttttaaatggaatttgataagctattgctaaaatatacatgaaagggcaatacatgagaaataaccatggcatttcacatgctttaaaatggaaataattattattaaactttaataaatttatactttggggcaaaagaatgggcaagttggtcagggagcccagaaacagcactgtagatatacagaaacctgatttatgacatagattacactctagaagagttgagaaatgtttggctcttcaataaagagaatatagtgaagttgagcccccatataatccatacccaaaattccatctcaagtggactgactacgtaaatgtgaaaagcaaaaatataaaatttggaagatagcatagaagaatgcctttatgacctcagtttttagcaatgtttcttacagctgggtgtggtggcttatgcctgtaatcccaggactttgggaggctgaggcaggtggatcacgaggtcaggagattgagaccatcctggctaacacrgtgaaatcccgtctttactaaaaatgcaaaaaattagccgggcatggtggtgggtgcctgtagtcccagctacttgggaggctgaggcaggagaatggcatgaacctgggaggcagagcttgcagtgagccgagatcacaccacggcactccatcctgggccacagagcgagactctgtctcaaaaaaaaaataaataaataaaaataaatgtttcctaaatgagccactaagaaaactgactacattaaaacttaacttctgttcatcgaaagaatacttttaagacagtgaaaagataaaccatacgctggagtaaaatgtttaaaaaatacacacaatattattccatttatataaagcataaaatcatgtcaaaatgacacatagtttggatataaaaatatagcaaaactaaaaaaaaaaaaaaaaaaaaaaaactctgataaaattcagcagaattactccagaagagtaagcaactgaaatggaatcaaggaggcacacacagaggacttcaatgaaaatgagtggttctgttccttttccttaaataagttgttagtttattggtggtggttatataattattcattatgttttaaatttatttattgaataggctttatgtcaactcagtatttaatataatttaaaatctgctgtgtataatgtactttgcagttatgtgattatgtggatataaaatgaatatgacatagttcctgctctctgaggacttacaaaatggcttaaaactctgtgtcttcaacttgcttcagtatgagaatatcatggtacttctttaaaagtacagatttacccacccagcctcagacctaccaaatctgaatatggcttgcaagggtgtcacctgcgggtgtttgtgggaagcggttacatgcaatcagtattggagtggtccagtgtaaagatgccaggaatcttgcagtaaagatctttgagtcctggtattgcaagcactttgcaagaaggaatggctgccacaaaccacaagtcagccatgtgaggaaaggactagaattattctccctagaaggagattgtaagattgagactatgtttatcattaatctatgtaataccataatccatgtaataccaccaatgacatttgtgttggttttacttttttttgtactttaaattctgtaactgtaatttctggttctatctgatgatctgatagcatttttgcaattacacgaatcaatttttatataaacaccatatttttcaacattcaattacttgtacaattatagaattactaaaataatgataacatgtctcttcagtcactcatagctgccctcttctatagaggaaaattcagggaaatacaaatctcttagtttcttcccacagttctactggcatcagaataagtacttcattgttctcttggcaagtaaaatgaaactcaaggaagactgccagtttgaatttgcagtgtgacatttgaattatagaggtccactttggtctgtcgaccgtttagttcaggatctcagtgggaaaaaagatcactggttcccttctcatatagaatatatttatcagggacttaaagacaatagcatttctctctttataagtaggtaaatgtattaaatggaattgaattaagaatattaagacatggtgaatatattttatgctcacaagcagcttattttgctgtggaaacagtaaatatgtatggtaaaaaatttaaatccttttcaaggcaacctgtcaaaagatccaataacgatagtgtaaaagaatcatcacaattttaaggcataaaaaataaaaattaatttgatatttctggtttctatttttatttgaaaggatatttttgttgtttttgtttattttctgtagcacaagcagctgtggcaatgaagggtgtgttcaaaaaaaattttttttttttgagacagagtcttgctctgtcgctcaggctggagtgcagtggcatgatctcagctcactgcaacctccgcctccccggttcaagcgattctcctgcctcagcctcctcactagctgggactacaggcacatgccaccatttgacccagcaatccaattgctgggtatatacccaaaggattataaatcattctactgtaaagacacatgcacacgtatgtttattgcagcactattcacaatagcaaagacttggaaccaacccaaatgcccaccaatgatagactggataaagaaaatgtggcacatatacaccatgcagtactatgcagtcataaaaaaggatgagttaatgtcctttgcaaggacatggttgaagctggaaaccatcattcttagcaaattaacacaggaacagaaaaccaaacaccgcatgttctcactcataagtgtgagtggatcaatgagaacacacggacacagggaggagaatatcacacactggggcccgtcagagggtggagggctaggggagggatagcattaggagaaatacctaatgtagatgaccggttgatgggtgcagcaaaccaccatggcacatgcatacctatgtaacaaacctgcatgttctgcacatgtatcccagaacttaaagtataaaaaaaaaaaacattaaaaataataataaaaagaaattgaatgtctgacccatggacagacaatacctttggcctgatactctcagtttgagatgggtcaacttgaactcatgaccaacaggattggaagggttcaacaaacattgtttgtcaaatagaaatgacagattccagaaagctgccaacctggctacaagtggtagccttctgtttgattaaaactttgtctctctgcctcctgaaacagggagtttggcttgatgatgtcttcaattcataggttttctttaaatccctggtattggttcactgatagttctgccaagttgttcaatgttgtcttctggtttttcaatctcagcactagttatgcagacaccagaatggacatggccactctgctcaataggcagcactcaagcccatttatatcactggccaatactccccttgatgaagcatgttatatttttactaactctgggtctattacgactgacttgttgggtctgtcactcctaaaattacagactgacatataaaagtttgggatagatagggttaggagtggtggctcacacctggaatttcaatactttgggaggttgaggtgggagaataacttgaggccaggagttcaagaccagcctggacaacatagcaagacgtgtctctaaaaaaataattttgtaaaagcccggcatggcattgctgcatgcctatagtcccaactgcatgggaagctgaggtgggaagatcacttgagcccaggagtttgaagctgcagtgagctatgattgtgccattacattccagcctgggtgacagaatgagtccctgtctctaatcaatcaattaaaaaaaagtttgggatggcaaacagtggaagcaaattgtggcaactggtcacattctttgaactgcttatgtagctgcaccttagaggaatttttatatatttaaatgtatttaaagaaaggcttttaaaaatagaatcagaatctgcagtttaataggatctccaggtgattcttttaaaaatatttttattgatgcataagatatacatcatttcagggtacatgtgacaatttaatatattcatttaatttgtaaagatcaaatccgtttacttgggatatccatcaccaaagaaagacctttgtaagaagtcttttcttaaaaataaagaaaaaatgaaatcttttctttaggatattttaaagaattttaaaatatatatatgtatttaaagaaagaccaccattagatcatgtagccttcagatgattatagagatccctccaaaatgaggctactcttagttactaaagggagctttcctgagggataactaatttattatttgtatgagccctacaggcaattgtccttatgattaaagtcatttaatcagataagatcttatgaaaatggttcctgattttaggtaatgtggttattggtaccacctcagtcctggaaggcagtcakgtyagcctcaaccttttggccagggtttttctggacagtagaattgctctaacccctagacttcctccttgtatgccaaggtttgagtctatgtaattattgatcctgctgtacctggttcaataccttaggccaagtggaaaggtcaatacagaagcttaaggagaaagtcctgggtttctaaggtatatcctgatggtttatgggatttctttaaccagttgggtctgggagcctagagaatatagttgttatcaatgccgaaagttagactaattctgctgcttggaatcctattgatagtagtattaatcatatgctctgagatagactgaatggctttggtcctagccactcttggttacattgatcagtgtggccaagggaatgccatactcggagaaaattcacctcaagccaagactgtgtagaaatgagggtggacgttgtttggagacaattcctccatgggttctcccttctctgcttgttttttgagcagcagcagcaccagcagcctatgtttcagattatctttccaatgatgttggtatcattgggagacagtatgtccctttaggcagtgacaggtttgtttatcactcattattcaaaaatttgaatttcctaagggcagaattcttaagattttattggttgtactatctttctttctctttctttttttttttttttttggagacagagttttgctctgttgcctagactacagcacattgatgcaatcttggctgactgcaatctctgccttacgggttcaagcgtttctcatgcctcagcctcccaagtagctgggattacaggccagtgccaccattcccagctaattttgtattttgttttagtagaaacaaggtttcaccatgttggccaggctggtctcaaactcctgacctcaagtgatccacccacctcagccttccaaagtgttgggattacaggtgtgagcctccacgcccagcctggttatacattctgcttcatttttaaaccgcattcttctggcagttccatggatttgaactctgtttggaagccatttcttaactgtagacttaattttaagactttgaaaaccatcaagtttctgtttaaacagaaagaattcctttctgtttaatagtactctcarctgaactctattctttttacattttactacaagcagcaagaagaaatcaggctgcaccttcaccactgtgtttagaagtctacttagccagatcaccctgttcacaaggaacacttcctactttctcgttagagaaggtgataatgttgctaagctttgtgtcactacataataagcacgctcccttccagtttccactcacaatctgtgcagtgcaatttagtcttgctccaatacactcttcggaatcctagccttcgcccactgcctgtttccaagccacttccctgtttttttctgtatttgttttggcagcatccctcttcaatttgctgcattacaaactaccaccaaaacttagcaacttaaaagaagaaatatttgtacattaccgtgtctgtgggtcaatttagctggatgcctctgactcagaatctctcccaaggctgtaagtgaggtgttagccagagccgtggtcatccaaatgctccactgggagaggatctgcgtccatgctcactcacagctgttggcaggactgagaagacccacttccaggctccctcatgtgacctggcaggcctcaggtcctcactggctgttggccagaaacatcagctccttgggatgtgggcctctccctgctcataagatggcaacttgcttcccaatagtgagggctgagagagagagagcaagaggacaaaagaggcacaaatcacagtctttttttttcaactaatctgagaagtggcattccattacttttgttgtattctggttgttggaaatctgtcattcagccctcactcagtgggaagggattatacaagggcatgaacacccagaaagcaaggtcattggggtcattttggagtctgcctcctatagtaggaaatagagtcccagcttctggagtatactttctaaaaggaaggggataaaaactaaagaatggatttgagttgtcggaaaatattttattggcaaataatgatttttttggtcaaaattttaggaagaataatttttcagcaatattaccaatgacctgacaaggtgagagcctgaaggtaaggaacacagacgccatatgagtaatctagagaaggattttagatgtttcttgagtgggtgactagacaatgagaatggagtgaaaaatcaggaaatattctttttttttaatatatataaactttaagttctagggtacatgtgcacaatgtgcaggtttgttacatatgtatacatgtgccatgttggtatgctgcacccattaactcgtcatttatattgggtatatctcctaatgctttccctcccccctccccccacccacaacaggccccggtgtgtgatgttccccttcctgtgtccaagtgttctcattgttcaattcccacctatgaatgagaacatgcggtgtttgttttttttgttcttgcaacagtttactgagaatgatggtttccagcttcatccatgtcccaacaaaggacatgagctcatccttttttatggctgcatagtattccatggtgtatatgtgccacattttcttaatccactctatcattgttggacatttgggttggttccaagtccttgctattgtgaatagtgccacaataaacatacgtgtgcatgtgtctttatagcagcatgatttataatcctttgggtatatacccagtaatgggattgctgggtcaaatggtatttctagttctagatccttgaggaatcgccacactgtcttccacaatggttgaactagtttacagtcccaccaacagtgtaaaagtgttcctatttctccacatcctctccagcaccttttgtttcctgactttttaatgatcgccattctaactggcatgagatggtatctcattgtggttttgatttgcatttctctgatggccagtgatgatgagcattttttcatatgtctgttggctgcataaatgtctacttttgagaagtgtatgttcatatccttcgcccactttttgatggggttgtttgtttttttcttgtaaatttgtttcagttctttgtagattctggatattagccctttgtcagatgagtagattgcaaaaattttctcccattctgtaggttgcctgttcactctgatggtagtttcttttgctgtgaagaagccctttaatttaattagatcccatttgtcaattttggcttttgttgccattgcttttggtgtattagacatgaagtccttgcccatgcctatgttctgaatggtattgcctaggttttcctctagggtttttatggttttaggtctaacatttaagtctttaatccatcttgaattaatttttgtataaggtataaggaaaggatccagtttcagctttctacatatggctagccagttttccatttattaaatagggaatcctttccccattgcttgtttttgtcaggtttatcaaagatcagatggttgtagatgtgtggtattatttctgagggctctgttctgttccattggtctatatgtctgttttggcaccagtaccatgctgttttggttactgtagccttgtagtatagtttgaagtcaggtagcatgatgcctccagctttcttcttttggcttaggattgtcttggcaatgcaggctcttttttggttccgtatgaactttagagtagttttttccagttctgtgaagaaagtcattgatagcttgatggggatggcattgaatctataaattaccttgggcagtatggccattttcacgatattgattctacctatccatgagcatggaatgttcttccatttgtttgtatcctcttttatttcgttgagcagtggtttgtagttctccttggggaggtccttcacatcccttgtaagttgggattcctaggtattttattctctttgaaccaattgtgaaagggagttcactcatgatttggctctctgtttgtctgttattggtgtataagaatgcttgtgatttttgcacattggttttgtatcctgagactttgctgaagttgtttatcagcttaaggagattttgggctgagacgatggggttttctaaatatacaataatgtcatctgcaaacagggacaatttgacttcctcttttcctcattgaataccctttatttctttctcctgcctgattgccctggccagaacttccaacactatgttgaataggagtggtgagagagggcatccctgtcttgtgccagttttcaaagggaaggcttccagwtttgggccattcagtatgatattggctgtgggtttgtcataaatagctcttattattttgagatatgtcccaacaatacctaattcattgagagtttttagcatgaagcgctgttgaattttgtcaaaggccttttctgcatctattgagataatcatgtggtttttgtctttggttctgtttacatgctggattacgtttattgatttgcgtgtgaggaaccagccttgcatcccagtgatgaagcccacttgatcatggtggataagctttttgatgtgctgctggatttggtttgccaatattttattgaggatattcacatcaatgttcatcagggatattggtctaaaattctctttttttttgttgtgtctctgccaggctttggcatcaggatgatgctggcctcataaaatgagttagggaggattccctctttttctattgattggaatagtttcagaaggaatggtaccagctcctccttgtacctctggtagaattcagctgtgaatccgtctggtcctggactttttttggttggtaggctcttaattattgcctcaatttcagagcctgttattggtatattcagggattcaacttcttcctggtttagtcttaggagagtgtatgtgtctgggaatttatccatttcttctagattttctagtttatttgcgtagatgtgtttatagtattctgtgatggtagtttgtatttctgtgggatcagtggtgatatcccctttatcatttctaattgcatctatttgattcttctctcttttgttattagtcttgctatcagtctatcaattttgttgatcttttcaaacaaccagctcctggattcacggattttttgaagggttttttgtgtctctatctccttcagttccactctgatcttagtgatttcttgtcttctgctagcttttgaatgtgtttgctcttgcttctctagttcttttaattgtgatgttagrgtgtcaattttctatctttcctgctttctcttgtgggcatttagtgctataaatttccttctacacactgcaaatgtgtcccagagattctggtatgtagtgtctttgttctcattggtttcaaagaacatcattatttctgccttcacttccttacgtacccagtagtcattcaggagcagcttgttcagtttccatgtagttgagcgattttgagtgagtttcttaatcctgagtgctagtttgattgcagtgtggtctgagagacagtttgttataatttctgttcttttccatttgctcaggagggctttacttccaactatgtggtcaattttggaataagtgcgatgtggtgctgagaagaatgtatattctgttgatttggggtggagagttctgtagatgtctattaggttctcttggtgcagagctgagttcaattcctggatatccttgttaactttctgtctcgttgatctgtctaatgttgacagtggggtgttaaagtctcccattattattgtgtgggagtctaagtctctttgtagatctctaaggacttgctttatgaatctgggtgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccttttgcttagtggatcttcctccatccctttgttttgagcctatgtgtgtctctgcacatgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcttagcctcgatggtctttacaatttgtcatgcttttgcagtgggtggtactggttgttcctttccatgtttaatgcttccttcaggagctcttgtagggcaggtctggtggtgacagaatctctcagcatttgcttktctgtaaaggattttatttctccttcacttatgaagcttagtttggctggatatgaaattctgggtttaaaattcttttctttaagaatgctgaatattggcccccactctcttctggcttgtagagtttctgctgagagatccgctgttagtctggtgggttgccctttgtgggtaacccgatgtttctctctggctgcccttaacattttttccttcatttcaactttggtgaatttgacaattatgtgtcttggagttgctcttctcaaggagtatctttgtggmgttctctgtatttcctgaatttgaatgttggcctgccttgctagattggggaagttttcctggataatatcctacagagtgttttccaacttggttccattctccctgtcactttcagataaaatcaggaaatattctgataacaaaagattgaaaagaaaattttgaatgagttgataagtgggagaaaaaaataaatatatatgctgggccaggcatcattttggatattttgcatatttcatttcttcgaatcctctcaatatcctatgagattggtatcttttacaccattttatagaagagaccacaaaagatacaaactaaatgacttacttactgttatgcaactgggacattaggatttttctctcttctggccctcatctctccaaccccaaatgctttttttgttgcattagtttatggtgttgtcctggagaaataagggatggtgaaaacmatcataatcataacgtcatgcagtcagttagcatattctaggcactgtggttaactctttcatatcactacaatgaattctcatagcaacctctttaaatgaagaaggtgctgttatttccattttatagatgaggaaacaacattcaaagagactaagtgtactaacattataaaattaggacacacaggagtcactgacaaaaaaatggaaagagagatgcttcggcagagagagggatgtttttgccgaaaggcctctggatggttggtgcagatttaggaattttaaacattaaaatgtgagtttgacgttttcctcctccagggaagaagcagctctcctttattctctcacagaagtgcgtctgaaaatacatagcaccaaattcaaatccggtaaacaaattccatcaaaaactgcataattaaggctatttttgtgattagcgccatttagtttccctgaatttaccagagcaaacattgctacagcaaaaattactgctaatggttgaacctaacaacaagagaaaatccccagaagggtcatttaggccccagctgcagctgtgtttcactatatttcatcctggaaagctgagattaacaggaaaatcaggctctactgtgctatgcagatgtggctacaactatctgaatttattcagcaaacatttgttcagtgcccactatatgccaagcaatgtactagccacaccgggattgcagggataaattgtacctggcactctctaggaatgttcagatgaaagaagttgatgagagaaggcagatatagaaacatcaaagcattatgagtgatgtcagctatacagtgggagcataaaggagtgaattaggagagtcttaagggcagcagcttcacaggatgttctcatgtacacggttattcatcttgaatccttggggcaggttggggccagtaaatgaggaggacagaggcatggaagttttcttgggcttgggtagaagctggtgcctaccccaamctgggaatataagtagaggaacaggtatatatagaggaaaggaaaagttttacttcagaaatgaccaatttgcttataaaagattcatgtgttgaggtcttctaggaacttacatttatgagaccaaagtttagcaaatgtggttacaagatacagatgagaaaatcgttagcattttgctattgcagtattttgacaccagcagcagcaacaatagcggtcactcgttttgagcacctaccatgtgccagmccttgtgttaaatacataggcaccatctaacttaatcttatgacagctttcttatgctaaggaactgttttgtccttactttatagatgaaaagattaaagcttagatatagacgctaattcccaatgtctcaggaccaggacttgaacacagttctacgtgacttcaaaaccaaaatcctttcattgatccccacttaaccaactccccaatataacagatactctctgttccttctgcaaaacctagactgatatctatagctctcatgagtgtcccaggctctagtatgtctacatacgtctcccactagtcaaaagttatatgtttaccaagagacacaacctgttggttgtacttgttactataattatgttattttataaaatattaagtgatgtaatatgtgtgtaaatgaagttgttgtatctatgaaaactaaatacagtgctttgggaagatttaataaagactggcagctcaagaaaattaggtatgagaaggaaatataaaagaggggaaaaccataaaattctatagaaattttgcattcattttgccttggaaggatctttttcatctgttttaaagatgctacagtaatttcatacactatatgttatggttgtagtttatacaagagtgcataaaatgtcagtcagcagacccataagccaagaggaagacttggccctgcaattaaaagatgagcaaataaatgaatacttctgtgatttaagttaacataaaatggtatgcatatgtgtgtgtgttcgtttgtttgtcagcgattcctctctgtattgcaattaacccacaagtactgctcccgattctttcaaaggggaattctatattcttgtccagggtaagcatattatgagagaagagaagaggacaagaactttggagcccactatacagaggtgcaagtcttcaaagtgaattcagtgataatgtttaaagccgtggaaggtgaatttcaatacaacaggattatccacccaggtttggggatgggatcattaaaaaatatattcccaatttttttttctgcagaactttagtttctgtagactggaagcatcatagcataaaagaaggagcatgggctttaaaatatgttgaatgcagcttcaacaacttaattaattgaccttaggtatggtctctgagtctcagtttcctcaaattaagatagtatggtaacacccatatcccatagttgttgaggaatgtccaatgctgggcacacagtaagttgcaaaagtattgctcttcattttttacccctttgtgtggggctactaaaaatatcatatattaatcagaaaggtaggtaaagacatgaaagggaaaatttactatctctgtcagttttttacccaaaaaactgttactgccacatttgaagtggatttgcgtgttaggacaaagaatttcaagagtctctggttacttgaaagatttttaatttgaacagaaatagagctagataccaatggaaatactttgttatagtaattttgggttttgttggttttgggtttttttggtacaacattgttcatcttcctttgtaaatggcagatttaatccaatctaattttgcggtttacaacattctgctgacacattccatgttacttattttatttgcagtgtaaccacaaaaataatttccattttcaataaagataaaatattagaagaacctatttttcttagtccactaagtgtaacttttttatttccaggtatttatgagattctgtagtaaatgtatcatcctaaagcctatttaaggttggaatggcaaatgatcagcaagagagagttataacataatgttttaaacatgccatccttagcctataataagtaataagtagaatcaagacagcaaaagacatatttgtcctcaggatgcttataaggctaattggagaaagaaggcattagtaaatgaaaagatgaaatgagtgataagaattttaacagtactgcaggtaatttgggtattgggaaggagaggatactggcaaagtccacaaaagaatcaagaagaacgcttaacaacgtatgtttattaagataattttcataatgaaagtatatatggatgacaaagtgcagctaaaaggtaagaattgcatatgttatgcataccctaatcctgttattcacagtaaggttgttagtataatatactactgccttcttaacaagtgaccacagttcattttcttgatattgaaaatctccttaggaagttctgtctattaccaagttaatgcattggcattcttggatttattcttttaaaaatatttgctgagatcctgttatatgtcaggtcccatcctaggcacatatttatattaattctctcacatgtagtgaacaagtatttattttcaagctagcaaaaggaaatcaaattgttcatttcaactcatgtttaaaacgtgccacattgttagggcttagtcatactttaaatttagcataagagtttcttgagtcattcaatgctgtatatagtgagttctatatacctggtttaagccttcataataaaggcttgggttttgctgccatttgtaatgatagggttaaaaacaagtacacagttttatacctctatatgaaaatttttcagcaaggtatcttgagattatttacttgccagtcttgctgcattcctattaattaacttcactggaatttaccaagtatttgttggttctagaaatgggtatgaacaggagatgaattgattcaagaatacaaaagaaaaaaaaaagccaaatctggaattagagttttttaagatttgtaggatctcattgtgctaataaataagtacaagctatctgaccaaccagctcccattcttcagctaccttcacctgccagtggcaaagacacttgaattggtatttatagtttagacattttcagactgatttctacagagatctagagttccaggtactcaggagatacataggatccaactggaggccaccaacctcttttcctttcagtcaaatcacctgtgattatatttggggaaagtaaaggttccaactaacctgtaaccagtttggaaaatcattgctccacatggaatattctgagcttacttctgtacacagatgccaccaatgtcaagttctccatgataatagcctctgtgtggggaggtagagtgtgaaggatgctgtggcagtgtgttcatcatggttgatgaccttcaaattccttactagaaactgtgtctactttcaggctctgcaatttagagaaatgtggaaaagttggagagaaatcagagcacaaccacaaagacaattacagcaaattaccttggaggcaactagaattattttatttgaaaaagagaaatctgaaggcaatttaataatggtctttcagacattgggaattattagattgggattaaggaccagatttccttcacgtgcaaacataggtggggggaaaggggaagtgaggggctcctgctttggcaggaagaatataatacagaatcaaaagaaaaaaaaacagcaatcagatgctgagcctatttactcaaaggaatagatcattcagtacaccgttcatggaagttttttaaaggcaatatgaattcctgtctctgttttatgtgttagataacgtgctacctgaaggaacagggatgagttcaatgaactttgtttttttaaccctgtcagtgatttatctttaaattatatcataaggtatagatttcaaacaattattttgaattacagtatcatagcttgatgctgccaggagaggatctactttctaataaagttaaggaagttagtggcaaagaggaatgtttattccaggggtcaggaactcagatacctacagggacaggtgggtattacaaaggagtgaagctaacaatatagaactatatgacattagaaaaattgtggggtattagaaagcatataactcttctaaaaggggcaaccactactaactggccaattgttatcatgtcccaatatgcctaatattaacggatgcttggctttctcaaggaaagctggaaatctagaactttatgtgaaacatttttctcacattgacagaatactcagatttgtaaatgtgctaggcaggcaaaacaatacacttggtgcaggctgcaagttagaaacctttggtttattctttagctcactagttcaccacaataattaacaagcaaacaaaacagaactgtttgaactctaacgcttaggagaattaatcagctaaacctttgcaaggcttaattaaggtcccttccaactctgtgattcattaaactccccttcccttttcattgctctcagtattgggtggcgtattcacaaagagaatttaaagaaatgacttatttccctcagcaacataattttatttggtaaaataatcaaatrctcagaaaaaacaactcttgtttctgtattaaagatgccactgayactagtagatttttagaaacgcacttgtatatggcataggtttgtcactttggatctttaaactaacatttgtttataacattggctgcatgaggcatgcttggctgaaaaacctacttacacttttaccatttgggtacatgtcttacttgtcttttataaaatattttcaaataactcacctccacctggggtaaggacagctggatttctgaaatccccttcctttcagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagaggtatgccactaagctgcaaaatatttctttatgcctgtccatttcattaagtatatatttctgttcaaataatatattaagaataatcagtttgcaaatcaaagctttttaataacaggttgtcttgagtctcattgaatttcaagtagaatttaagtagatctcgttccacggtcattgatttaaacgcttatttgtcatagtgacatacctgtagcccataatttcaagcagtaacttaaatgtgcagttttatgatgtttaagttatattttttcagttttacagaagttttggtaactagtgataagcttttctctcaaggcagagacttcctaaaaagtctctttttgtctttctgttcatgaaataggtttctaataagcatcagatggcatacccaaagggtttacttgaagagagtttaatacacagactttgaacagagttaatagtactaacaaggggtggtgaagtgcacagggactggcaacagcaggaggctgttaccatcaacatctgcagctttataagatgcacagccactggtaaaagctgcatccttggggcaagggtaagaatacaccctgactctgctttccttttctgctgatgcttccaaacccaggcaagggagtatggtgatgcagtctcagagtttgaagagatcagactcctgaggcaatgtgctctcagagaagggccaagaatagaaccttgggagaggaaatgtggataactcttccaaagtagcttctcagaaccatgacacatgtaaaacagaaacagtgattaataggtcccaaagcagtttatctatccttcattgttttggaagagtatcctccatcattgaagagaaatgtgtcattatttacaacttgttcatttcttctaaagactttctaaattaactgatatcttcaaaccaaagagcaatgcagaaaaagaaaaggtctgcagaaagtggctgagtgggagaaagaggtgtaatctagttacctgtttctctgcagcccttatttggycaaagaatataagttatcaagaaaagtaggtagatgacttgttctctaagaatattttaactcacaacccaactttaacaaatattgaaggcagtgagatcaaaatagtattccctggcgaaagcctataatacagctctttcattttaccagttgagtatgacccctagtctttggtagataattgagctggaagaagggtccacattcttttatgggaggtgaagagcctacagggcacagataatatatggaaagttatatcttccattttcaaaattgagctaaggactcaaagttccataaatattgttttaagcatgcaccattgtgtagagtgatctagaccaggggttagcaaattatgatacattgtccaaatctgggctactttttataaataaagttttatttgaacacaagcatgcccatctctttattgtttgtggctgataacatactacaacagcaaagttgagtagttgcaatagagactgtatggcctgcaaatcctaaattatttgctttctggccctttactgaaaaatgttactgaccctggtgtagactgctgtgtgatctcgattcattctgtgtaatgtggctgatttatttttagcttgagtaaccagatctgtaactttattttagttttggtttctaagaattggaatttcatcctcacctcaataacaggcaatatcacatcgttccacttaacaattcttttatcctcttttgttttacatttaacattaatatattcatttcttcagaatattgcccctgtgtatcacctgtgtggcactcttttgtgacatttgtatcttgtacactgtcactatcatagtcttaaatttctttatgtgattaatatacatgtccaaataytatatagcactgggcacttttcacaggatcatccacaaaacttggggtgagtgtgaaggatcatattgtattagagtctttacaaagtttcatgttacaggattgtcttaattattttaagcaaaagtatgtgttttactactcgggcaaaatacattagactgacattatctcaatcagtcatactttgggcctgttttgtatctatcttcctgctaaactcaaagctcgcatgtttttgcttattatcatgtcctcagtctttgtacaattcttggcatatagttagtggtgaaatatttatggaatgaatggtgtcaaacatatactggaatttgttgtatgatataagacatgtacccaatttaatgtttccaaatagccaacaaaagttggctagcccttttattaaatgctcctttaccaatttccctttggtgggagggccaacattattatctaaagaatttgtgcctttaccttctgaactgcttatggcttcatagtctgctccatcttctcatttttcttcagtgcaatactattagaatatacgtcaatattgatgagctaagtcgcatcattccaacttttcaaaaatgcctttatttttcaacttattcaagaaaatatttgaatcactttataaatacccttgaaaaatacgctgcattttttgttgtaattatgttaaactagtaaatttctagagaactggcattttaaaaatcacatcgaatcttttaatccaagttcatggaatatatttgtttaattcaagccttttttctcatcctccctaaaattttatcgtgccctttattcattatataagtcacatacatacataagttacctaagtatcgagctataagtaacaggacatattactggagtgggttaaataaaagctgccacatggccagtcatgctggctcacatctataatcttagttctttgggaggctgaggtgggaaaatggcttgagctcaggagttcaaagttacaatgagcaatgaaggttgccacagcactccagcctgagtgacagaaccacacaagaccccatctcaaataaacaaaaactgggaggattaagatggcaggtaggagggagaactgctgcagcttctgcttggttggacagaacagcatgtggagactcacattgtgaacttttgccccaagaactaccacaggaaaataccaggaaagccaagagaatccacagaccttttgaaggaactggatcascgctgcaggctccctaaaatgccaaaaaagtgtgagtctgcttgctttctcaacagggaagctcgtgatttagggtgagttctcagccctggtcataagctgcctggaaatagacttggtgctgttgtggagggcacggtgggagtgagactggcctttaggactctgggctgcgtgggagcagagtgaggcctatgacttccggctttcccccacttccctggtggcgtatatgactcatcagaggcagccataatccccctgggaatataactccattggactgggaaccacaacctcctcccccacagcagccatagcaagccccaccaaaggagagactgagctaagacactcctgtccctcccccaacctggtggtcttactctacccaccctggtagctgaagacaaaggttataatctcttgggagctctgtggccctgctgactgcctgagaaacctgaatacttgaccaggtgttcctagggcaaatttgcatcctccctataggaccccagctcatgtgctcttgaaagtgccaactcctggctggaatccaaccaatacaagaccagcacactcaataaaaataacaaccaaggaccctgcagagtccacttcactcccttgctacctccatcaaagcaggtgctggtatccatggctacaagacctgaagatgaatcacatcacagtactctttgcagatactcccaagtaccagtgcagagcctggtagctccactgggtgctagatccagaaaagcaaaaataatcactacatttcagctctcaggaaaccccattcctagggtaagggagagaacaccaaatcaaggcagcacactgtgggacaaaagaatctgaacagtagcccttgaatcccagatcttccctctgatgtagtctatccaaatgagaaggaatcagaaaaacaattctggtatatgacaaaacaaggttctttaacacccccaaaagatcataccagttagccagcaatggatccaaaccaagatgaaatctctgaattgccagaaaaatattttagaaggtcaattattaagctaatcaaggaggcaccagaggaaggtgaagtccaacttaaagacatcaaaaacataatacaagaaatgaaaaaagtttttcagtgaaatagatagcataaataaaaaaacagtcacaacttctggaaatcaaggacacacacaaatgcaaaatgcactggaaggtctcagcagtagaatcaaacaagcagaagaaagaacttgaagacaaggctttcaaattaacccagtccaccaaagacaaataaaaaagaattttaaaaaatgagtaaagcctccaagaagtttgggactatgttaaatgtccaaactaaaaataattagtgttcctgaggaaggagagaaatctaaaagtttggaaaacggatatttgagggaataattgaggaaaacctccccaaaacaaagagaaacaaatcctcgaaatacaccaaaatagaaccttcttcaagcataaatctcacaggacctttataacaatagcacaatagaaaaaaaggtattcaagcaataaatagcacaatgagtagaatagtacctcacatgtcaatactaacattgaatgtaaatggcctaaatactccacctaaaagatacagaatggcagaatggataagaattcaccaatcaagtttctgctgtcttcaggaaactcacctaacacgtaaggactcacataaacttaaggtaaaggggtggaaaaagataccgtatgcaaatggacaccaaaagcaagtaggagtagctattcttagacaaaacaaactaaagcaacagcagttaaaaaaagacaaagagagaaattatataatgataaaaggactagtccaacaagaaaatattacaattctaactatatttgcagctaacactggagctccgaaatttattactgttagacctaagaaatgagatagatggcaacacaataatagtgggggactttcatactctactgtcagcactagacaggtgggtcatcaagacagaaagtcaacaaagaaacaataggcttaaactataccctacaacaaatggacttcacagatatttgtggaacattctacccaacaattgcagaatatacattctattcatcggcacatggaacttctccaagatagaccttatgataggccacaaaacaagtctcagtaaatttaagaaaattgaaattatctcaagttctctaagaccacagtgaaataaaattggaaatcaactctgaaaggcaccctcaaaacaatgcaaatacatggtaattaaataaccctgctcctgaatgattgttgggtcaacaatcaagatggaaatttaaaagttattcgaactatatgataatagtgacacaacctgtcaaaacctctgggatacagcaaaagcggtgctaagaggaaagtttatagcattaaataactacatcaaaaagtctgaaagggctcaaactgacaatctaaggtcccacttcacagaactgaagaaacaagaacaatccaaacccaaacccagcagaagaaaagaaataatgaagatcagagcaaaactaaatcaaattgaaacaaacaaatgcaaaagataaatgaaataaaaagctggttctttgaaaagataaataaaattgatagatctctagcgagattaaccaagaaaagaagagagaagatccagataagctcagttacaaatgaaacgggagatactacagctgataccacagaaatagaaaagatcattcaaggctactatgaaaacctttacaygcataaactagaaaatctagaggagatgtttaaattcctggaaatatacaatcaccctagattaaaccaggaagatataaaaatctctgaacagaccaatagcaggcagagagattgaaatggtaattaaaaaaaattgccaacaatgaggaaaggattccctgtttaataaatagtgttaggaaaactggctagccatatgcagaaaactgaaactggaccccttccttacaccttatacaaaaattatttcaagatggattaaagacttaaacryaacatctaaaaccataaaaaccctagaagaaaacctaggcaataccattcaggacacaagcataggcaaagacttcatgactaaaacacaaaaagcaatagcaacaaaagccaaagttgacaaatgggatctaactaatctaaagagcttctgcatagcaaaagaaactattatcagagtgaacaggcaacctacagaatgggagaaaatttttgcaatctatccatctgacaaagggctaatatccagaatctacaaggaacttaaacaaatttacaagaaaaaaacaaccccatcaaaaagtgggctaaggatatgaacagacacttttcaaaacaagaaatttatgtggccaacaaacatatgaaaaaaagcttatcatcactggtcattggagaaatgtgaatcaaaaygacaatgagataccatctcataccagttagaatgacaatcattaaaaagtcaggaaacaacagatgctggagaggatatggagaaataggaatgcttttacactgttggtgggagtgtaaattagttcgaccattgtggaagacagtgtggtgattcctcaggggtctagaactagaaataccatttgacccagcaatcccattactgggtatatacccaaaggattataaatcattctactataaagacacatgcacacctatgtttattgcagcactattcacaatagcaaagacttggaaccaacccaaatgcccatcattgatagactggataaagaaaatgtggcacatatacaccatggaatactatgcagtcataaaaaaggatgacttaatgtcctttgcagggacatggatgaagctggaaaccatcattctcagcaaactaacacaggaacagaaaaccaaacaccacatgttctcactcataagtgggagttgaacaatgagaagatatgggcacagggaggggaatgtcacacaccagggcctgtcagggggtggggggcaaggggagggatagcattagaaatacctaatgtagatgatgggttgatgggtgcagcagcctaccgtggcacatgtatacctatgtaacaaaactgcatgttctgcacatgtatcccagaacttaaagtataataaaaaaaagaaaaataatgtaaaaaattgccaacaaaaatagtccaggaccatacacattcacagctgcattctgtcagacattcaaagaagaattggtaccaatcctactgacacttttccaaaagacagagaaagagggaatccttcctaaatcactctctgaaactggtgtcaccctaatacccaaaccgggaagggacataacaaaaaaagaaaactacagaccaacatccctgatgaacatgggtgcagaaattctcaacaaattactagtgaactgaatccaacagtatatcaaaaagataacctaccatgatcaagtggatttcataccagggatgcaggaatgatttaacatatgcaagtcaataaatgtgatacatcacataaacagaattaaaatttaaaaatcacatggtcatctcaatagatgcagaaaaaagcatttgacagaatccagcatccctttatgatgaaaaccatcagcaaaataggcatagaagagacataccttaaggtaataaaagccatctatgacagacccacaaccaacattatactgagtggggataagttgaaagcattccccgtgaaaactggaacaagacaaggatgcccactttcagtacttgcattcaacatagtactggaagtcctagccagagcaaacaagaaaaagaaagaaagggcatccaaatcagtaaagaggaagccaaactgtcactgtttgctgttgatatgattgtatacctaaaaaactataaagactcatccaaaaagttcctagaactggtaaatgaattcagcacagtttcaggatacaaaattaatgtacacaaatcagtagctctgctatacaccaacagcgaccaagctgagaatcgaatcaagaactcaacgccgttcacaatagctgcaaagaaaaataaaatacttaggaatatacctaaccaagaaggtaaaagacctctataaggaaaactacaaaacactgctgaaagaaatcatagacgacacaaacaaatggaaacacattccatgctcatggatgggtagaatcaatattgtgaaaatgaccatattgcaaaaagcaatctacaaattccttgcaattcccataaaaataccaccatcattcttcacagtaccattcaggactaaaattcatatggaaccaaaaaagagcccacatagccaaaggaaggctaagcaagaagaacaaatttggaggcatcacattacccaacttcaaactatactatcagtcaccgatatagcatggtactggtataaaattaagcacatagaccaatggagcagaatagagaacccagaaataaacccaaatatttacagccaactgatgttcgacaaagcaaacaaaaacataaagtggggaaaggacacattactaacaaatggtgctgggacaattggcaagccaggtgtagaagactgaaactggatgcttatctctcaacttatacaaaaatcaactcaagatggatcaaagacttaaatctaagatctgaaaccataaaaattctagacgataacatcagaaaaactcttctagacactggcttaggcaaagagttcatgaccaagaatccaaaagcaaatgcaacaaaaacaaaggtaaatagatgggacgtaattaaactaaaaagcttctgttcagtgaaagaaacaatcagcagagtaaacagacaatccacagactgggagaaagtctttgccatctatacatctgacaaagaacgaatatccagaatccacaaagaactcaaacaaatcagcaagacaaaacaaacaatcccatcaaaaagtgggctaaggacatgaatgaatagacagttctcaaaagaagataaacaaatgtccaacaaacatatggaaaaatgctcaacatcactaattatcagggaaatgtaaatcaaaatcacaatgtgataccacctcactcctgcaagaatggccataatcaaaaaatcaaaaaataactgatgttggcatggatatggtgaaaagggaacaacttttacactgttggtgggaatgtaaactagtacaaccactatggaaaacagtgtggagattccttaaagaactaaaagtagatctatcatttgatccagtggaaaagaactcattgtatggaaaagatacttgcacatacatttttatagcagtacaatttgcatttgcaaaaatatggaaccagcccaaatgcccatcaatcaataagtggataaagaaaatgtggtttatatgtaccatggaatactactcagccataaagaggaaagaaataatggcattcacagcaacctggatggaattggagactattattctaagtgaagtaactcaggaatggaaaaccaaacatcgtatgttctcacttaaatgtgggagctaagctatgggtacacaaaggcatgagtgatacgttggactttggagactcaagtgaaaaggtggggtggcaagaggttaaagactacacattgggtacagtgtacactgctcaggtgatgggtttaccaaaacctcagaaatcaccactaaagaattttttaatgtaaccaaacaccacctgttccccaaaaacctattataacaacaacaaaaaaattttaactgccacaaagattatatttgcttcaatataaattaggaagtttttccgyatttttttattttcagaaattacttttataaaagagacttaatgatgtagataagatagaaagtwccgttcctggaagtttgttattattcagcttttaattcagcatattaaaggtaatgacagaaaccacaattacttttgcactaaccttatataaaccatctgtgcattagtggaggaatattttaagtacctttcataataattattactctgttcaagttttcaatttcagggggacgattttggtattttgcatttytcaagaaatktagatatttcctttaggctattatacttattaacttatatttttataaaataatttttaagtattgaagtattttatatttataagtagttatcccttttatattctttcttctctttatttgaatatttttacttttttaggtttttttgtagaattttatctgtcattctagctttttagttcctaattgtttcttctttgattaaaaaaagaaaaaaaacaaagaccaatatttcttttttctttcttctttttttcttcttggttgattaattgcacttagtttatttatttttaataactcttacattctgacacctgtactgatttttttctgaatattgctttaactacatgtcacaattttttacagatagaatgccattgttatttatatgtattttttcttgcaattttctttttaacaaaagaatgatatagtgttttttttcattttccagacatgtagaactttattttgctatattgtgttatgggttgcaactttattgcactctgatcagaaaacatattccatataatagctattgtgtagaattttttaagatattttatattaatagcttgatacataaacagtttttatttaataatcctcatttatgcaaaaagcacccttgttccatatttagatgtgaagtttatgtgtgtgtatgtgtatatatatatatatatatttttttttatggttttttgttttttttttgagatggagtctcactctgtctcccaggctggagagcagtggtgccgtctcagttcactgcaacctctgcctcctgggttcaagtgattctcctacttcagcctcccaagtagctgggattacaagtatgcgccaccacacccagctaatttttgtatttttagtagagacgtggtttcgccatgttggccaggctgttctcaaactcctgacctcaggtgatctgcccaccttggcctgccaaagtgctaggattacaggcatgagccaccatgcccagccatatttttttatatataaataagattaataatacaaacacatatacacattttttctgtactatggcttatattttgtctatttgatctaccaaatctgaaaaagcatatattaaaatcaccagttaccatcatttatttcttcctgtaatcctaccagtggtagttttagatattttacatctttgttgttaactgcatatatgttgaggattattacaacttctttatttataatatctctcttgtcctttatggtgcactttgtcccaaattatattttgtctcataataaaaaattaactctggctttcttttgctttatatttgtttcacagcatctattttttccatcttatgtatgtattttttccaacttatgtatgccaccttatttcatattttacaatgtccattcttttttcttatttcttttttaagtctttctacctacttgccattaggtacatcaaattttcatctgctgctttaaagttatacatttgtattttattaccttgacttattttgacttagtcttaggttattttttcctggcaatatataaagcagatcaatatctatgtctttatcgtttaacaaaataatacccatagcataccatcctctacctctcctcttgttgccaactttttgtatttcaggagttttagttacatatatttgtaagtgtactttttacaaaataattagttccagctcacctatacttctttctgtccaactgtaatgggattctggtgctgccctagtgttaattcactattatctctggtgctgcagcttacctaccacattacaccaaaggtttctaccaaaggcaccaaaggataataagttagtgtctaggaggtctaagcttcagggcctgaaataggctatccctgatgtacctccagatacaggcttactcaggttatgtggagaagactaaagattaaattgctggcccccattcctggttactgtactctcctgcttcagatccttagttttccaaagacatctgcaactacttgtgttctgtatgagtttctcatcagctgttttattaattgatgaataagaccctgaagcccatacaaagtctatttttcttttttggcatctccgaagttgaattcaagagagacagggaatagctcatgttagtttgctatgttgtactgcactggcactttccccctccctaactttgtatttttatttattccatcatcctgtttctcttaggaatgtttgattactcatattctaacttcttgaaaccaatgctgaatttattgtcatacttgattgtttaaatatgagagcagttaaaattatgaacctgtctcttattatgcctttgsscacatctcgtttcaacgtgcattcttctcattttcatcacttcataaatagtctatattttttatttttactttcattttctctttgacttgaacaattggggaaactttttaatttgtaactttttaatctatttaatgttttattacattgaggccagataatagtgtcttttcaagtttttctttttttgaatgtgttgcttttattgtagactaatactggtgtttttggtaaaagtgacacgatgtgttttagaccttctggatccatattcatttttccttaatctaggaaattgagaattatatatactgaaattatacctcattgttgtattttgtgtcttacagctttggttatctatgttgatggcatgttgaaagtacataaaatatgacttcaagatttatcaacctttaagtatactttgatgttaatattcttactgctacttttgtttgcagttgctggataaacaccagtgtataagtgtgtacctatttttaacataaacataattgtagcactttgttttatagtagctttaaaataatataatcacctgtggttccagctattcagagggctgaggtgggaggatcacgttagcctgggaggtagaggcttcagttgagtggtgattgtgccattgcaccccaatctttgcaagagagtgagaccttgtctcaaaataaataaacaaataaaaatataatattggaatctgtattttttacaagaaaatttaaccaatttaagtttataattataattatgcaagatataggtgttcccaccttattttatgctatatgtttcttttatgtttattggctttcacactaaggcttgtctttaagtttttgaaaagtgtttaaaaatttaaggacaaaataaaaattaaaatattaaaaatgaaattaaaatttaatttaaaaattaaaaattaagaacaaaatataatttgaattcaaataatcatttgaatgtttcatatggaagattttgatacactcttgggttctaagcgagattattaaaatataattgttacattttttaaaaacttatgtttttggttagttttctaaagatatttacaacagatagttatactctcaggttaatcagtatccactattattccttttaaagaataatttcttcattcttatattctgaattttttctcattctcagagtatatctttaagtaatttgttaagtatttgtggaggatatagtttccatgagcttcccatactgagaatgacattctaattcatttatgaactttttccctgaaaaagtggtagggcaagttttattgttttaagagtgttttaaaggaaaagtctaacataaagcttgcatttggatgcttgtattgttttcaccttgtactttaaaaatctttagcacaatttattgaagtaggccttctttcattgattatttgtctttttaatttgctttcattgctctgtttttgttttgttttcattttagttcattaatgtttccttcagttttttcctatttctgttttttttctagaaatactgtcatcagtatctattacgtttttttatggttttattttgtctttttttcgtgtctgagattgtttcttaaatttgtcttgtcatatcagtgattttattttttatagcattaattatgctttttgttaattttttattgggtaaaatatacatgtatagtttactgtctttaccattttaagtgtacagtttaattgtaattaaatatgcttttaaattcaaattcatttatgctttttagcacttctaacatgacttaattctcttattaaatgtttagtcttcttactcttcattctttctcgcttttctttactttctcttcagcctagaatttcaaaaagtgatcttaaaatatttttttacttatgggatacatcattttcacaagtttacttatttgtgtgttcaagttgatattttctttaccttgatttgcagtatttgttaatagacctaaggtgacctgttttttctttccttatcttgaaatgaaacaaaaatcttttagtaattggttagtcagtaattattcactttttgattatgaatctcatttctagacttagatcaggagggatatttaggtgcctcgtgtccagcccagttgctattttctagcagtctgacatctagggcaattctctgtactaaggtcagatactcccaagtattgccacacagttctctaagttaaagagataaaaaaggtaatttccagtcttcactgctagcaaggcacttactgaagccacccatgtctatataggtctgcagctgaaagtatgcagtgtgccatgcatcagccaccttcctgcatttccccctaacagttgctttctgagcaaatatggaatactgaggaagttagagagcccagtttgaggccccattcctgggcaagacagtaggggttgtccactttttgcttgggacagaatggatctcaagccatcagtgagggtggtacaaagtgtctccctgatgtcagaggggatcttggatagatttttcttaattcaacttcatgactcttttatattctatgaactgttgtttttagttgtggtgttcatttttgattgtgagtttttttgtttttaatgtgattacactggcagtttaatggaaggtacggcgaggctggctcaggaactgttagccaggtaccatttaaagtgactgtccaatttctcccttgccattcctcctcaggagtcacagcaattgcaacaattaaaaaaattcgacatttctcttgaagaaaaaatggagtctaaaagttggtttattttatttatttaattctatgaaaaagaatctagaaaagttataaaatgcatgggataataacattaagttatctttatggaaktttccactaccatgtagggaagctataaattgctgcctacttaatagcaaacagttacttatttaaaaaagagctgtaattacaggccatcaactacatccagcagcagcatcattaataacaagtttatgagtacctacttagggagtgaccttgttagagaatctcacccaatgctacatatgctgccattagtgttaccattcagattagattgtgatattgttcagtcagccagttttagttcattttgcatacatgattccctaagtaaaacactttcgttaatactggatagataccatatgtaaacttttcagcagaaattacaaagaaatatggcaaagcttcatcttaacaccaaaatgtagttaaaaacagctttgatttcttttgtgaagctatattgttgtaggtaagacatacatcactcaaatactcacaaagataactaaaaatttagatcccaatctagaaagcactttataaagttctatgcaaatattagttattgatttgcttttgtaaagcaacagcagaaaatgttgcccttatctgattgtaatatttctagaactagagctctcttaaaacatttcctgcraagatatttttcactttttaaagaaaaatgtttccatgctctcacaggataagtagagagagggcaaaagttcagtctcactatttaagtttctgtgtaaaggatgtttctatttctagcacagttatatttggattatatcgatccggtaatatgagtgcatgttctgtattcatctttttgaaaaaaaaattatacacagcaggtacaccttcagaatgttaaatgaaagctcctgttctcataggaatgtgtatgtttatttgtgctgaaatcctgaggtgcatatctatggctttcatattaaagatgactgaagagatgaaaatgatggtcttgtaagttaaaagacttttacctgcagtccttaaccttttctttttatttatgccctcctaatcccaactcttttctccaaacctagcttctctgaagcccaaaaactccaacaggcatctcaggctctatttctattaaccagccctgttaaccttctatccctgcagtcagcgtgcctgaccattcttgcaaactcttggacctgtactttgaaaaggttattgattcttgacataaatctcttaaacatgtggaaagggaactgctctagaataagaaaactcaaccttttaccaactatgcttcatttgtcgaggtccttcacccctgtgaaaagcaattttcttttcctcatgaaatggagataacttgggtccatcttgctcactttgcttggaaagtagggtccacgtctggacaaacaggccaaagacacatgacatctgatctggctataggaacaaaagactaaacaagccatccagcagcaggttgcctctgacctttctcacagggtgatctggagaattcttacaaggtgtttttattaatctccctgaagtatcttgaaagtagattctatgtcatgttcatgtatcctcagtgattagcatagtacctagcacgtagtctcagtcactaaaggccaattgattattaagggaggtggaggtctgctttctaagcttcattaataataacagcagctgattgagcaccattttgcattcactgtcagaatgctcagagactaccagaagtgatccatggtttccagttggagtaataacttctcatctgagaggttatgatgatgacatatggcttggggtttgggggaagattaaatgaaaaatatatcccaaagcaactggttcagttagatacatggttaagggaggaacagaggtaggaagagtcaaatctggttttgtttccgctccatcacctgtttctagtgggaacttgaaaaggtgtgtgacttccctgagcctctttcctcatctgaaccatgaggttcacaacacctgccctgcctcccccagtcatttgcaatgataaagggagatgattaaaaataaaggggcctacaaatgtaagaaatttagtattagtggaaagaaccatgggctgggatttctaaaacctkgctttggcacctaatagccttccaaggtaagctcactagacacaggtccatactatataaaacaaaaagggttcagttagtgtattttgatgcttttcttgtcaaaagtgatggatttgtagaaattctcttaatrtacatacagaattaaaataatcgcatatttttaattttaggcctcatgtgtactaagaaaatcttgtccattctgaataatgtgaatttacacaattcattctgctttcctatatgtaaagaatttagctatacttagtaacactccaaactttgcgcagttgttctcacctcactgctaattagttcagttccctcctgttatccatttttggtgagatggaaagggtagaatagatcaacatgggctgtttcacagttttacctgggtttgtcccacaatttgtggattaatctagtgtatttattcacaagaaggaaaatattggctcaggacaagaatttctaagctctgcaaccttgacaactaccttcaggttctttgtttcataaatgtcacacctgttgtatgtgaaagggcccttggagttcctcacatctagcatttttcatatgggaaactgaggcccagagaagcaacttatagaagacacagtgatctgagaaaagaaagtccaaaatgccaacaagctgcatgccacgtatttggttaccctacgaggagttaataaaatctgtcacttgcccatagtgcagtgttcactgtggaatctgcccttttgatttcttgtttctctttaaattgaatcagaggtgttcattttacttcaggtgtgacattttacagcagttagcacatttaactgagaggtgaagctggggtaatcatatttgagttattcagatcattctttcttggtcctagctgagtttattgaggacatactatatgctagccactgtgctaagtgctttatatgggttttatcacttaatcatccaataaggaaggttatgacttataaggaactgaattttacaggcaaggaaagtgaaatgaaagaggttaagtaattttctaatgctccatagagtacatggtagaccagagatgaattcaagcagtctaagttaactactcttcatgcttggcacatggttgaaagaacaagaagtatatcttgtcaatagcgattgcaaatcctmtaaaatcacctaagtgtatggattttctggatgccttagcacatagccatgtatgtttgtgtgcatatacattatttgtttttgtagatttatatataaataatgtgtctaatgtctaagtacttttgcccttttttacgttattagtttatactggtgggggagattagccctaatatttattagagggagaaaaagtcatttttacagcatcctgcacatagcaactcttcaacgaatgcctattgaattcatccttattttctaaggaaagtggcaatggatcagaacgagaagatccaggttttagttctggttttaatggtgatycactgtgaggaaaagaccaggttggctgtcttctccaatctttagtcttcccgtgtctaaaatgagttcagaagagcctacagttggagcgtccactgggcattcaagcctatctgactggctagcctggtgtgtcaggattccaaaagatccatccagactaggacttaggatgagtatagacctcatcagtgaaggggtaggaattgcagggacttctgagcagcactgttgtgtctttacaccttcttccaatctagtcattgagaaaacttgtgattaggttccttgccaggtgcactaatactctgagcatctgctaaaggcaggtaagtaagaattgtaccacttgtgctgtggtaagaaactaaaagagccagattttgtgtcttataaaaataacatttccacatagggtcctactctagaaactgttcaagcatagaagcccctaggagccggtgagggtgcaaggagcaatagccacaccagcaagatggccagagtgaccaggtcaggaagaatgtaagcagtgtgagtgcggcagaatcaaactgaaaagtttcaaaatcactctcagcaccaagagcagtaacaagagctgtggcagtgcagacctcatgccttttgcataacaggaggagcactttacaaggaacttaggaaccctcaggttctgggcagttagccacaggcatccaagggggtcgaatagacctgtccttggttcttccatcttccctttatcatccttcccatgtgtccccatgaacttggtaaaaacccaagggaatacaggttgcaaacccaagagagggytgaggtttatgaggtgctgtggtctccacaggttcacattgctagtctgaaaactccacatttctgtccttctgtcagactcactcacttctgataagaaaacctcttagccttacttgattacagtaatagtaaaagtttatggtccctcatgtacagtcttaaatccaaaacgctcccagtcttttttgtaattttgtgtcaaactaatttagtggtacaacctgacctaacaggatgctatttacagtcttcatgtacctcgcttagtgggaatattcatgtttggtggcaaaaataattcatgtgtttttgactatagagtgcctccaaagaccctgctgtggataataagcaatttgtagaagatacatcgtaactacttttctgaagttggaagaatgctgacttccaaaaacatctggccccaaggatttcagacaagaaattgtgaacccataagttgtttttcttaaatttgggagtatttattgatcccctaaggaaacgaatgattcgttcagttccttcttcttcccttacaaagaaaacaaagcggggggagggacaagcaaaacaaatgtaaactgtgactcttattgctaataagctgtggcagaagctgttgggggtctgagtcttcaaaaggagcagatcttttggaggacagaaatctggatctgtacctttcctgcaattaaaagaaaaaaatatgtatcagagatttccccgtgcaactgcagtcctcctcctctctccctttgcagtggagctgctgatcagaatgtgcttgcaactcacaggaccatagcgccacctttcttgcagatttggaataaatcttcacacgtccaggtttggaattaaatcacactatcagctcacttgcctgtgtatgccgttcagttagctagacttagcaaggaaacagttccttgacgctcaaatcataaaggaagagctgcaaagagggcaataaaaagtgttttcttctcttggtccctgagcaattaaaytggtaacctaatctgatgttagggagtatagaccataaactgtgtttaattagtttgcacccagtgtcatttcacacagtagacactttaatttacaacttgctgcactgcagcacttttctaggccttttactatgtaataaggcattcttgtagctgctgaggcttyacaaatatagatacactttcttagttcagattttttctttcttttcaattttcagttgcaaatcaaacatgcagttacagaagcagagattcaaaaattgaagaccaaggtaagcaccgaaacatggtgtttgaattttactttttaaacttcagatactatgaataaatccaatcctaggactaaaggttttgtccctgtatatttgaaagaatgcaaatgtgatagattcattttcactgtcaggtacgtagacaaacctgccagtgagagcaaacacccacatccccctcagtgcaaataacacaatattttagatatatatatttatgtatttgcacatatgtggcctctgagatttccttaaaaagtaatatttttaatggttcaagtatgcaaagtatgttttgattactaattccttaagcaaagctactatatctcctcttcacttaccttattataaatagatttaatcatttgtaggaacaaatttagtatagcacatcaatgttttataaaccatttctaatttctaataattaaatcttataaacttaatacatgcataatttaagtgccaggtactactggaaatttttagttgtttggttcacataatttaaatttgtgggggagaaaaggtcttgataaaagggagtatgtattattagtctatatattttcattgacaaactttaaggcactcgtatgagacacaattctagcaattttgtttagttttatcaaatatacaatttcaaagatttaaaaatatattttaaattacttttaaagcaatattctttattgtttcaatggtcttttaaaaattaaaacataattaccctcccccgcccccaatcaccaccaccactaccactaatgatctcttttgttgttcacattgaacacttgttttggtttctccgtgtgttttaaatggagatgaattagcaaggctattttggttaaatgctattctcagctaattcactctgcagctctttagtcaaaatacgactatacatcattcacggtgttagtccagctccgtgaataataattttaaattagtggcggttgctaaataaacaacttgatacaaaacattgcttaataaaagatgcagtnnnnnnnnnnnnnnnnnnnnctccgcctcccgggttcacgccattctcctgcctcagcctcccgagtagctgggactacaggcgcccgccactacgcccggctaattttttgtatttgtagtagagacggggtttcaccgtgttagccaggatggtctcgatctcctgacctcatgatccgcccgcctcggcctcccaataaaaatatattttaaattacttttaaagcaatattctttattgtttcaatggtcttttaaaaattaaaacataattaccctcccccgcccccaatcaccaccaccactaccactaatgatctcttttgttgttcacattgaacacttgttttggtttctccgtgtgttttaaatggagatgaattagcaaggctattttggttaaatgctattctcagctaattcactctgcagctctttagtcaaaatacgactatacatcattcacggtgttagtccagctccgtgaataataattttaaattagtggcggttgctaaataaacaacttgatacaaaacattgcttaataaaagatgcagtaaataacctattcctgttttaaattgtcattgtctcttgacatagaaagaattgaagattttttaaattgttgttttaaaaagatctctttttccctgtgattgtgttttaatggcgcttatgtattagactatagacatttaacttagaaaatactataaattagcattttatattttttcatcattatattggcatgtaatatccacagattagcactttattatgattctttattattcattttgataatagaattcctaatcttgacattgttttggatgctttctaactttgtaaactgttttgcaaatgtgtttagttaaaaatatttgcaaaaacatagatgtgtgtgtatataaatacatgtttacttttgctaagtgctatatgattttgaacattgatagtttataatgactttgcatccttttgaactttaaagaaggcatataaagtagataaagtaccagtttgaaggccagagagttattgggaatgacttttgagccctcacctaaatgatcagtattggatttctgtagaaatgagggtattagactagtttactatctattcctaagagtccctagaagcagaaaaacaaaaagctggttatggctttctgttccgtgggagggaattaaattaaccaagcaaaaatttatacttttacttacactatcttttatatttttatgggaattgaggtttataaagcttgagaaattcattacactacatgtaaaataatgagctatagaatatgttcatgttccttgaaataaagaatgaaataagatcaccaaaagggttaaaagcagagtgaaagtggttaatgtttatcagatgattcttatgcccaaggagctatttcaagcattctgatgtgttatatcacaattctgttgtatggatgatgtaattgagtcttggagaacttcaattacatgtccaaggtttaatggccaataatgacagaactgggattcaaatccatgctgaatgactccagagatcccctcttaaccattaagccatactgtgcttctaactcctctctcctccctggccctctccactccctttttagttaattttttatatataattatatattttttaaaaactctcaaaacatgttgacattcgttggatatatcaaactctgaaacatcttttactgctcacagaatttcagatcacctggtgtgatggaaatatcatgtgaggtggaatccaatccatgttttatcacttatcaaatgtgtgaccttggacaaatcatttcacttttcaaggcttccattttatcatctgtggaattataaaaataatacctgcttttctcatctcaagtggtttcagtgattgtttatgataatagaacttgatctacaacatgctataaaaatgagagatttttgccacaaaagtggccaaattatctttgccttgacgtttgctttctccagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaagtaagccgcttctaataactaaagaatagttatgtttgtctaaagaaggtttatgtccaataattttgtaatatctagtggaacagaaaagatgaccttagagatatctttcctatccaggagcatagttacagcataaatacacattaagttttggaagtcacttctatcactttttcatgagattatgttttgtatattttatagtttttggctgccagggcctctttgctatttttgataattaatcgttgtttrtaactgttaaaacatctgaatttctttattctttttgaaacacctctatgatttagaaacaagaagcccagcggaaagtcatgtagaatgactgactattggatgtggagcacgcaagccacagctggggcctgaatcaggctgctcctctctattcttagatcagtaactacagaatttcccactacagacagtgcacatatcgactagcaaggccccctgccctgccactctgcatttctcagctgttgagagaatcaggagggcctcctttcactgcagggagagagaccattaccacattctgcttttgattttcaacagctgtttctgagctactgctcctttgcttccatctcttggatctcggtgtaatgtcacggagactgaccacggagatttttactagatttttttcatcagttacttctggctagttagaacaaataagtagtaccagtaccttttctggtcttccatgccaagcctcagaagctaagcatatatgtaagattaaccatatttctgttatttcctattatgtggaagaatgtttttaatatttaaaagagttttgctatcaaaagtttcttgttaaaaggggagtaattattctctgtgactataaattcaatacatcactgttttaactatttgccaaactctttttcatgaaataattttatagtaaattttgctaaatttgcatattctattccaggttttcaaaatggaactgtttctcttctccccatattatccttaggtctataagtgagtgcccctctcgatgtttctgacccacccagccccctcttcactgttattcatagaaatcttacaattatctttttcgaactcttatctagttacatcagtttactatactatgcttatgacattggaaaaatggaattatttctacctgacaagtaattatctccactaaattacccaatgtgggtcattagtgcagtctttcctatctaaatatgtatgggtgttctagaatcaggagctacgaaagaaaattatagtaagcagaatcgaatcatttttctttgccttgtgacccattaaagatgttttagtttctttcattactatactttttcctctaactgattgaatgttgtccatttaaataactgttcagttgcttatcctactatgcagtttattgtttcagataagaactttcatttattgagtgtatgatataatcagaactattattttcttcttaagagagcttgatttcatcaaaagacaggaagcagaaagaaagaaaatagaagatttggaaaaagctcatcttgtggaagtgcaagscctccaagtgcgggtaagttgtgttccctaagacactaaataataagatggttttgctgtacttggaggggagcgctagtttagagttttataaatggatttgtttttcctagattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaaggtttgtttaacccaaccacaaaaatcatttttgatgactgtgtaatttggccttttatttttctttttctgacccagagatttaaaagttggaaataccttcctactatgggaaagaagaaaaggcttatcaaaataggagtcaatcattttagctctcgtcttatcaaaaataaatactttaatatgtagcattaacaaatcacaactaaagataagccaaatactattttaaaatcatcatacaattgacagatttaataaactgccttacaaattgtagttcatcctatctaggatgaactacactacttatgtgttaatgactaaggtttagattttttttttttttttttttttgagagtctcactctgtcatccaggctggagtacagtggtgcaatctcagctcactacaaccttcgcctcccaggttcaagcgattctcatgcctcagcctccccagtagctgtgactataggcatgtgctaccacgtctggctaatttttgtatttttagtagaggtgggcttttgccttgttggccaggctggtctcgaactcctgacctcaggtgatccacctgccttggcttcctagagtgctaggattacaggcatgagccaccgcgcccagccaagctttagaatgtttaagtcactagaataaagatctttttcataatatcagaaggcagactgctgctttcagcacttgagattcatgtagttaacgaagtccatatagttttgtgcttttaccatggtgtactgtgtatacttcttaggtctttcatgtcaaagaccaagtaagaccaaaacactggaaacatttggtattataaatgattatcttcattcatacaccaaccataaataaattacttatgttcttacacacacaacattcttagattgcacgtgtatgaacatgaatgactgttttaatatctgtggtatatttgcaaattagaaaacacataataattataaagataaatacacaggaatgtgtggcttcatctttttaaatatatacatagtagtccctggaaaatgaaaataaaagaatgtggtgcagcagggttgtcatgacaggaccgacaactcagaggcaacactttgacgtgcagtaaaaccctgttataatgggctttttagttttttcgtgatctttctcacatattaaactgtctccagtgaagttttcctgataagcaagtgtttatatcctatcatgaacttttagaactaagctcttagccattaaaaatggaaaggattagaaatcttcatttaaaattaaaatgatatctagagatttgaatccattcactgggtttatatccttctaatgggttttccctaaataggatgtaatttataaatagtgcctcttaggcagctgaaagaggaggatttagcattagcattacgactaagtgaggagctgtgtgacttcaggaagagtatttagcttctctgggttgatattactgtgcatattattttaaaagtagtatttccttcttcaccactttaaggcctgttttgaaactatatggtttagtctttgaagccaaaaaagtaatttatttgagctcttatggaattataatttttatacctggaacactataagattgatatctaaagaaaaacatcaggaatcaaaccaaattttttacctttttgaatattttaatttttaaaaaattatagtttatatataataaatacatattcctgctgtggcatactcaaagtatgagcagtatctagtagcttttcatttctattcatttctttcagtttagaaatctgtatcttttcaaacatataattaatggtgtttattaaattatatgactacagaagatcaacacactatactattaacatgctgatttggatcaaaaccttacatttcatctgaaccctttttctattctacaccctccattttgccacataattatcagtttccctagcaacactgttggttcacagtgagatgtggagactactaattcttactgaagccaatccatgcttgtgcagtagaggtagaatcagtcatctcagacattagtagcatacatatcaagtgctcttccagttttgctgtgaggacagtcagtgataaatctctttgaatttcagttgcttgatcacataaactaaaatggcgtggtcagtagctagataggaatgctctggaaagcacttttctaaattgatcccttgcttctgttgctagggaatgctgaaatactagaggtttagaaaggaaagtaaggctgcagacctaacataggccattccacatttaaaaatccaccaccaacgttttgtaccaggagaggtatagcacttccagtagttcccaaagttcctagatgcaagtgttatcctcccgaccttctactgactgtccaattctgatttgcttttcaggcactggagtggtaggatgagtggtttagcatgtttttaggcattgaggtagctcatgaagcaaaagaatgatcaagtgtaggtcaatgaaaatggtcagaatgaaatagtaaaaggaagggaaggcaagctaaggaggaagaaaggaagagcctctgagcagccgtttcttcatgtgtactcatgctcttccaaaatgatgtgactcttaatattgaattataaatttttgaggagtaaaacctttttccaaaccatacagaaatttagcacaaatttaaaattacgtttgaccaccatttgtatgtttctcactaaaacctaagccaactcaagtattattaaaattttgataacaatcatcagtacaaatttgttatttaatatattgtaacacttttttcttatcatgattacataaagcagacgtaacaaatttttttccaccaagagccataacagaccccaaatccattctagtttatatcaatgtgctggtcaagtattttccttgtgttccaggaaaggaaaaatgataattatgccctgctgctatgtttcatgcttgtcatttcttagtgcctaaataatgccaggattaggataaaaacagagaataggtatgttagagtgatcttggtaggctaaaagcttgtaatattagttttattggatttcctagaaaagtcacagaagcaatacattctgagcttctagatattccaggatccttatgttgataccatttgctgcttcaaatattttgaaggctggtttgctaaaggattgtgcatatcccatagagatactgaaagaaagactagggccagtaggtggaagttacctatgaaggcatatttctgactattctaccgtgagagatcaggagtaagtgtgatatcatttaaaaaattattttgaacaccgaaaacctgcttccaggcaggccttaggtggtacactgacttgtaagagaaagtggctactaggcagaaagaaagtactaggtcctgccgattatactgcaaggtatatgatttgtgggatcaagaatgaaagaggaaaagtttggtaggagacaaataaatagaatttaaggcactatgtaagcatctcaaaagatgagagggaattcaaagaagagaaaattgaataacattagcataattttttttctgattcatggtctttatgttgaaaaggtagagccatttgaaatgacatagtgtgttcttggagtagaagtgggctttgactgcagaagggtttgtacataatcttgtaagcattgtgacccattcacagttttgaagcataacaggaacttagtcacttgtaggtttgtaaatgtgattcaaggatttctgtgaaatttgaatattgctaccaagtgctgcttcatttcattytcacrcctacctactcagtgagtggaccaccagttaggtaatactgcatgttatcttcccaaaagtgtgaacaaggagggttatataaggcattttatactttgttcccttagttacttactgttccttagctctaatgagaactgagcaagaaaaaaatatactccagcctgagtgatagagcaagatcctgtctcaaaaaaaaaaaaagtgacattgaaagctattaaatatcctgttaatattagcaacctgaatccagaaatgtaattaaaatatatatgactaacttgagtctatgtaaacaacacaaaattgttttaacattagaaaacctactcatataaaatcaacacattaactagaggaaaaatacatataattatttcaatgaatgaagacaaacatttaatgaagtttaataccttttcaagtttaaaagttttatcaaactaaaaatatggaggaacttccataacttgatattgtgaggctaacaaaagtctctgtcacacattatatgaagtggaaaaatgttatactccaagaatttcctttaaaattaagaatgcttttaatatttcatcactaagtgtattactactgcttctattcagtgttgtcctagaggtcctagtaagtactaccagataagcaaaagaaatcaaaaatttaaggagtgaaaataatcaaaattttcattattcactcataataaaattgaatacattaaaaaactcgagtcttctgattattagatgttataagaattaacagggtagatggatttaagaagcatcagacatcaatcatttccaacaaacaaaatgtaattttctaaaatatgccataaaaatagcaaaaactatgtataaggtagtcagtgatgaatttaacaaaagatctcaagacccatggaaagacatgaaagaagacttacataaattgaaagagaaaggaagcctcaatattataaaaatgctttttatgcaaaattaatctatatatcccatgcagttttaattagaattcaaacaaggcttttaacttctttagaatttggtaagttgtttctaaaatatatatggatgaattgcttggcccagaatagggccaaggtgaattgcttggcccagaatagggccaggttctcctgaggaagaacaaggtgaggaacttgttcttctagatactgagattcattatgaagtaaaagtgattaagaccacgtgatatagtcccagcaattgtcaagtggtctaatatgcagaatacagagtccagaagcagactgacacatttatgtcagtttgagaataatacagagcagacactgcagttctgtgggtaaaggatggactaataaatggtgctaggaaaattgaccatccatatggaaaaaatgaattggattctacctcacattattcatgaaataagttccaaatggattacagtctcaaatttgaaagacgatacttaacactcttagaagaaaatgtgggatttcatatgatttctttttttttttattattatgctttaagttttagggtacatgtgcacaatgtgcaggtttgttacatatgtatacatgtgccatgttggtgtgctgcacccattaactcgtcatttaacattaggtatatctcctaatgctatccctccctgctccccccaccccacaacaggcccctatgtgtgatgttccccttcctgtgtccatgtgttctcactgttcaattctcacctatgagtgagaacatgcggtgtttggttttttgtccttgccatagtttgctgagaatgatggtttccagcttcatccatgtccctgcaaaggacatgaactcatcattttttatggctgcatagtattccctggtgtatatgtgccacattttcttaatccactctatcattgttggacatttgggttggttccaagtctttgctattgtgaatagtgctgcaataaacatatgtgtgcatgtgtcttaatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtacctcattgtggttttgatttgcatttctctgatggccagtgatgatgagcattttttcatgtgtcttttggctgcataaatgtcttcttttgagaagtgtctgttcatatccttcgcccactttttgatgaggttgtttgtttttttcttgtaaatttgtttgagttcattgtagattctggatattagccctttgtcagatgagtagattgcaaaaattttcttccattctgtaggttgcctgttcacaaaaattccaaatcgtaaaaaggttggatgaatttgaccacagtaatattaagaaaatctgatcattaaaagacattataaagtaaatggaaagagaaaccgaaagttgaagagggtatttgtagcacgtataactaagaaaaaaatattgttgtccacaataaattaagaactcacataaatcataagaaaaacacaaccaacatagtagaaaaatgggcaaaacgcataagaagttcacaaaagcaggaacctaaacattagtaaacatagacattcaacttcactggcaaaaatcaaacaattggcaaagataaagtgtcacagtaaaatgtgatagccagcacatggaaaaacaggaaaattcayaaaactgtttcattaaaataatttggcattatccattaaaatagaagatgtgaaaatcctatggcccgacaaatttacttcgatgtgtatatatatcctccagaaactcttgtcagtgtataccaaaaggcatattcaaaaacattccatgtagcattgtttgtatagctgcagtaaaaagttaattaattttagttacacctttcaacataatgttaaacaaaccagctaactaaaaaacaatttgcagaatattatatacaattcactaccacgcatctgaagtttaaaagcaagaaagactaatcaatatattctttagggataaatttatggaataactagaagaaaatacaggggttacaactagaaatagagaacagagagggcttcaaaagtaataattttatagtttaggcttgatggaggtacrtggttgtctttttttttttctttcttcatatgagttacatatatggtatacatttttatataaatgttttagactagaaactttaaaataattaaaaggtaagaataagaaaaccacaaaagagtttttaagctaaaaaatatatattagtttaaggtttagtaagaaaataaaaaaggatagcatcagccagacatttatatccataagggtgctcctaaggtcattggactcctccaagaaatcatttcctttgtcctttttgcctttctcttgagccctcaaaatcagcagctcttttcagatacctgtgggtttgaggccaggccagacccctaccaccatatctgatttatttcctgatagagtttgagagtacattaagcattctcttttagcataggaacctagaattttaaaataaggttaaaggcatgattaaagccagaatttattagatggaaagtcattaaaagaaaagtgaatgcttgcactgcattatcaggagagtctcatacaagagcattagatacagagcaatgaggtaattatttcatgctgtcacactgtttagttctaaattggagcctagggaattctagagtagattcagcctttttaaaaatatatatatattttttgcatacagatataatgtaaactttcacaattttcatttttcctgaaaacttattttcaattttgtttaatccccaataaataattttgaccatgaaatattgaattgcactaataattaaagggtgaacattcctggtaaatcactatgggaaattttaatgaacaagccaagtgaatgagaaatcaatatttattgattattttctggtgtatcattaaggccaaaatctgtcctcttacttaaaaagcaaagcacctaaattgcctgtctagttttgtgcaagttttgaatctgactacttgtaaactattaaaacttttgttgccaaatcagtgagacattctaaaggaggtattcagttgcaaattgacagctctgcttcattcatatttctcactgcatcttcataagttcgtagaatccaccagacccttcagtcatactgagttataaaatagtactgggagatatctaggccaggcacggtggctcatgcctgtcttcccagcactttgggaggccaaggcgggtggatcacctgaggtcaggagttcaagaccagcctggccaacatggggaaaccctgtctctactaaaaatacaaaaattagctgggcctggtggtgggcacctgtaatcccagctactcgggaggctgagatgggagaatcacctgaacccgggaggcggaggttgcagtgaaccaagatagtgcccctacactccagcctgggacagagcaagactctgactcaaaaaaaaaaaaaaaaaagttgcttcaagaggaaacacaatgttactttgtcagaatgagctttaacttagtaattttctgttcattttaggaaaagtgggctactttgttttggcttttgaattttacttgcttttaatagaacaagatacattatgatcttttataagtaaagatcattttaacccaaatgtgagtaatttcttttcaaggaaacttcagaagactactgtattccaaattatttcttatattgatatatggtctgattcaccatgatatatacatattatggtctggttcacctggttcaccatgaaattctaattatagattaaataataaccatatagctatgctaagataaaattgactaggctaggatatcagggtagagggatctaaaagtatgaaggagaagatgctacccagtgtggtttgtatatgaagtgttgccctgggctcctacattgttttcaaggtgggtcacagtgttcacgtaagatatctaatagccaagagggaaacatgaccagtcacagaggttgaagcatctgtaaagttaaaactgaacagatgaacagttatttagtaccagaaaattctgctctgtgtatggttctgaaaattgtgccaaccatattatttcagcaattagagtatcaggtccatcaggttatgactgagttcctttaagtagacatgaaataattctgttttaatactatacagtaatcatgtctaagacctataaggaataaatccacttacaaggaaactaaagaaacattagaacataggtataccaaaaaacactgttgcttgtgagtttttgatgacactaagggtttttttttgaacattgaaaaggtcattcaggtattaatttttggttttaagttaatgtttgatttactcaagtgacattatcaaaaacctaattctttaaatcttttaatttgttgaaagtcactgttgagggatttttattatttatttacaaactttattacaaactatttccaagcttaactaatgaaacacctataaaaatttaacgatacatttacaaatttgatatattccattttctattaaagtactattaagtactattactaggagactgacagtctttgcaagtacttaaaaaattcttatacatctattatattacacttccaaggattgtgaaccttcagttttcttacattttctaatgctttacataacaaaatcttcccatgattgaaagatgctttcctttttagggaaataactatcatctcaggtaactgagtttactttctgtaagaggcctacaatctgaattcttcctgtactaatcaaggatgctattgtatcacaatatgtaatgggagggtgtctacttagcatgcttggggttacctaatatccatagattttgattgagaaactgattagattcttgtaggcaaccctgagtgaaaacacagaatcttgcttattgttgccatgtcaaagacactacaatatcaatgtcaagaaaaagacattcacatatcctagctcccatgacccagcttatccacatgatgtcatagttctactcatagatgcctgcagtccccaactagtttgtcatttgattacatttttgtatttccctggcttttaggttatgcagatctcttttccatcagaatctaaagacatctgacactgaaagaaccctgagatatttaaatgcctttccctgtggtctaaatctaaattccatatcctttcatagtctagaatcaagcaactcttacaagtgtttcaaatgatatttgatagcagttaggacatttcctatagttttttctgactggtagtcactgcctttccaggtagtctagcggtattactgaagagttgtttctgagatatggataacagaatttaagcctctctgtccactgagaacaggagtgtaggctgatcataaactgaagaagggtatattagatatcagattgcaccagagaagcactacactaacaaataaccaacttacattttgaaggctatacagatagttttgagattgcatgtattgacaaaaaaactgaaaaagggatttcttaatattctttcaatgattagcaaattaaatgtatagctcatacaacaaaagttcagacctagttagaagattagaaaatagcaataatcttctgcttgttctggaactgttgaaagatacccttcctccataaccgtgtctaattcagtacatcttccccatacaatactaaaatgaagtaataactgaaagctaagccatagaccttaggccaaattatctggcagttagtaaggtagcaagccaggcagacaatcaccacagatgtaatgaaagagcagccttctctcatggggaagactgatagtcatgcagattttgacaaagttccctgggcttatatcaacatgtggagatactgagtcctaggacaccagatctaattaaattaaaatagaattaaggtgcctttaagagaaaatatactaaatatatgtttttctctatttttattcattttaactacgcaagtaatacataaatgtaaacaattacataatacaaaatataataccaaatttttaaacattgcaaataagattaaagtaccctttgaccaacatctcctaatctaataccttctttgtaagtaagcactatatcagtaggaagtatatctttccagtttgttgttgttgttgctgttgttgttgttgttgttgttttgagacggagtcttgctctgtcacccatgctggagtgcagtggcccgatcttggctcactgcaacctgcctcctgagttcaagtgattcacctgcctgagtagctgggattacaggtgcacgccatcacacctggctaatttttgtatttttagtagagacagggtttcaccatgttgttgaactcctgacctcatgatctgcccacctcggcctcccaragtgctgagattacaggcatggcatgagccactgtacccggcctctttccagtttttctatgcaactatatgcatatgtttaccactagaaaatgtattttgtgttaatgttttctaaatattttaaatgagtgtacatgttattctgcaacttgctttacccacttaacatcttgctaatctctttataaagatatttattgagtgcttattacataccactcttctaagcacttttatatctattaatgcatatataatcttcatagcaatacagttattatgttttgttatcatgactgttttgcaattgaggatcctgagggacagaggttagataaattgcccaatttaatgggacagccgcttgttctgaattctattcaaggaacaactccaggtctactctcatggtaactgttttacactgcctctctgagatacataaacttacctcctgaaggcaattatctattaacccaaaccccagtgggcccaccttttatgaacttgcagtggctgcaaatgatatgcagatactgttcaagttttaaaatgccaccaagtgcctcatgatgctcagcacctccattggtaatagcacaggcgaggcagtgtgatggcatgaagtatggctgtttctgagtgggttagtgcacgtaactgcggagcagaccccattgttatgctgctccattcccctagttccctcgctgcctgtatctgatctgtgggcagcattccacttacgtcaaaaataacgtcaatctagtgaaaaaaactgtatgactcacagtattactgtagggaactggtctctgtgtaatatgatatatagcatcctaatttcwtagagcatttttcataacagctgctaaaatcatcaaatccattaaattcttttaaaggatccaatttgtagcagtattgaaaatagtcttaaaatgcaggtatagaggtggagtctctctcactcaaaactgctctgtcattagctacttcatatcttctgtgtatttatctgtctgtatttattgattcacctcagtcttctcctgttctgtatttctagctgcattgcgtcagaggtaggctatttcagagactggagggtctgagaaaaatggaagataagaaagcagaggaggaaaaggaaattttccgctgacccttatggacaacagaacaaggcacactggagaaacgaggaaaagaaagaactgaggtcttgggcttatgaaagcagtgtaatattattgactaaaatatctgtagagaacgaatgacagtgagagaaatggccacttaagcctttacatctagcagcacataacttagaaacactgagccagttggatttcccctgccacactgccatccacaaaactgacagctatttttctttgtaagaattttattcttggatatatgtaaagccaaaaaaaatccctcagtgttgggggtttttgtttcctctgatgctatatgcttctgcaagtttgcaaagttagcccttgacatgtgcttttgttgggaacataaagtaagaccaaaaagaggactcaaagaaggcagaagaatgtgaagtttacttccagacttgagattgaccttccagaaggagaataggcttctgaagcctgagctctattcactctctgtcacagattaactgtgtggtrcaagttaatacacaaattgaccttctttaagcctcagttttcttatatgagaaataagctgggaccagaatcccaaggttattttgagttgtaatattaggatttttgtattacatgatggaaaaagatagcatgtgatggtcagtcacccttctagttacccagcagcataaatcttatacacattttccttccgtgtacacacgtgtcctctaatactgttaagggagacatattgcatgtagtgtctttggtaggtgcttcttgtggacagtattccttccagcttccttctggtgtaaatgctattaaggcgaaagttttcaacttcatcctatttttctggttcttttaaaaaattatttttagaatggaatataaattactgatttgtaatccatgaatcactgcaataaagtagctctgtgatatttgctttcagaccttcaaaaattgttaactgcatacaatgtgttgttggctacttaggtaccggatataaggcacaactttttagattccagctaacagcatcataaatagatataattttatgtgtgtgctcaagcagtttgcacctagtcagctaatgttaaagcagatacaccagattgccatttttgggttgtctgacacaagcaccaggcaaattattgaatagtaatagagcaaggagtcccagagtaaattttctgcactattaaaacctgctaataagtagttctgattttctctcacttatatttgttcagcttccattgatggagtacctattgtagtcctggatattgggttccataccagatcctcagggccagcattctactgcaaaaggaaccatgtttacaaaagtggagtgagattcttccttgggtctttttgtcacttagtagccaaagctgttattaaaccaaccagaccaaaataaaaaatcatccaggaagtaatttattctatacttttcaacatgtcatcctttttttttatcatgttatctaacatatagggaagattaattataatattttagatggagcctattggagaaatgagtttcctagactagtcacgtcatatatgattttataacccaaaacaccaaactctaatggcattaaaatcttgcaatgggaggtttatcaacactagctaaatcatagtggatagcctagtagcctggaaatcaagacactagagtaatcatggtagcgcattaattagttatgtaaatgagggcatgctactcaagttctctgagcttcaggagagaaaaaaaatacttgattggtayctcatggggctgttgtaaggaacaaatgagatagagtatgtggcatgatttgtattatagagcatacaatccaaatatgagctagataaggcataaaacgtgcaagtactacatacagtgtttctaattatattacagctttcatctaygtggtgttccacattttatatttaagcaagagcttataagattgactctctcccagttatcacaactaatgaactcttaatgggcagctacaaatatagattttatcggaaggaggaaattaaagtgatcaaggaattattttttctcccctgacatgtaaaaagtaaagagactgctaattagaaaatatttagctgttctttataagtacctgaatggtctgaattttctgagtattcattcttcattcagatataggaaatgaaaagtcaaaaccttctctaaatattgtcattcaatggatgtatctcctgggcaaaaatgtagttaattttgtttgttagagccatatactaagtgctaggtttcatagacaagaggcacaaactgaggtgcttccttgctttggttttgtagtatagcatatttagagcacatctagaataatgctgtaaaaaggaattgcctgagctaataatattataagaaattgtttattctgttaatacaagtacataattttctgcaactcagttatttgcactcaattattaactccttgaacatgacttcagctaatgactgccactctgaagagataaaataggattaatgatcaaactcctttatttctaaggagtgattacatatgcaaatgaaaggagtagtagcatttcaaataagttccaccagagagtacttttccttaaccaatatccaggtatgttaatgggtacctttcctttagaatgttaacttcggggtcctaacttaaaatctaggtagcaaaattaaaggtggtaagagccaggctaaagaggactaattgaattctctctgtggcctttgctgttaatagttcattttctttgtgtcccactttactctctttttcttttagcctttttatttaaagacttaagtatttacccttcgaaaatcagtgtcgtttctggtggggagagaaggtattcacagagatgagtcagaggcacatacaaataacttgtaatacaaagttagatgttaatgaaagaaaaggaaatgtttatcctacctcatccacaatactagtaaactaagtacttacgattttttaactgtttgtttcttcatttgtgtagccagaccttgtttcttttccccagctatcgtcaatttgctgattaggtaaattcctcactggtctttctacaggtttcaaaaaggaacaaggtagattttcagaaactgttttgggttgaaaattatatattaaaatgaaaatgatatagtacctgaagactgctagtaaattttgctacagtaaatttatgatagttaccttctgttgcctgtagttgaactggaaacctgactttgtaggttttttgtccttggtttctaagatctgtcaacttttgatataccctcctctatatctttggtcatctaacttcccaacatgcatacacataaatagtaaatacaaattagtgatttttataattatattgcaggaaggttgtatgcttttcggatgttggatttttatagcgccttcatcatctttagtgttggtttcttcctttgactttgtatatttctcctaagccccactgatttcttggttatttcttggttacaggctgtcatggtggtcacctgatccttacctgatgttactggttaccttgagattttatcagtgtctgygrtctcttcatcagttctctccaaaggtttctctcactgattatctttcaatattcttagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaaggtgagcacccttgaccgtttcctgatttgtactgttggagtatatcattgttcctacagcttattgaagattatgatttttctgcaaacagagtctatgtcctagttggtaagcagctagaatagttcacgtctttgtctcctgaattctttatattgttgtaattcaaaatattttgtctattcattcagtgaactaaccaagagcattatcygtattgtcatatttcatgatggtgcttttgatattcagctattggttttacttagtgggaaataatgaacgtacaagtaattgtttctgtaggtcttaggtatatgtattagtgacgatgttaatatggtgaattggtatgaaccatgcattctcatctgtaaatcaacaaaaactggttttcatggggattcactaataaaaggttggtcttatttcaaagtaagtattgcatagaactgatactcagtggcataaccttccttataatctcttataccaacagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggkgcctctstcctctatgtggggagacacttcactgttttctacttcaaagtctgatcatgatgtggaagaatctccttgccatcaccaaaccaccaacaagaaaatattacnagaaaaaggtattgttaatttctttttctgacttcataacacctcagcttgtacagtataaaaatgactttttctcataatcataagtcatttgttttctcatagctaataattaatattaatttctttttatattatagaataagagaaacaacccctscatgtattttactttaatttagttttatcttttcctatctggttcagtatttttatctcttcagctctctataagtttactactcaagggagttcttcaggggagtggggcagcccagagtttcaacaaacactaacacagtcataaagaaaaaaacactacatagtcatatagaaaaatatagagcgattttgtagaatagcagcccagagtttcagtaaacactaacgtagtcatataggaaaaaaagacgaagatcaaagtaacacaggcatataattgatacttaataatgttcttggatgaattgctaatatacctctccacgtaaccagtgcagatcttctagaagagggataatcaaccgaatgtagtctccacctgcttttgtaaatgaagtcttatgggagtacagtcacacttttttacttacatactatctattttcatgctacagtagcagtgttgagtcgttgtgacagagactgtgtatctcacaaacctaaaatattttactctgtggcccctgaaaggtaaagaaagcttcctgwtgcctggtctagaagtatattttcttatactcaaaattgctggataaactctgaaaatggcttcatcattggttgccatttatctagaatttttaaaaagtgttatacctttacttttggtctatcaagttaccacaaagatgattaattacagccatgtttgattgcaggcttgaggataaggctctggttaccctaacaggagttggcgattttctgaattgtgtcaataccacatttacaaatcattttttttcatatctgagggacatcagtggaaattrggatggagaagtcccattataactggctaaatgataagcatctaacggaatatcaaattagargaagtaaaagatttttttctagagatttgtaaaacaggttatatgccagtagaaggcatgaaaatattttcctcgttcctgttatataaacaacctaatactaaagttttggtcccgaggcttacatagcactgggcctttgttcagtcaagattaaataaagtaaattgaacactatcaattttctactcacaattactagagattattattctaattttttgtgtggttaataacacattatttgacccagaagatgtgttcaaaaatattcattgaattaatgtctagtaaatagaaactggcttttttaaagctttacaggatttattgcttattaaaagcattgggcctctgcaagtatagatagagtacaattatatcaacgctcagaagagagagagattgcrtccagctgaggttggtaaacaaaacctatccaaggaagtacaattagaatagccatcaaagcacttaagggaaaaaaagggtaggtaaggagggaatagcgggtaaagtgatgtcattaacagagacaggcacatatcatatgatttaaaggtacaaggctatcccagcctggctgtagcagtttgcttatgcagggtggagtagttacacacaaaagtgagccagtaggttaagtatatagctttagaagttaaacatcttagataacttgccatattactaggaaaccacaagaagtttgaccagaggaataaaaaggaaaagacaccaccaggtatggagaagctgagttaggagaccctatgaggtggtgccctctaaagaggagcagtagacartgacaggaaagaatgattcaaggacccttgagacataccttgactaggtaacaggtaagaaagtgaggcaaaactatcatgggcttcacgcctcagaacatatggtcttgtcattaacagaaaataggaaatcagcaacatgatgggggaaataggattaactcatttttttaacagaggaggtcatgagcgcaagagagaggtcaggactgccaggtagatttgggagtccccattataaaggaagagatagtcaagtatcttattacagtgagattaaggagatgcagtccagtrcaagaccttaggatttggccatcaggagatcatttattatttgaaaatgaaaaccaggttgccacagcttaaagttgaggcacccaatctgggggctcagatgtataattggtcacaaaggtagtattggagagattttaaaaagcctaacagaagtcttacgtagagctaaataaacaaaatgtatgtttcttttttcctgaaatcataccaatctaatgttggattttatgcagactagaagttctagtgtgcattaaagatggatttaatcgattttaaatgggaaagtacattattccttattcttaacatcttcagccctatggaagcattcatttcagtgttcctgggaacgcactttggcaaatgtgtgagataaagatgtaaggttgcctagcaccaagctctgtgataggcagaatcaggcttttagtcgcrtgatgtccaaataactgcaacactcatgggttacagagtgttttcgtgtacattgcctcagctggtcttctcagcgctcattgtaacatctcccagctacctytcattcaggaaataattaggcagtctccttttaactttgcatagtcctagccattaagagttgctttaggattgatctggaagaatttggcactttcttttcttcagcttctattaagaaaatttaaatcttgcttttaaaaataaaatccattagtaaaatcaccttagaaggtgtttgtgccatgtctatgtctatggatttttttatatgattgtgtcacatctgtgacaattcagttacccaaagagtaatgatgcaaatatgcataataaatatttgaggcttgaagtggatttttgacacagacatatttctgactcttgtgtttcattatgtacatttcagtgagttgcttattgtaatctaagtatcattaactaaaaatatgaaaagctcattgctaaaaacatttggagtatttgtcagtgtcctgtgctgcttgagagctttgaacctagactgctatccatgaactgtgtgtgtacttcatgttttttaaaggtgtatgtcgatgtgtgttgagaaatttctcttgaagtaaacaaaaatcatgagcaacattaacctgcaaagttaattgaacacttttttaagagggccattctctttgccttccatactagaaagttcctagaaatttaaaacacattttaaaagataagagacagaaaaacagataccaaaaaagaactggggaggaagagtttcacacataaaaaacatcaaatttaaaacagcatttgttaatcatctgagctaattggatatgctgaaacgtgatgccgatcagtaccctctgctgaatagtttgggtagagcctgtccgagatggaacaagtgccaccagtggaattggttcccaccttgacattgaactccatttgcaaagcctgtcttcctattggcttttggtatcatttcgagggtccccattccccagcagctgctacctttgagagtcctagaggcaaagatcagtctgctctgaacactgaggagattttggcatcttccacattaaggggaaccagccaagttttgctgtaacctaactattaagaaggccctttcaaagatataaatgttttgtagctgagcccctgtttaaggagtctcccccatgtccycccctcctctgttccaggaccggccacaggccattagcaaaggagagccagagaagaaaactttgactctgactttccccctaaatctcccagactctcagaggtgatattctgcgctgggctttggagatacgggagaagtgggctatgttcctgttagaaggcactacaaccccaaggcaagaaaggaatggaggacagagcccaggcacttgaagccaagaatttggagccagagaaggaacaaaagtcatgttggtccctacttcgaatgcagaggatgatttgagagtatttattctcccttgttcattcccatgcagttgaagctaaaactctttgtgatgaatgttgagcctctgtcctatagaggacctcccctgcttaacygmragttcctcaatgtaactgtgtctcctaggtcgtataagaaggcattgattatttattttacaattaggaatttaggcaaagcccttagattcagagaygcattgacttttgaattgtgactttaaaaataataataattgatctttttcacaaatgtgtatatcctagatgatgccaaagatcccaaatcactaagggcatccagttcattggcggtgcaaggaggaaaaattaagcggaagtttgtggatctggggtaagcacttcacgatgtaaaaagaaagccctctgtaaaaggaggattgaaagagaaaatttcagcttcccctttctgactgcttactatcattacagggcgcctttgcgaaggaattccarcaagggaaagaagtggaaagaaaaagaaaaagaagccagtaggttttctgcaggtagcaggtacggttgtgtgattaagaacacgtgtatttctatacctaaactttctggccccctcttctattgttaaccaaaatcagtggtcagtatctttgagctaaagtgatatgccaagaattgagatggaagaaaaattgcacaattagtttatattggtcttactccaattatrgcctccatctagccttgggcatatccattggttcttaattgcagaattatggccacatgaaccatttcaataagtgtttatctaaattcagcacaaatatatctatgtgatacttcagaaatatcaaatatatttatgtgatacttcagattttttgcctggctacccacaatgctagtgcattgtattaagtctaaaaggataatcattttgcatttaagtaccttgttgacattcaagattgtcttgtccacatgtatgtaggagtgaccaccatcttttgctgcacttggctatttaattgattttgtgggcactgtcaactatgcttagtcttcagtaaagaccttcccataaagagcgagctttgaacagcatgttatcaaattttcccagttgttttctgagattatataattttaagctgagatttgtatagggagtcagtaaagcatcaagctctgaagcccagctgcctggatttgaatcatggctctcctacttataacttttaaatcttgggcaagtgagttaccctctgtgccttcatttcctcatgtaaaatgagagtaataacagtaccttttacataaggtcagtgtaaggattcaatgagttttcatgtaaaacatttaaaatgatacttggcatgtaggaggtattcaaagaataataaagataacaatttgctgctattgccattactgttaccttattattatttgcaagttacaaagtagttttatatttatcatttcatttgatccttataggattgagaggatggcaaggcttggtggcccacacctgtaatcccagcactttgggaggccaaggcgggtggatcacctgaggtcaggagtttgagaccagcccggccaacatggcgaaaccccgtctctaccaaaaatacaaaaattagccaggcgtggtggcgcacacctgtaatcccagctactcgggaggctgaggcaggagaattgcttgaacccgggaggcggaggtttgagtgagccaagatcgcaccactgcactcctgggcgatagagcgagactccgtctcaaaaaaaaaaaaaaaaaaagattgggagagtagataataataccatactttattgatgaagaactttaccttcatagaatttaattgatttgcccagggttatgcagcaggcagttaatgtcaacctggggcttgctcctcctgtgtagatgtttttccawcatactatgccaccttcagttacttatgcatctaatgatgcttaaatttctttataaaatttggaaataatctcaatatcatagactaaggaagaaacacactaaaaataaaatactataaaatcatgcaaggaccacttctccacttcatgggttgtccactgctgtttacttttcttttttctcttttctgacatataccttggtgagaaattgtaccttcttcttggaattaaaggagcattaaaggagcataatgggcgggagatgaggagagagaattcccaaattaattatctttgttagtgtggctttcctttatactgtacattggaaaagggtagaatgctctcagaatgaggacaacaatctcaggaaaataaaggtaaatctgaggctatatgcatctcgaaagtagtttaactttgtgtggttcgggagtgagaatgatccactttgtgtgttaaaattaagaatagaaaaataaaatcaaacatactcatggaaaaaaacaaataatgaaaccgtttaggggagaaagagatgcataaatacatgatgggagagaaactcagatactgaaaatgacactgtccttcctttggtctctgggctttgaagacagtcactccctctcatctttgaggcaccacctgagagggatgtgagcacctgcagccagaaagggggagggtgtttgatggaattttgccatagtagccagagatgattcacctccttgtataaatcacaaatgaaagtcaagccaatcttgattgtgttggtgagtgcctgcccacctcactataggcaaaaccacagcttgtcaagggcaggtggccatcagcacactgcttcaccacagtcgatgcctgctttgaacccacagctagacttctagattggctgcctcrccaccactgtatttttaaaactctggagtccccctgattcagcagtcagaaattattgtacacatacccacactacaaactagtttctaattagaatcatgattttgatcttttgtagttcctaagtgtgatgattgggtgttcacaggcatgtgtgagatggcctccctcaaaccttgttatgacattggcatacccaaaaaaaataaaatcatagttttataattattagtaattatagtagaattttggcaggatggaaaggaattcatataattggaatagaagaacaaggaaagaagaaggacacttttctcttgcaagaaaaaaaattttgagctgctatagtaattggttaacactaataaaatctgtggacagctatattcttctgtatagattgataatgggtacagaaccttataaaacctatcccaggaagaacagaattgctgcccagtaggagcttaatgcaattgagttggattctcagggtcctgaaagtctgtgggctgtaagcaccatcagctgcagggtcgcactatgattgtagtgggcaactgggaatacactcaccaaccctgggagacttcctcagaaaaaggagggaaggatccttggactgagtaatgttatctttttgaagcatttcatccaattcttattaggctaagattctgataagatcattggtcagctataacctatggctgttagattttaaagaggcaagactttcactatttggtcttggttttagttttttcctctctataaagagtttaccttgttgtgtttctgtggatacataatgactcagatacatgcgcgacatgagacaactagagaaaatggatgaggctaataataataaacaaataaacccaacaaagaaatatgacttggttccatcccttttcaaatatgtgctcagtggcattgtctttttgtttgtttgtttgtttgtttgagacagtgtctcactctgttgcccaggctggaggactrtggcacaatcacagctcattgcagccttgacctcctgggctcaagtgatcctctcagctcagccttctgagtacctgggactacaggtgtgtgccaccatgtccagcttaaaaaaaaaattgtagaggtggggtcttgctatgttgcccaggctgttgttgaactcctgggctcaagcagttctcccacctcagcttcccaaagtgctgggattataggcacaagccactacacccagccaacattctgattttaaacaggcagcatagcagataacaaaagcaggaaacatttagttgtcagagcttgttcaccccttaaaatgtataccaaagggtaaaataaaatcctattctgtattctggagtaagtagccactgatgtcagtggagcatctactttggagctctgtagataagtttccagtgtagtcacggaatggaaaactctgtgagatgtgtgtatctcagatggggagatgtgtgtatctcagatggggctaggtgatagtatgttgagaaaatgataaggaaaggagatggcagtcttctatggaaatgaatttgcattcaagtagaaagtgtgaacaacagaaacaacactgagctggaatccaaggtagtagtccttacttttccattaggcaagtctctgaattcctgggaccttggtttcctaccaaaaaataagtggattgggctracactgcatggctctgacttcccattcacctctgcgtacactgtccagtatggttgcctctagtcagataaggctagtctatattgggatatgtgtaggagaataatgaatgctggactcaaagacttagtatgaacaaaaagaacataaaatatcttcataatattataatattgattacatgtcaaaataatattttgggtttggagggtaaataaaatgtattattgttaaaattattttacctctttttttcccatggtgctactagaaaattttagtttacaatgtggttcatttatatttctttttggatagtgttgatctgtaggattccatgaaaaacaaatcttcctttaatttctaccccattattcagttggtctattcatttattgtttattttcttatttatattctactcctcgttattccaaaataatttgtttacatacaaaagtacatatgctacaacaatataatttattaaaaagtaaattgaatagggaaaagttagattaaaaagtaagtaaaattgttacttaaaatacaacatcttcaataacatcttcatagtaagtataagagtgaccttccagtgaaagccaaaaacacaatgtcaatatggttaaaagcctgggttgaaatcccaactctgccacttacttcttggacaggtttcttaacctttctgtacctcagttttctcatctgtaaaatggagacatagacacacacacacacacccgcccctcacatacttcttcatgttattaggaggattaagatggtcacattgaagtacatttcaaatccttaaataaaaatgtctattgttatcattgtttattaaagcaggtttgatgggaaggatacaaaatgacattcttcttgcgtattttgctggcagtcttgttcatccaaggatgacttttgttatatcttgaagaatgaatgggctatatggattatacttcaggctgtacttcataggctatttctctcaaagaggctttagataaatcatggcatgacagtgagtttgaaattatatcctatgacaagtacctggagggtccactctgcccctgttgctgagtaagagcaaaacccctgcttaagaatcatctgagctggctggaaacacaccttttagaagaattgatggagatgagcacatgtgtgtgagtagaaaaacaccccatctctgcctaagcctggcccagtgaatgtagtcattttcatggagacctttgaataatgtcagcttagccctagtagatcggacttattccccataactgtctagcccatttttagctgcatttatcaatttaatattcagttttctttttaagtacagtatttcaaatgcctgaagcctgacaaayttacattcttaacaggcaaacacttttccatacttaaaaaagctcttgaaaatctaataagttactgtttaactgtagtgactctaaacgtcccaatatagttatcaaagtgcttaatatattgtgtgtttgttaaaaactcaaatttaaaatgagtttagatcattaaaatgagtttaacattttaaggtagaatcagtggacacatttctctttcagatttctattcatacaaattttcttaaacacctaagcaatatatctgttattcttaaacttagcatttakattttgatagtatggattttatttacgtgatcctcttctatttcattttaaacccctccagtatggggaagactcattaagggaatagtttcaccatctcgaatgattcagagttgaacactacagtgaccatctcagatgaactattattgattagatcagaactcaggatctgggagcaggatatgtctgagtagggggcgggggttggccctgagctttagatggacatgtttctcacagctgttatccattagggtctctagatcccatttagatgaggctagctttacaacctcaaactccttggtggatrttagaaccttatagaattacttcattcgatttaggtaaatacaagtctgcaatcttcctctggttgcaactaattttcttcaattaacttcttttactcctgggcttaaattctgtatttcttttatacttcatctgttctggcagtttctgaactcttaatgataytttgatgacatccagttagatgctgaatacttcacacacctgtattcaaagttagaatgacaacaacaaagatcaccttggaatgtttagctggcaatttaattttgggatgccagccccaggatacactggattcaagatatatgtaaatgagttcattacttataagagatattacataaaccatttaaatgccaggaaacagctacctctgaaatggtatctttggattatgargacgaatttgaagccattctttctcccagttcctaggagtgacttatgattctcttttttccaaaaatgatagcaagccagtaaattatagctaaaaaagaaggtgaagggaatatagactatctacctattttgatccactggaaaaattattttcagattcatcaagagttcatttctaccaatctcgattttggggagaaaggaaggtgaaaaggaaagaaaaggaaggaacgaggaggagaagaagaaagggagggaggaagcaaataagaaaggaaagaaggattttatgttattcctaatggatttctccacaaagtgaaatagactataagagtggtcaacrtggaataactgctgccaaaccctttctgcttctattgtgggcccaagagttcaatttattcagaaggaaattgacatttattttagaaagcatgtctgctaagctgataggtctgtaattttaaagcaaaaatttcgttttttaaatgaatgttctctaggtccgagaaatgaaagcataccactcactgttcagttctttaaggatactagcaagtacccaggggttacatcagttcatggggttttaaaatcacagatactcacagaggaatgagagatacaggatacaacttcagcaggggcacagccaagcytcatgggaaactgaaaaatattcttcaaaatatccctgaatctggtgatttgccactgtagagacgtaggtgtcttctcggaagtggcctctcattgccttctgcctggctcttcctccttcctgtctattacttggtgtgcaaagctagggaaaggaagcctctgggtatcaccagaggcccagcttctgtgatctccttcaccgcacatgtaagaaccacatggcctcaagaccctcctcagtgctggatgcacaggtccatgtggaattattagtcttgaatatttttctgacagtgaaaatgttgtgagagagtttaattagatgtgaccttcagatttttttcttttcaaatgttgcttggacaggatttggactaccaaaagtccttttcaactaaagcaatggaatgaccacaagtagaaaacaattcttattttgtccctatttgcttttaaaggtaatagtgattgttctaaaagcattgttacaaaggctgttcactgggagtaggacaagattgtcatgctgtcattaatcatggcctatttataaactttaaaacaatatccatatatttaagcactactatattttattgaaaattgtggatgaactcatttaaaaattcccttgattcagaaatctataaccagaggagataatgatcatccggtccagtttttcctcagagatacccaattataagagtatgggactgcagagaaaatatttatatgtttctacacagytagagctttctaggcatttttactagaatgtgsaacctaagctaaaaaacaagcctcagaaaataaattatgaggctgagtgttgtgattcacacctgtaatcgcagcactttgggaggccaaggcaggaggtcaatagcataataaacccctatctctacaaaaaataaaaaagttagccaggcacrgtggcacacgcctataagtcctagctactctggaagctgaggtgtgaagattgcttgagcccaggaggtccaggctgcagggagccatgactgtgccactgcactctagcctgggttacagagcgagaccctgtctcaaaaaaaagaaaacagaagttgaattgtgggtgcatagatagtgagaactccagagagattgacctctgcagaggtaatgtggttacattttaaggaggctaagtggaagagggggatgagaccatctccatggagacattcctagagttgtaaagctggagccactagtcatatctttccctagagacacatgtttacatcccaaagggtcagagcccaagatccttcccaagttgaatttacattaaggagataagatttctccctccaccctccccagaggctgcagaggggacagctttccctctcctrtataatcaaccagattcatgtttttggagttcctcacctagagtgtagaccatgtgtaggatgacatctggttcccccagcatgctgatctcaatattttatcagaacctcactgacttcttcattctcttcagttatcagccttataatccctttacatttgtatcttgctttacagtttacaagatgcttttacatttatgtcccagtcgatcctcacaataatatttgcaaataaatgggaattgttaggtgttatactatttatataaactggaaatatatttcaaaatatatttgaaatgagatgtaagaagactgaaattcagtatacatgtggtgggacagaagttgtctggctgtggtgtccaggcacttttaattgaaagggaatctctgtgttatcgtggtatcagcagctatcaaataataggcattccatcaaacrgcaagggtgacctcttccaagatgcacataaactgctgcctgttcctactttggtttctgatagttattttttctcttaaccaaaagataattacagatatgaaagaacctacattaagacaaaaaaatctgttttcaaactgcgttcttcaaatgcctttgaatcctttaaatgttaaacaataaacatagaccattgacaatttgtaagcactttcacatatctcatttaattcttaacaaacacatatgagatacataaaaatatccactttttacagatggagaactaaaagccgagagaaggcctgagaccatgtacttaggaggtggtaaaccctggccctccaagtgggagatgaggacttcagatctcctacgcctcctgtgaaaaggcactaagattctggtgaaaaaccaataaactacgtgttccacctaaagtattttgaaccctgaaatttcaaaattatttaaatatatcattttcttaagtctcagacccttcggaacacaagtccagaggaagacaggaaagaatgctgcttatgagctaatgtccctagctgtgaggcatgtcacccagataaagggaatgcagtgatgattaacctaatagcagttcctaaaagactgtgcccctccctgattataattcatctacgtacacttattaggcacattttataaaaattcaccatggcaatagcaatacgaaaatgttgatcattgtcacagaatccatttagaggcaaaaagataactattaagattagtgttgtagtcaaaagtgcaaactttttactctgttgaatagaacagtttctcaaattgttacttcaaactatattcagagtccttgggttcagtaggtcttttatccgccctttctttatctaacacacccattcttttcacaaaacaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaatgtaataacactgcaataaacaatgcatggtatttcttatgtggggaaaagaaagcctcatttaactaccaccttctttaatgctgtttcattgtagattgtacattactctttgatttgcctatcttttcacatattgctatttaatctcagtttgacagttaagccatgctgggaaagatgcatttgaatcatagaacagaatgatagatctgtttacccagtattctactttaaattacattactaaactatttcactgtgcttctcaagatttactgaaaagcaaataaatttgggactgaatacgagttcagtacatctaagtgaaactctttaaaacaaaccaatgatgacatagcatccttatttatttcttcttttaatgtcaaacttctgtgttgaacaactgctgtataattctatcaccaaagttcttcaacagaattaggaaatatatgcatgggtgttacttgtttttaaatgcatgatggttatttccagcatgacactgcaaaccttatctaacattttattgaaacacatatggtggctaactttcacaygttgtttggtctccttttatctgtgttcgcttttctttctcaaacagaaacgtgattaatgttacttgaatttaattcttttcagtttcaatttaaatcttttcaacagctcaaagggttttgactggggtaccaaatggtaatgttcatgttaaatgtcctgctgcttaaatgttctgctggcctagctccatgtgctctaacctagacttcttttctgaagttttagcaaactttggagtttgttcggtactgaattctccagcctctggcatggtatttatttttgataaccaactaaacccagtataagggaacctagtggaaatctaacagtccaattcctaaggaaatgcaatagaaacaagatggtgttggtcaagtgcttagagttcctggaaatccatccattttagaattactagcaaaagaagttttgatagcagcacatcactttggtcttgaaacattttcagtattggatctgaggcatctaaatgcaattcgaagaattctgccattatcttgcactgtagagactccagatttggttaaaaatgtttttacaagtgcagctacgtagtcattgttgtttgattttcatatccactgaatattttaatgaagttctggggaagttttatttacaygctcccacctcccccacccccaggtgattatttggaaacctgtgtctgtgctgtgtggcagcctctctgatgctctgcgggtgcagtgagagagttgtatttcagcatgtaactactagtgtattgtcaggctgtgacctcccccagaactcatcatcttgaagggtacatccaggagaggatctgccatttctcatagtatttatcacagccaacaataagcgatccttcccaggaggtgctctagctacctttctaatatgaattgccatctgttcctaataactcagcctctccacaccatcttgtatttttacttacactgttactcatcacgattagggtcaaagaagataggcttattaatattattcctctgagcagttgcaraggataatgaattctgtacccttgaagagcaattgaagaattgtctctctaaaacatctatcctttcatcacatggagaaagcacccagaattccctcaaccagacaaggtgcagcattctcaaccgctgccccattgaaggtcatcaccaaatcatacatgaatttctgctaagattgtttaaaagagcccttttagagcttgtagacacacctacctcttgctcactcactgcactcatttaacactgagcttcatttatttttacagaattttaccttcaatgatgacttcagtcccagcagtaccagttcagcagacctcagcggcttaggagcagaacctaaaacaccagggctctctcagtccttagcactgtcatcagatgaggtaattccatggcactatgacagagctgctttgtcaaatctgacgttttacccatgaaccatcaccaggaaaatgtttttagggtagatattgcatagaaatcatcaggactgtggtttatgtttaatttgaagtcttcatgatttctctccctccctttctcaacagaaaagcaaagtcttgttcttaagctttccaggggccccttttacacgtatatgtaaacacacatgatggggaggctgggcagtgcagagttaaacatgggggaacagctcagaaatcacatagaagtttcctaattactcctttctttttttccttgcctcccctgacarccacactcactccaagattctgatactgcctctgattagggtgaggtctctgattgagaatcaatagttttgataaagagggaaaatagcatgagaaccatttatttaaaaacaagggtcaaaattagtattgctacaaattatcaggagataaatgtgtacaagagagtcaggaaatgaggttagtgatttagttccttgaaaaatggagggaggacagaaggcaccataaataaagatatttttgctctaaatatttgttcttactatttctttctaacatgattttttattcacaaaacttttttttttcttgtaagcttttctgcccgtattcttcaagcttggtgcaattttaattttattaaaattatgtactatatatgttgtgtctcctgtttctgtaacacttttcttcttgattcttttattgctccctcactcagagcctggatatgatagatgacgaggtgagctatcagtgggctgtgtgtggtggcttgtgtgctattgtttgaatgtgttttttcgctctttggagatgactgaaaaatcagacaatacaagaatatcttcctctgtagtgaagggtttccttgtgttaaatagctttactctctgcctttgtcatatcttagtttaaaagatgttcctaacttaagaggatctccgcattgcacctccagagttcctcgatttctcttccatcaccattacattgacatggtccattcttcttcctctcctttgccttcatctcagcttaccctatcccttcttctgtgttccctgtgtgggtcaccaaggtgactcctgtctttccttcaagacctatcatcaccttcatctcctctcagcttagtgggtctaggaaccaacctgtccctttgcactattaaaaggaatattctgcagtggacagagccagaaatttagaataaactcctaactattgagctctaccacttactaactgtgtgatcttgggcagatcacatagactttctcagcctcagtttccttgtttctttttttgttttttaagacagtctcactctgttgcccaggctggagtgcagtggcacaatcttggttcactgcaacctccacctcctggattcaagcgattctcctgcctcagcctctygaataactgggattacaggcatgcgccaccaccacactggctaatttttgtatttttagtagagaggggatttcaacatgttggccaggctggtcttgaactcctggcctcaagtgatccacccacttcagcctcccgaagtgctgggattacagatgtgagccaccatgcccagccatttcctcatttcttgaaagtaatgatggatattatatgccctaccttcctcacagtttgcttgctgctcaagtgaaataatggttgtgaaacttcccctaagaaggcttgagagcttaatgctctcctcttgcaagtgaaagatacctcagtatttgttaatatatttttacaaaattccaatgtcttattagaggataagtgatgcattgcatatagaaatttatgaaatatttattttctacatcttataatctgtccagactgttttgatgtaaaagcttgcaacattaatatattttcttcaatattaaacttcctacattaataatggtgcttttttattatggggaatttctaaacttctaaaaacataaaaacatataggtaataagtattttttctaacaccactagaaccattagcttatcatattttggtttaaacataaatgtggctctcataggttaagaaattccttttgatagcataatatgagccatagtatcttggtcctttaacaacactacgtaacattcctatcttagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggtaaagaattatatgtctgtcttaggttaccaggtataatttgtattactcatatcacctaaaatgttttcattaggtaagagcattctgcatatctgagaggtaattctcatcaatattcagcagaaaggatgttgaattctttctgagtagtaaatgaagtctcagaaagtccatcaggggttccaaatcaaatggtaggctgctgattaggagagtgagggacccactccattgcttccacctggcaacacatggtccatatattaactctccttacatctgatgtagtatgagttttaataatggccactgtggactttttcatcacattagaattaagacccagatccacgagtcttcttttccttgttcatttctccttcacctccactcttccttacacaccactcccaaactgggatgatgttctccccagaagttttttccccaaatatgtacacacatcttccctcccctccatggcactttcatttccacttgtccagtccatctctcttagagaccaaggtggcatccatccctttgggaaagggaaaaaggtgcttacagccaactccatgtacccccaagccccacccccgcctcagccccctgctgggctgacgggcagacgagtatctcttgacaatcttgaaaaggttagagatcaatcaatagcttgtgaatatgaaggcctcattgacaaggctgtccctgttggggagatagatagatgcatcctgctgttgattctgaaggtcacgaaacatttaaagtacataagcaactccccttattctgaattctaagttcatcgagcaacctcctcattataatcaacttcctttataggtctgcctacagggaaagaatggctagtcatgctgacacgagcattctggccccaaagacatttttggttctcattgtaatgaaaacattggcagaaaggaagccatttcaattcttcttgcccttcttggagccctctgtgacagcaggtgctcactcctatgctttgaaaatattgatgagtttagcaatacctttacccgtaaatgcctacagcccaaaggttggagaagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaaaacaaagagaaaagctraggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttcccccyacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttkctgcrttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccrtattggatactctattaatgtcttgagatgtctggtgctttgttattttttmacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcayctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgmacattttgttttcyyattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggccactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttttttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctcttagaatggtttacattatgatgggggatggggagctgggggagggctgtacattcccaaaagaaagtagtgttataggaaatccaaatgcacttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtcaatcaggagcaaagtgcacatttttcatggaaatgaaactaagtcttaactgtggtaaagtgtaaattggcagctagaaattacatttgaaagcacaattatggaactgggcataaagttaaaagagcaaagcctgcactcgaagcttcctcgcccgtcattttgttcccctgtcgctgcttcaccatcaaagtctctgatatctctcagccaggaaaacctctgtgacaaatccattaagtagtcagtctcacatagcgaggggcaagctaaggaagaatcaggaccatcgtagagtatggggttattttaaacaatattctttctaaagccttaaaaataagtgagggctattaatttcattcattcttacacacgcaaactataatttatatgtgactaagcctatgtcagtgcgaaaatttagatctgggaatcacagaatacatgaattaagctgttttcctctttttcacaatgtatgttatgaaatttctaaccaagccatgtccctttttgagtgatcttgagtatgtgctgtgtcaaattggataggcttttgtttcttcagtggaatttgcttatctatcatcaagaacaagaaagaacagaatgtggtcattttattgaagatgttagggagcctaactactcaggaaattctttctttctaaataatgaaatatgttgggggtgttccctaagcatcacactcattgataatttcaagacagtctttcagagaacccagcatcctgggctgtgagcagcatctcagaaaaattgagcccatgtagggcacgggatattatgtcactggaatcatgagtaactccaatcttgctgtgaataaagtggttttttgacccaaacaaaatgttcctgtttattacttcaagtcagtgattcttaaacaactgttggtggttctcaatttattggcaaaacattttcccggaaatgccagactatcatcataacaagtgccttagaaaaacttcgtttctggctgggtgtggtggctcgcacctgtaatcccagcactttggaaggccaaggcgggtggatcacctgaggtcaggtgttcgagaccaggctggccaacatggtgaaaccccgtctctactaaaaatacaaaaattagccgggcatggtggtgtgtgcctgtagtcccagctatccgggaggctgaggcacaagaatctcttgaacctcggaggtagaagttgcagtgagccaagatcgcaccactgcactccagcctgggcaacagagtgagattcggtctcaaaaacaaaacaaaaacaagaaaaaaatttgtttctaaagtcactgccttaacaccctgaagaagtaattcatcatgaaggttataccttcaaatcagaaaaacaaataaatgaaaatgtgtaacctttatatatcagcttctataacaaaatgataaagtcatgttttcttcctagtcatgtctcagtagatagccaaaggggttgttgatcttttctatttatttgtttgtttacctttctattattttttttcttttcagcctccacaacaagaagtttaaatattaaacaaaaacccaccagcactaccaccacctcaacaacagtgtagtctttggggacacttttagcttcgcccatgtcaattatgggattcattctgtatccagtcatcgaagtgaacaaacttcctttaaccaagtcaaagacactcaaatgtacaatttgtgccaagatcatagagactcataattttcaggtgtgacaacactcccaagaattttaagattttcctatgtgtcattgcaacaggagaattgaaaaagcaagagtacaaggggagttggaatagttcaggttaatatttactgagaaaaagtcatatatcgaagggaaaatgggagtaagtaagtctgactgccatagtcagacttactatgtgcatggagtagaggggaacttcataatgcatatgttttctggcctgtgaactggagtccctgggtgagtactggagttctaaagacacgtgagctaaccctgctcccctgtgtcttctgaacaagacatggcaaggcagcgatacacacatgtgctttcaggcaacacatgttttagggtaagtacttttggggtcacacactgttatttaatatctgacaattgacataactgatttatccattttagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttagaatgttctggattcgaagcacctgtggaagaaataacattgggttaatatttttgttaagtcacttaaaacaaccttatgcataatagggtcatcctccataagaagccatataatcttatacaatgagataaatcctattttgttccaaaattacacttaacacacctgtttcttcatttgggaacaggtgggtactgatctcaagtgatctttagcagaggtggagagtatctagacctacagggatgaggcaggaaatgcaaatgagcagcgcatcctggatgtgggacattagggagcagtggggatttcagtaaatgtggagggaggaagctgttactcagt

SEQ ID NO: 17840 - DNA, 14023 bp, Homo sapiens
  misc_feature (1)...(14023): n = A,T,C or G, or insertion/deletion polymorphism (see Tables 1-2)
gactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatcgtactcaaagttctagtcagggcaattagtcaagaaaaagaaataaaaggcatccagattggaagggaacaagtaaaaccatctctattcatagatgcatagatggcatgttcttatatagaggacactaaagagtccaacaaaagaaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtccagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctccygccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggccnggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccaccyaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggatttttttttttttttttttttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttatttttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaaactttttaaacatcataaaaagtatttgaaactaacagtgaacattatattaaacagtgaaacacaggttacattctcattaaagtcaagagcaagacaggcttatttgttatgtgtttaccagatcctgtcagcataatgtcatcagtgtaatggacaggcattgtgcttgtgggatgtaaagatgtttgaggtcccttgagtctatattatgatagaaaacaagagagctaacattgccctgatgcatgggcagtaaacttaatactcttgttcctacttggtaaattcaaatgtattctgattttactaatgtatggaaatgaagaaaaaacattctctaggtcaatacttccatatcaggtgcctggggctgtgtaaatttgcttcaacagagatatgatatctggaattgcaattgttttttggcatcaccacctgattaaatttgtgatctgctgtcattttctgtgactcgcctggctttcgtagtgtccaaacagggtctctaaggagaatagtcactggtttgtgaggcacctatctcagttatagccactgaaaggcttttacacaaaagagggatgactgcttcagagactggggagtggttgcctcctcaggcaaaggaggttcaggggaatttggaggtttgcaattctcagcctcatccatgtctgcctaaatgcctccatctcaggcctcagagtttcactccttcccaccggtactcttaccacagcataatagatctggtggagttaagcatttaattgtcactgcagctctgcaacttatgctcagcccctaagtcgtatctgcctacaaccacaggatacggagtattcctcaaaagctctatgcatgcatcctgattttccatgtatgttcatcagtgttcttattttgtatatattcataacatttcatttctttttccatgtgtatgccctctagggctgtaagaagacagaccactctacaatcaggtaatgctacgtttgttgccacagtgactaaatgccactgtcatttaatctccccagtgtcttacttgccatctgcaactcatcccatagtatcactggtgataatctgagaaactataatactaacacatgtcatggattccctaactgctcattttcttccttggcaaatatgttatctctgtgtttcttgaatatattagcaacataaccttagaattgcattttgaaaatctgtttcctggggtttcttctagcaccaattactgtatgaaacaagggatccagcaaggaacagaaaacatggaaattaggataatttgtggaaggtttaataaagatactagttaggagggtgggaacagagtattaccatcctgtaaacccaaaataaaattctaatcccccctcctttcggcaaagggccttccaaagttaacctgaaaaacgttcaggccatgatgggaaagtggggatcaaatatgccttattatacccgcctcccttttggaattcagaaaaatctgaccagcattaacatcaacacagaccttcagactgatagaacagactctttaagtctgataagaaacatttacaatctattctctctgaagcctgctacctggaggcttcatctgcatgacagaaccttggtcttcacaaccccttatcttaaccccgatgttcctctctattgattctaagtctttacacaataacttaactctttcaaccaattgccaatcagaaaatctttgaatctacctacgacctggaagccccgcctcgcttccagttgtcctgcctttccaaactcaatgaatgtacatcttccatctattgatttcggtcttatgtctccctaaaatgcgtaaaaccaagttgtagccagaccaccttgagcacatgttctcaggatctcctgagggctgtgtcacaggccattggtctctcatatttggctcataataaatctcttcaagtattttacagggtttaactttttgtttgttgacaatccctaaacctgaaaggatcagaagagagaaacatcctgaaagagagaattggatagattattgtagtggctttaaaaaatgaccaccaattatttaacatttctcccattaaaaattagggtctatgtctcttccccttgaatctgggtggatatgcgatttgcttataaccaatagaatgtattgaaagtgaggactaaactctgatttttttttatcttgcccaaattcctatctaaggggtctggggagtcatgccctacaaatcataaattctcatcagatgggttttatttaaccttatatgtcatgatttactttccaaccttactctggcataacattatgagacaaggaagaaaatcaaaatattttaccccaaaacatgtttttttgccatattttgaaatggccctgcaaagctgttctttgtggagggaaatttgcaactgtaaagaatctctattaacatagctagatctttttctc

SEQ ID NO: 17841 - DNA, 12658 bp, Homo sapiens
cgtccttctgctggtataattattttaaaatcacaggacagggaagggcccagtggctcatacctgtaatcccagcaatttgggaggccgaggcgggcggattacctgaggtcaggagatggagaccagactggccaatatggtgaaaccccgtctctaccaaaaatacaaaaattagctgagcctggtcgtgcatgcctggaatcccaactattcgggagactgaggcaggagaatcgcttgaacccaggaggcggagattgcagcgagccaagatcgtgccactgcactccagcctggttcccaatagaccctgaaggccctacaggttgtcttcccaacctgccccttgctccataccacccgcctccaccccataatattatacaaggacacctagtcaaacaaaatgatgcaacttaattttattaggacaaggctggtgggcactggagtagcaccttccacgaccaggagaggcactggggaggggtcacagggatgccacccgggcagctagaagccacagctgccctccacagagcggcactgcacgatgcgcaggaatgtctcgaccttgtccatgtccttcctgaagcagtagagcagcccgtagttcttgagcagtgcgtcatcgttgtgcgattttgtgtcaaacttgctgtaggactgattgaagatctgcccagtccgggggctgccatcttccagcctctgcaaagtgaaggaagagaaggagaggccaagcgcttgggcactgttccctccctctctcattcatccattttcctccctcccctccaggttgtagagaaaggcctggaggattcacgaggggaaatgaagaatacggtgagttctcttgggtcagcgcctgactgctaaaaagagggcagcagtgtttctctccccagtccctggaagccagtggggccccaggattggggatccctggtgccaccctcacccacatcagcgtttggatgccttcctctaggtccttcaggtggcgatagacgttgctgtccgaggcgccatacaccaggctgttggcgaagacgctcctgaggagctgcacgggctccagccatgactggatgagcagcagggagatgcggagcagctctaggttctgcaggggaaggaccggcagtggctgtgctgcccgggggctctgaccacaggtctaccccatccccacctggggagaaggcatccactcacagatttctgctgcgttttcaccctgttggaaggtgttggaatagactctgagaagcagagggaggtctgggggttctgcaggaatgaatacttctgctccttcaggatataggcttcttcctaggagaaggaccgcccaccaaggtctatgctggagaccagctcccattgttacttttctgggaacctcactcagcgtatgctcatctgcctgcattttcacttcagaaaacaaccctgagctccttagtctcctcccattacttcccagcgggggaaagtcaccccttcctgccacctctgaagcgcacccattacccaagagcttacaaactcctgataggtgtcatatgccagctggtacaggcgacgggcgcggagcatagcgttgtcaaaaagcctggataagggaatggttgggaaggcactgccctcttgaagccaggacaggcagagcaggccaaaagccaggagcagggacgtccgggagcctggggagaaaccggagggcaacagagggagctggagagcaagaggccagcgctctccctgttccaggagctgggtttttttttttctctctctctctctgcctccctccagggaccaggaacattcagagattggccaaatactgggcttagatggcgatactaacattcataagccccaaacctgagggttagtgcccccgtcccatctacaggacgccgcctctcccctcaggacacattgtgcccaaagggattttaggggcgcttacctgcagccattgccgctaggtgagctgtccacaggaccctgagtggttcggggagttgggccttgggatccttgagctggtctcttgtgggccctttttatacctggccccttctctctcgctgcttctcctcacctgtttctctgcatgtttaggcctggggccactgacgggcttgtgctaatggataatttagaagctcctcccacacatgctgggatcatgccccctgacttgtcatctttcccttcccaccatcaccagcgttgtgagggttgtgcacagaatgtcagcagagataccacccaacttgtcctctctttaagggtcacgtgggtgccctctggcagcaggccatggtggccaacctgaacgcggagaaggatgtcaggatagccagtccttgagacccctaccgaccccatcccactctctatcctattcctttcctcctccccgcatgtttcccctccacccaccagacagaatgtgtgtgttgggaaaaggggccaaagcacagccaatagattgcgggggttctgggcatgattcagtgctgaattccacttttgctgactcctgggctcgcctgagacaggcccgcctggatgcagtgctaatactgaccactagagggaacaaactccacactttgctctcccctttacctgagccttggggcgggggcgggggcggggcgtggggatgggggtgggggtgggggtgggtgtgggtgtggggggggggggctcccccaggtccctggggacgaataacccagactcaaggtattgccccagctccttggacctgtagcagagatacaaaccaagaaacagaaatcccgggaacagacacggaccacaagcgcttcctcccatagtcctgaaaccaacagagaatctcaaagttggaagagctcttgaagatttgagtctcttccccagctttaaaactcagaacacatcacgccaaaagacgccctatccagccatggaagcccctcctcttttgtctcctcctcctttccagacctgtgtagagcttatccagttgccaagggcctgcctgtgcattctcacgtctgacctgccacttgtcttgtgtaggagctatgactatcatcccatttcacagatcaggagactgaggctcagagagactgattacatgagctacctcagccagggcagcagatcttcacaaccttgctcttcccacattgcgtcatttaaagtcctttctccaggccgggcacggtggctcatgcctataatcccagcactttgggaggctgaggtgggtggatcacttaaggtcaggagtgcaagaccaggctaacccacatggcaaaactccatctctcctaaaaatacaaaaattagctgggcatggtggcacgagcccgtaatcccagctacttgggaggctgaggcaggagaatcgcttgaacccaggaggcagaggttgctgtgagccaagattgcgccactgcactccagcctggatgacagagcgagtctacatctcaaaaaaaaaaaaaaaaaaaatcctttctccagagcacgtagtgtggtgctactcagttatttagttattttagcttcatttccttttttttttttttttgagatggagtctcattctgtcacccaggctggagttcagtggcatgatgttgcttcacagcaacctccacctttgggttccggtgattctctcgcctcagcctcccaagtagctgggattacaggcgtccaccactatgccgggctaagatttgcacttttttagtagagacgggggtttcactatgttggccaggctggtctcgaactcttgactttaggtgatccaccctccctggcctcccaaagtactgagattacttgcgtgagccactgctcccaacccagttatttcagcttctatatccctctgagtgcagggatcctgcccccaacacaaggggccctttgcctcattttgtctttccataaggggcagattgttctttctcaattctcaggtgagaatggcccagtggcatggggtgccttgtggaaacctcagagcaggacaaggtgaaggcagagaaggccaggactgagcctcctgtctcctggtgcccagggttggggctacttcaatataatctggaggtcacaagcatcagatacccccagagatgagagcaggaaagagcaccctctctagtggtgaaatcttcccccctgagtttaagagcatctagcacttgactctgtagaaacacaagcaagcaaacaagcaaatgcttccagaagtggttggctgtggtgttggcaaccaacattgaaaacccacacccctgtggcctaggatgtgaatgctggggccctgccatctccccactttcagagcggaagacagagctccattttctgccatcattcctgaaacattatcggaccagcaccccagactcatcacctgctgggagggcactgtgctgtgggctgttctccaggcccgcctgtgtgaggatccaagaggggtgtcatcaatgataccagctctgagaaatatgtggccaagggagggtggagtcaccactttcccctgctccttccagcaccagcaaagaggaggagctaggtgggaatggaagagggtccctgagctccatgtagctttctgcctcccccaccatccttcctccaatgtcagctgggacagggagcccccatgacaggtccttttagccagttctggggacttcgatgtggattttcggccatggaagaagtctccagcctcccttaggaatgagggtggcaggggccctagttggggaccactgcataactccgcaggtgggcacaggggtggcaaggctccccaggcaggttactgacagcaacacgtgggaccagccggggcaggggagtgtctcctctcacctctccacttctgttgaccccagaattatggtgactcagaggactctagggacccctggggaaacacctttataagggattaccatggtaaccatggaccagagggaagaactgaggcccacaggtgtgggtagaagtcaatgatcattttctctagtctagatcttcccagagccttgagcaatggagaccacatccatcattcattgctagtaaaaaatcatctttgaattagacttgggattcccctgacagtactgggaggtcgcccactgttggggcatcacttgaggccagatccctggctcctgcaggctgagagagtacccaacaagagcctccacatggccaatggggagaggctgcgctttgcacctctggcgtcagcttcaaaaggctcaggataggccggcgtggtggctcatgcctgtaatcccaacactttgggaggctgagacatgtggatcacctgaagtcaggagtttgagaccagcgtggccaacatggtgaaactgatctctactaaaaatagaaaaattagccgggtgtggtggcatgcgcttgtaatcctagttactggagcggctgaggcacaagaattgcttgaacctgggaggcagaggttgtcatgagccgagatcgcgccactgcactccaccctgggcgaaggagtgagactgactttgtctccaaaacaaacaaacaaccaaaaaaaaccaaaaagaaaagtagaaaaatcctcatctctgagttcaccgttacctagctccttacccaccgagaaacaaacatgggaagcaggggccccagggccaccatggacagagcagggttatcatttagtccaaatccataagaacaccctaggtttcatctgggactccctgcccatacggaaagtgggaaagaagagttggctcaaagcagggagctgctagtgctcccttgggaaggaaagctgttgggtggaggggacagcatttgggtgaggggaggagagggagcagggggtgaagtagggagggagtgtggtgcactgaactcagctccttgggatactgtttctgcagaccmaccayggttagaggaatccagttgctctgccaaacagacctggctggaagggatggaacacamgctcrcctgcgtcccaaagggaaacccagctccagccttggtgtgtacctggaatggggtggtctttgaccttgaagtgccacagaaggcaaccyagaaccacactggaacctaccgctrcacagccactaaccagctgggctctgtcagcaaagacattgctgtcattgttcaaggtaacctttgctgccctgctgccaggcccaggatggaaacccctcaggggtttgggattcttatcyaagcatgaaaataagaaagattctactaggttgggaagaatgagactcagaagtgggcctggtgggctggggtgggtgatccttgtactctcagactttcctaactctatcttctgtgcttgggcaggactggatgaaggaatcagctctaccctctttgtcattattaccgttgcccttggagtgggtgtcatcaccatagcactgtatttgagctatcggccctgcaaagtggacaggaggcaaattgctctataggcagaaagaggaggacaaagaggaggaaagccatttgctgttcaggaagagaaaagtacaactcatataattgacagctatttgattgaatgagacttctggctactgtggtttcccagggagggaagaagggatagaggagaaaggaagaaacacaatggcaggctgcattcccctttgtgtacgtctgtcctgtaaaacggtgtttcaggcccccatgccccatgtcctgtgtgtccaatatgtccacaagctcacctttctctctctgtctctttttttttttttgagatggagtctcgctgttgtgccctaggctggatgcaatgatgcgatctcgggctcactgcaacttcagcttcccgggttcaggtgattctcttgcctcagcctccccagtagctgggattacaggtgcacaccaccatgcctgtctaatttttgtacttttcgtagagatggggtttcaccatgttggctgggctggtctcaaactcctgacctcaagtgatccggccaccttggcctcccaaagtgctgggattacaggtgtgagccaccgcgcccagccacctttctctttagagctcactctattcattaggaatctcagtctcaatgtttgatttgtaagaaggcctcttgctccttgccaggtgcatcatcagtccactcttagatccaaaaaaaaaaaaagaaaagatcttgccgtttcttcatggttctcactgcccttttctcttaaacatcatactaaagtcaggcatatcttagaaatacaactcatatttcatggttttctgattactaactgggaactaaatctgtagtccaaggacaggactttgaagggagtaagtatcaaatatggggccaggaatcagagctctgttcctatctccactttcccttgctcccctgacctgggcttctggagggccagctcccagagctgagcttgttgacatcattaaggatcagtggcaagcttcaactcagtaaccatctgttgcgggtcttgggggagtatacagatggtaagaaattccactttgggccagacgggcatcctatctagctcagtattctgtctctgaaggagaaggtagagttcttccatgaaattggcctcataggttaagagctccaaacatctctgaattccttttcatagagtgatcaactgtgagttcgcatttgccagttttcttttttttacccatatgggcatctaggttaaagttccaatctttactctcccttttcatcaataagtgcatattttcttctgtctgtaaacaatttccttgaagcttcaagaggaatcttcttgtgaaaatgttcatatgattttatgtttcagcttctttccctgtccttgggaaagagtatattcaccctcggagaaggcgtgaggaatcacagaaccagatgttttctcccaaatcagtcaagaaatgttcactggaatgttgctatggtaaaaataaaagtggttttatgatgtccaaatgcagttcccttcccttctgtgtcattgctaaaagctcttatgtcaaatggctgcattttataacttttttttttagatggagtctcgctctttgcctaggctggagtgcagtggtgtgatttcggtccacttcaaactccacccccgggttgaagcaattctctgcctcagcctctatagattaagagtagctgggattacaggcgcccaccaccatgaccagctaattttttgtatttttagtagagacagggtttcaccaccttggccaggctgatcttgaagtcccgacctcgtgatctacccacctcggccttctaaagtgctgggattacaggcctgagccatcactcccggctgcattttataactttaagtacaatttctaaggaaaaaataccgtgttgatagcataaacaaccagcccagggccgggggtgcattaactgagggcagcagcctatttgacctgctttcaaaactgaaattcaggctggtgtggtggctcacgcctgtaatcccagcactttgggaggctgaggcaggtgaatcacttgagccctggagtttgcgaatagcctgggcaacatggcaaaaccccatttctacaaaaaacacaaaacttagccaggtatagtggcacatgcatgtagtcccagctacttgagagtctgaggtgggaggatcacttgagcacgggaggtggagggttgcagcgagttgagatcatgcactgcactccagcctgggcaacggagccaggccctgtctcaaaagcaaaataaaggaacaaaaatgaaagctaaaggtcagacttccagatagagagaggtccatagccttccaaattgcagataccagctagaaaaaaccatggcatcagacagcagagggaaaacgttttcccattcttcccagacctcccctgagtctggtgttatagattaagtgtaaaagtaaccctttggtttcaccacatacaaggcagtggggatacagtggtgaacaaaacattgttcctggcttccaaaaatatattaggaaagctagacaaacaagtaggagattacatttgtgcatgaactcctatgactgggaaaacagattgttaagagaaagcataactcggatcaaggaaggcttcccggagggacacgaaatatcttgactttgtaaaatagcatcatccccgaacatgaacttttcaacctcaatgtttccactaggtggagctactgctccttcatcatgtgagtctaatataaatcatccaccttccctgaattgagcatttggggaagtaagttaagaagcaggtttaagagacaggagtatacagccacaccatgcagggatccacagccattttggtgtcaggatcagtcgcatcagggctgtagttaccctgtatctgcaaaccctgcctcatggcctcagtgccttgaagcacagcgaatccaaaaaggaagggaaaaatgagccaggcatggtggtgtgcacctgtaatcccagctactggggaggctgaggcagaagaatcgcttgaacccgggatactgaggttgcagtgagccaagattgcaccattgcactccagcctgggcaacagagtgacaccccatcttgaagaaaacaaaaacaaaagcaaacaaacaaaaaacaaaacaaacaaaacaaaaaaaagagggaagaagggggccacttggactttctagttccagcagggagatcctggaggcttagccggctgctgcctttgcttctcactgccacagggtgtcagtgttgacagatggtcccacacagtaccctcaaaccaagcgggtctgcagatccgggttcccagctgctgtggatctctgagggaggatgatctgcttcttcggggcctggtccagctgcgggtgtcctcttgctggggtttccagggttccagttcttagagctcagtagtttggatgagccgtcccgcaaagctcttcagagtaggctgggctgtttcccttgtagacttggaacctctgttcgctttccttcccgaaggatccacacaaccagtggtcaggcaggcagccccttctcattgattcttttttttcttttctttttttttttttttggagacagagtctcgctctgtctcccaggctggagtgcagtggcacaatctcggctcactgcaacttctgcttcccagcttcaagcaattttcctgcctcagcctctggagtagctgggattccagatgtgcgccaccacacccggctaatttttgtgttattagtagaaacaggatttcatcatgttggctaggctggtctcaaactcctgacctcaggtgatctgcccagcttggcctctcaaaatgctgggagtacaggcgtgagccaccacacccggcttcattgattcttaaagtaggaagggtctcatatctcttttccagtataatagagcttctaagggtagctgcctcattgtctataagaggaggccccaccctctaaatggttttgatcatattctttctgaacattaaagcaaccagcttatgcttaaattgcagctaccttgattatctccagaggaagagtggcctttaatactccaaaagtttaccctctttcttactatttttgagagagaatcttgctcagccatccagctggagggcagtggcatgatgggctcagtgcaactctgcctcctgggctcaagtgattctcgcgcctcagtagctgggaatacaggtgtgcaccatcacacctggtaatttttgtatttttagtaagagacggggtgccaccatgttggccaggcttgtctcgaacttgtgacgtcctcccgcctcagccctccaaagtgctgagataactggcgtgagccaccgtgcctggccgtttatcctctcaaggatggtcagggtgacattctggtgtctttctctctagacctgagaaagcataagttacatcgttagtgggacttcttaccataggattaataatagtatttaccttagagaattataattagaaagaaatgacacaatacatgtaataaactagcatggtgctggagatatgtgttcacattagttgttttttattattacactgataattctagtggtaattaagcacatctttataatcacagtaaactcaaagcaagaatcagaaatccatgataaccatgagggccatcaaaggtcatatacaccgagcacagctttccggtttttctagtctttttcttgctccttcccctactttccccacagtttggtaccctaagatttaggactactaatagggtgaccagtcctgttagctgagtgttcattcagctgagggatccctggaaggaacgtgggactttcagtgttgacattgagaaagtctcctgcaaactaggacgagttggtaaccctaatcccagcggtgctcattgtgtgccacagcacttcagggccttctgaattaaagaagcagccaggcaaaatgtcagcttgtcttggcctagaagcccagaccctgtaattcagaagaaaagggaaggggtcagttctgctctcaactgtgtataaagggacaaaacccaccatgtgtatttcgacaatgctcatggaagaaattcagaattggtcactttaggttagggtaaattcaaaaaaaatgacagagtcagtaaaacattatgccaggggtcaaggatgactggagctctgcctgctgaactcttccctgtgcgagtctcactaatcttatcttcaggaagagttttcgatagaaaataccattaagggccaggcctggtggctcctgcctatgatcctatcactttgggaggccaaggtgggtggatcacctgaggccaggagtttgagaccagcctggccaacatggcgaaaccctgtctttaccaaaaatacaaaaatctgccctgtgtggtggtgcacacttataatcccagctactcaggaggctgaggcatgagaatcacttgaacctgggaggaggcggaggttgcagtgagccaagatcccaccactgcactccagcctctgtctcaaaaacaaaaacaaaaacaaaacaaaaagaaactattaacaatttttagttgtgagaagatataaacgtttccatcttaaccattttgcctgtgcagttcagtcatgtcaagtacattgacatcgtcatgcaaccctcaccaccaaccatctccagaacccttttcatcttgcacagctgaaaccctgtgctcattaaatagctccctattccatccctccccacagccactggcagccaccatcctactttttgtctctatgaatttgactgctctgagtacctcatctgactggaatcggagagtatttgtctttttgtgactggctcacgataaacacttttagatgactggttggaattaggagcaggtggcaccacaactgccatctcctttttctcctttttctcatctcctttttctctgttttccctgttccaccagtacaacagctgtgaacacatgggtctcatctttgcggtccctaacacggtggttctcaacc

SEQ ID NO: 17842 - DNA, 19876 bp, Homo sapiens
ctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcggcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccacagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccacagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggcgccctgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagagcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacgaggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgatcagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtgagagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataatgaaagagtttcaggagaaacctgtctggttctgttggaaaaactccgtctcctggcgcaggacagccccaaacacctctccctgcaagtggctgtgcacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacamgttagcgcmgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccgrggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcckgtagcagccagcgcttgcaacccgcaatgagcatagagtatttcttttctgagggggktcgtctagagtgtccgtgaagggamcaggcacgcgaggctggtggaaaaagsgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttaggatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtckgtccgtcggaaagcatactcagaggagcgtcctttggggccagagtaayttacggcctggtaagaaagacacagtgaaaccacttataatttgggaaatctcccctcactgccaaawgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttaccyccctggctgctgagatatgtatttacctcttgatcggaaattccataactgaaacttttattttcaaccatctgtatgtgttccttgctgcttctctcctgccttgcccctggccatgctaaccactgccctcctygattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccrttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcrttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatrtgacctgtcccagtagtgtacagggatgagtaaaggaatagggtctgagagggggacaggagatagatttttgagggtcttctttccatctgtgcttagggatcaaaaagatgattctgtcaagcagatayctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcaccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcrcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagyacctcatgagacggttattttgagaaccacrttctatatgtgaacacagtttaaaagctgtaaatcactatcctgatataaataatcaggaagaaggtgatattgtgacccaccataatatcaggcagttaccatacgagaaatcaaggtcgttgggayggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgawtctttaacctgaggatccctttcccaggtatatggaaccctgggaggaatgctgactcgacagccttttgccattggtggctccggcagcacctttatctatggttatgtggatgcagcrtataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggytcttgggcaatacggataaaccagggctgttctgagtaaatcaaatgaggatacacagtcactgtgagaaccagtggtgtgctaagcacagtggctcacacckgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccacggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctaggrccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtaytcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagygtgggtgacagagaaagamcctatcttaagaaaaaaaaaagaaaagaaaaagaaaaaacaaacaaaaaaaacacccaaccctatataggtaktattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacataygaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcrggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattrgaagacttcggccaggcgcggtggctcrtgcctgtaattccagcactttgggaggccaaggcgggtggttcacctgaggtcaggagttcgtgaccagtctggccaacatggtgaaacctcatctctacttaaaatacaaaaattagctgggcrtggtgcctgtaatcccagctactcgggaggctgaggcagggagaatcgcttgaacccgggaggcaaaggtggcagtgagccaagattgcgccattgcactccacctggacgacaagagagaaattccatctcaaaaaaaaaaaaaaaaaaaaaattagaagacttcatttttctgtattggccaaataactgttctaatgcccttcattccaataaaaggtttgtagcagcttacagagataatttaaaacaatttttaaaagaagaaaacaacactgggtcagagagaaaatatggttaagaaaagtaagtgaagccaaggagtgaaactaatggaaactaatggacaacgtgaatatcttaaaaaaaaaaaaaagtggtgcgctgtcttatactggctagcaagagcagattgcaaagtattcaggatttttgaagacagttgttaactattggtaacttgatattgaccactatggaagtatttatactatagaaatcagcaatgctacaagtcagaagcattgtttttcttcagagagccggtttaacaggacacatatttatcagccaactataaatggataaaaaataattggctccaggccataggatagtgaaagcaaagaaggaaataaaatgaggtacaagattcataaaattcattttttaaaagttgccagaaaaccaaaaattatatataatagttcaagccacacagaacatttactcaaataggacatgcatcattccataaaggtaacgccaataaattccagagtatcggtatcttagaaactatctatattctaggccaggagcagtggctcatgcctgtaatcccaacattttgggaggtcaaggtgggcagatccctagagcccaggagtttgagaccagcctgggcaacatggcaaaaccccgtctctacaaaaaatttagctggatggggtgcacctgtaatcccaactagtcagaaggctagacgggaggatcgcttgaacccaggaggcagaggttgcagtgagctgagattgtgccactgccctccagcctgggcaacagagtaagacactgtcttaaaaaaaaaaaaaaaaaaagaaaaagaaagaaagaaactatattctgcaaccatactgtaataaaattagaacttgataactaaaatatacttaaaattgtaagtgaacaaatatatttatcagtaacatggatttaaaaggcagtcgtggatgggagcatcgctggagtccagaagatggaggctgcagtgaggcatgattgcgtcactgcactccagcctcagcaatagagtgggaccctgtgtcaaataaataaacagcagttataaagaaaattaactcttttagaaccaggtgttaaaaatgttacacataaaatatacatataaaataatattataatttcaaatacatttattagaacaagaaaagttaaaataaaggacctagaaattctactcaaaaatttggaaaaagagaagttgagcaaacctaaagaaatacgaagaaaaggagttataaagataagaatagaaagcaatgaaacagaaatagagaacaaaaaactaggtagtgaaaattaacatacttttgattccaaaagctgcttacttaaaaatatttgtaagatattcagagttacaacaaggccgattatggataaagggagaaaaaatgaataaacaaatacataatgaaaaagggggaacagctacagatatgacacagatataaagcatagagtgttatgaacaagtatatgctaataaatttgaaaacctaggtgagataagcaaattcctagaaacatttaatctatcaaaattagcacaaaaagaaatacaaaacttgactataccaatgagtattaaagcaatttttaaagttatcaatggcatctaataaaaaaatatatttttgaaaatgcccagatggtttcacagatgagttctatcaaacattcaaggaacatgaaacttctatattatatactttttccagaaaacagaaaaaaactaaacctgattagctaattttatcagccgagtgtaatcttgactccaaattgagttgtggaaaactcaaggaaaaaaaaataatagacccatttcaccttgaacacagatgggagaaaaaaataattatttatgaaccgaattcaacaatattacaaataataatactgggaggccgaggtgggaggatcgcctgaggccaggagttcaagaccagcattgtcaacatactgagatcctgtgagatcctgtctctacaaaaaattaaaaaattagccaggtgtgatggtgagcacctgtagtctcagctactagggaggctgaggcaggaagatcatttgagcccaggagtttgaggctgcagtaagctatgattgcaccactgcatttcggcctgtgcaacagagcaaggccctgtctctaaaaatatgtataataataacaataataataatgattatgctaataatgatacatcaagatcaaatagggaatccttggaatactagggtggttcaatataataaaacatattgttgctataatttaccatattcatagaaaagtcatttcctttgctcagtctattaataaaagacatttggtaaagtatatccatttgtgatttttgaaaaacagttaaggaagcaggaatcaaaactttcctattttggcaaaggttataatccaaaaaatctgtaaccactagtatacataacggaaaaaccttgggtatccaagacaagaatgttcactataattactagcttatcatagcactaaagcctatgggcaacataacaagaccccatttaccaaaaataaatttaaaacattttaattagctggcatggtggcatgcacctgtagtcctacctacttgggaggccaaggcaggaagattgcttgagcccaggagtttgagcttactgtgagctgtgatcacaccactgcactccagcctgggtgacaaaggaagaccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaataaaataaacaggaaatataattaaagagttcaattgaggattgggatttagaaaggaaggcaggaattaagaataatccttagttctcttcctaatttgcacctctctcactgatacatatgtattattttctttttatgtcttttagaatctaataaacatgttttatattatataacaaactagaatatatggattatctttggtcttccttaccaagttcttaactctgctggctctggggcactggacataccatgtaagaagaaaaatgttttaactccattgaacttattcagaagcatcggaaattggttcagcaatattcaactttgcccagcaatgtttatgaaagtttcatatatagtatagtataagtatgtgtaatacagaatttatgttctcaaaaatgaagagataaagtatggagattctaaactctgttgacatagaagagggtggatttctcgaagaaacagccttctatagaaagtggcttgtatgagtcgggattctccagagaagcagaaccaataggatgttggcagagagagatttattttaagtaattggctcatactactgtgggagctggcacggtcgaaatctgcaggtaggctggagacccaggaagagctgatgttgcggcttgagtctgaaggtggtccagaggcagaattccctcttccttggaggacctcagtctttgcccctaagaccttcaactgattggaagggccacttacattatggagggtaatctgctttacccaaaatctattgatttaaatgtaaatctcatctaaaaaataccttcactgcaatatctagactggtattcaaatgtctagaaaccatagcctagccaagttaacacataaaattaactatcacttggctcaaggtgaaacttccagatcaatgtggcaggagtgttgaggaaggaagtgaactcggttctaaccaagtaggacagccgaatcatcactgaagtgtggcactggcctttcgccaaggtaacatgtggcaaggttttaggttaggataggtaccaggcaaaagctgggtgactcgatggaggcttttgtgccaaccttcagagactggctgcgtcagactgccctcaagagcatacaaaggaaaaaaagacaaattaaaagcctttaatccaaactcaagacatgaatgaaaaactgtaaatgcctctatagcagttttaaaggctatcttttctcctgcaacccagcacagatatggctgagggtcaagcccgggggcttatgataaaggttatgaagttgtagaaatgtttgttgcatcatccaacagcagctgttgtgataaggcaagacccctggttgggatagaccggaccctgagatatgaaatagggacatatgagcagacacagagaagtctgagtgagaactatgaatcaccgcaccccctgagggtccttgctggaagaagcagactcaccgtattagttacctattgccatgtaatgaatgacacccgcttaaaataacagacatttactataaggtgttactgggacaataggggattttttaatatggattgtgtgtttgataatatggtatcaattttaagtatcttgggggtgatgacagtattagggttttgcaggagaaatgtccttattcttaaattatacatgacaaaatatttaggggtcaagtggcataatttccacagattactctcaaattgtttaacaaaatggttcttcaacagtaaatggataaacaaaacgtagtctattcgtgcaacacagtactatgtaaacaatgaaacttcatcaactactgaaaatgtaacaacatggacgaatctcatagaaacaatattaagtgaagaagccagacttgcagaaatacatactgtatgtttccattatctattgctgggcagcacaccaactccaaacttaatggcttaaaacaaaaataatcattttattatctctcatgaatctgtgaattactggactttaagagccactgatgtagtccatgaaccaaaacacatattcacggcagccactccacccagcacctcacacctgtgatgtttactggctgcccatgggatttgaacacctttagagtactgtgaaatttcccctaccttttgagtcctgcctccctaaagtggaaaccagaaagctcacttcccctagccttctttgaagctagagcacctaagttccaccaattaaattcatccacctaagacttcagttacaaaggggccacaggaggaaccagggtgtgggggttgcagagcaccttttactgtatttatttctctggcaaaggtgacagaagaagcaactgtcttttggggaagcggtgggttttttccttttttttttttttttttaagtgaagttcctgaaacagaagtggtttaggaggtgtcttcagtggtggctgcagcaacctccaggtcctaacaacagaaccaacagcagcgtctagaagccatggggcagcagcagtggtgtggctcatcagacctgctctctgcgtggtctgaccctgtacatacatgtgcctctcatccgtagttccagcatttcctctctaaagtctagttctgagagaaatttctttggtagacttttcaaagttttatcaaactcaaagagggaaccagcaagaatacaagagccttgatccaaagagtatttgaaaaacagagctgtatctctctgtgaggaaataatttctaggctagagattcaaaatggctaacgtgctagagggcaataaaatcataaccttggtgttatcttctttaccgg

SEQ ID NO: 17843 - DNA, 84886 bp, Homo sapiens
aaatagactatataacagttttgaaatttataaaggtaactatgcatcagaatctctatatatccatgatgaaaacaaaaacaaggagcaacaggaaatgctatgtaaatatccttgaatattgaatattgaactgtaactagcaataaaaagattgcaaaccctgtcccctcctcccccaccccaagccaataaagttgctcaaaaacatcacctcaaatttcacaaaaaaattatgtgattatttgaagacgaagatggggaaaatactacacattagtttataactcttacctcctcattcctccaactacggtagagtcagaagagctctgcagcattggaaacatctgcataaaaatacacttgcctctggctgggcatggtggctcacacatgtaatcccagcactttgggaggcccaggagggtggatcacctgaggtcaggagttcgagaccagcctcgccaaatggtgaaaccccgtttctactaaaagtacaaaaaattagccaggcatggtagcgggcacctgtaattccagctactctggaggatgaggcaggagaatcacttaatgtttcatgtttaaattttctctattttatgtaatgtttctttactttttaaaaaatactttattatagaaaatttcatacatatggaaaagttcagaaatatcaatcaaaactacaatgagatacagaaaataatataaggagcctccttacacctatcaccaaacttcaacattttttttttttttgagacttcctctatcacccaggctggagtgcaatggtgcgatcttggctcactgcaacctccgcctcccgggttcaagcaattctcctgcctcagcctccttagcagctgagattacaggcatgtgccaccacgcctggctgatttttgtatttttagtagagacggggtttcaccatgttggtcaggctggtctcaaactcctgacctcgtgatccacccgcctcggcctcccaaagtgctgggattacaaacttcaacaattattaactcatagccaatcttatttcattgatatttttacatacattgttcatattaatttaatgggcaaataacttatattagtacaatagtatatatttaatatttgtatcttttaaatgttttatattcttccatgttttgttatatcctttttttatgaattctggacacaaaaaataaaatactggtattcatactgtcattttgatattacactaaacactcaaatactgatattgtcattttgctttgtgcttcactagtaaatggggcctaagcactaaaacgcttgttttatgcctgcataactcagccctctgtagaacaatcaatgtcttgattacctctatattacaactttataccaaaatctttattccttaactacaaccaccatatttccacatggccttaaaaacagattaaacagaaatttttttctgaaaacttttctttcaaagcagtatttacagtatcatccagcagaagaacctgtactttataacttacaaattttaccactacaaaattcatacagtatcataaggccaaaaaaggaactaaaaacttaatgcattttagaataattagggacactgtgccctctcctaagcatatatacccaccatttttgtcctttagtagtttattgatgatgttactaaggtcggcaatttcagaggcagcagggattgagaagggaacatcatctacggcatatctataaaaaggaaatgatatgtcaagatcaagtctacagatatttgaacaaacatgcttttacgaattcaacatacatttattgggtaaataaatgccagacatccagacattttgctacatgttgtaaacaaaaatgaattaaaacatggtctctgttctaagatgaggttgaagtttagtaatcaaatagaatgaagttatataagaacaatgccattaggtgacatgtataaaaagaacaaagacaccataggtcattttaaccacagaaaaggagggcaggggagcagggccagaaacgatccacagaaaagataactgttaagcaacatttagaaaagtgattagccaggcgtggtggcatgtgcccgtagtcccagctacttgggaggctgaggtgggaggactgcctgagcccaggaggtcgaggctgcagtgagctgagattataccactgcactgcactccagcctgggtgacacagcaagaccctgtctcaaaagagaagtgagtttttgccaggtgagggaagggtaggctggaagaagcagtgtggacgaaaccagagagaacatcaaaacaatagctaggagttgttaaactgcccagccacttccagaaaatctgactttgctccaaagtgaccaaaggctaaagagatacacatggagtgctttatatatcatgtgaaatcatttttacttcttttttgtgggtaatgaagaactatcacagcagtgcaaattagaagtatcatcagattttatttagttagatctttctggctgcacaatgggcactgaaatagaggaacacatgacaggaggcagattaggagactcttataagagagactgtgagaaaatatttgcaaatcatgtatctaataaggaacttgtatctagactatattaagaacacttacaactcaataataaaaagacaacacaaattttaaaatggcccaatagggacatgcaaatgctcatcattagtcatccaggtaatgctaatcaaacacaatgaaatataatttcacatccactagggtgctataagtaaaaagacagctaataacaagtgtcagtgaaaatatggagcaattggaaccctgattattgctggcagtaacgtaaaatggtgcagttgctttggaaaacagtctggcagttcctcaaaaactcaaacatggaattacatctgacccaaaaactccactcctaagcatatatgcaagagaaacgaaaacatacatccacacgaaaacttgtacgagtgttcacataacaactattcataatagctaaaaggtataaacaacctaaatgcccaccagctgatgaatggaaaaatatggtacctccattcaatggcctattatttggccacaaaaaggaatgaagtgctaatatatactatgatataatgaaaccattttttaaaaatcatagtaagtgaaagaagccagtcacaaaagatcacattatataattccatttattcaaaacgtccagaagagagaaagttacagagctagaaagtagatcagtggttgcctagggctgggggtattatttaacaaacagctcaaggatgatgaaaaatgttctaaaattgactgtggtgatggttgcacaactttgcaaatatgatgctgatgatcctcaaaccacactttgagcaataaggctatagctatatatttatgtatataattcacatatatgtatattcttgtgtgtgtgtgtgacaattatattagccccccgcctccattttactgaccataatattaagcaaaaagaaaaagcaagaattttattatttatttatttatttatttatttatttgagatagagtctcactatgttccccaggctggagtgcagttgcattgatcctggctcactgcaacctctgcctctcaggctcaagagatcctcccacctcagcctcccaagtagctgggaccacaggtgggcaccaccatgcctggcaaattttttgtatttttggtagagacggggtttcatcatgttgctcaggctggtctcaaactcctgagataagcgatttgcgttcctcagcctcccagactgttgggattacagacatgagccacagcactcggcaaagaattttaatttctacatttttttaccttttggagggcctaaattcacacacacacatatgacatgtatccattcatttcaggggttaaaacacagtggcctattatctcttacaacttcatgtgaatcaacaattatctcaaggctggacgcagtgggtcatgcctgtaattccaggactttgggagaccgaggtgggcggatcacttgaggccaggagttcgagaccagcatggccaccaagacaaattcctgtctctactaaaaatacaaaaattagccaggcttggtggcacatgcctgtaattccagctactctggaggctgaggcgggaagattgtttgaacccgggagacagaggttacagtgagccaagatcccaccactgcagtccagcctgggcaacagagtgagactctgtctccaaaaaaaccaaaccaaacaaacaaaaaaaagccccacatatttcaaaaaattttattttaagaaaaacaaaaaaacctactttcaattaaaaaacacagtggttatgttaatgcatcaccacattcctagagaagtattaaggcaatgtatgtaagtaagtacatatactcaggtgcattgataatacgatttatgtatactttcagcaacaacacaaggggagagaagatgatttactagctctcctcataaagctacaaacaaaaccacagatgtaactcaggtgggagtttcctagtttatggctaactttagcttattaacacgacaaatattatcattttcactgaaaaatttgacattttttgttgactcagccaatccaagaagcttaattaatatatagtccctgccctcaagagacttccaatatagttggaagagaccaggcaaacacaaagaaagctaacaatgcaatatataccacaaggcagcatataattagttttcgaatgagtgctaacagaccttgagaccactggttaaaatgtttatatatctatatagatatacataaatggtaaatatgttttttcattttcaaaaactttttttccgttttcaaaaactgtgaaccaccactagcagacaccctataacaaggcccactgttcatttttaaattacacatataaaatgtttcattcagaaagcaaacctgaagcccttcagcctcctccacactcacaattcaaattatatagaacctacgaagctggttagaaagcaggtaatctcagaaaaaagggtgggggtgacagcagaaacaaccagggatccacaaggtcataccaaaggggtggtcggaaaggaacctggggaagggagagaaggctggaacgcttacttacttcttgttatcagtgtagaagcgtgtttggagctgagccatggcgaggagtacacacgacttgcccacggaaacgtacgggttagcagacccacaacacgaagctcctgccttttaagactacaaagaggcagctcaaaattagactgcacaggtaagcgaggaactgcagtctaagcctggactctgccttctgccctccggtctcctctgcagaaagcacgaggttgcccttctacagacgcccagaccacaaacatcgactacctactcctagatttaggagtcatcgattagaaaaggatagtcgtaaaggtagcatgtccctttaatcattgttagaattcttcccatacgtgtgggcccgtaatcgattaggaaaaagatcccactcaaatccgctttattaataaaaaattttttttcaagaggctgtcctgagcctggatagttcaaacacagctcctagttactacaagtctcagaaagcatcgcttctcaaacgctgtgaccaccgggaattgtagtctttttttgccacgctgccctcagagtatcttatttgcattaaatcctctagactccagccagatatcaaatttcctctgccttcagctttgcttgactaacgccttgccagtttttttttctcatacatattcccaaccagaggctcactcggcagaggtttttcctaaatctcgcctctaactgcggcttttagagagaggcgagaggcggaaatacaaagaaaagaacggatgagagaggaaacggtcgacggtggccgatagtggtcctactgtcgtgggactgctctgcgcgctcccggtggggcgcgcctgcgcattatgctggtctccatggcggggcctcggagccaagacgaggttgagtagactcgttttgaattttctcccctctgctccggcggacttcccatgtcgccttgtggggctatcggcggcggcaggactgggggagtcagaggtctggcagcgctgtctgcgcagacctaccggacgctacctcccaacccccctgtcttcctcctgcctcctcctcctcccgtcacctcctgacccgccggagctccgagcaactgccggcctccgcccccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccggtatgtgtgaaggtgaagacaaagctttccttttttacgttgtttaaagatgtcctactgtaaggtagacgcctaatgtttaaatgaacgcctaatatttaaatagagaatgagaagagatttaaacaattggaagaaaaaataatttttattagagagcaatgacaataaaagtaggactcttttcagtttactcacctttgtagctccgaatccgggccctggaaccagaattcctgggttcaaatcctgcctctgctacttgattaacctttttgtgccacacttttatcaactataagaattaactgcggcatcggaagcactcagtatatgttaattattatcatcaaatagttactaattccagtttaactagaagctttgccagcgtgaatagataagggagaatagccacattgagtggaggaataaaattagaaaacctctgtgctgaagtcccaggagatcacttattaggcttgagcttgctaatggaagtggtgatcgtttaaccatgtggttattgtagtggtgaagatttacacattaaataagtcttgggcatctgaagcttgaaacactttcttaatgaaatcttgccgttgaatctgtacttactgataatatgtcattggttaaaatatatttataaaatgtataattgaccagcaggttaatacatttttatcattaatttgaaatttatcaaaatgagaatatacagtacctgacggtcagtggagtttgatcttaatttgatttgaaaattatgatcaggaaaataaataacctgaatatatgcttaataatataagactttgagtttgcaaaacagaaatcctgacttgactaaaatacacttttcatttgacggagacctttagttaaggaaagattagttttagcattcaacataactaaatacccagcattatgttttacggtttttttcaacaatgatttatgtgtcgtgtttggtgttgcctccaaacagtacctaggatagctgatgcttttactttgagtctttttctttagttggaacattaattgcaagcttttggttggtaatcattttttatgggatgtatttactatatggtcctcatggagacacattgttatctggagaaccacagtttggaaaatacatttctctttattataaagttttttgttttatatatataatgccacagtgtgataggatacaaagactatgcattagggctttggagtcttaattgttctttgtgtttttctttttttccaatttgattatggatccaagcctaatgcactctgtgatcttaagcaagtttcttgacagttccagttttcttatctacaaacagagacaagaagatctacctcagagtcattgtaaggattaaataaatttgtaaagctctcaaagagcagcctaatcccagcattttgggtggctgaggcgggtggagcacctgaggtcaggagtttgagaccagcctggccaacatggtgaaaccccgtctctgctaaaaatacaaaaattggccaggcatggtggggggtgcctataatccgagctactggggaggctgaggcaggagaattgcttgaacctggaaggtggagtttgcagtaagccaagatcacgccacttcactccagcctgggcaaaaagagtgaaactccatctcaaaaaaaaaaaacaaacaaaaaatcagagcaaaaaggtaaaaagtttgtgcagagtaaaacatgggtagaaatggattgcagggaagcttatagtgagaataaaccataaataaaattgacattgtgaacaccagccttagattttttttccctgaaaattaaaaagtgcttttttttatttttttattttttgagttggagggttttttggtggtggtggtggtgtttgttgttttgtttttggttttttgttttttttcagagtctccctctgtcgcgaggctggagtgcagtggcgctatcttagctcactgcaacctccgccttccaggttgaagcgattctcctgcctcagcttcccgagtagctgggactacaggtgcctgccaccatgcccggctaattttttgtattttagtagagaaggggtttcaccatgttggccgggatggtctcgatcccctgaccttgtgatcttcccacctcggccttcaaaagtgctgggattacaggcgtgagccactgtactggttgaggtggagtcttgctctgttgcccaggctggaatgcagtggcatgatctcatctcactgcaacctctgccttccaggttcaagtgatccgtgtttcagcctccccaatagctgcgattgcaggctcctgccaccactcccagctgatttttgtattttgttttgttttctttttgagatggagtctggctctgtcaccaggctggagtgcagtggtgcaatcttggctcactgcaacctccaactccctggttcaagcaattcccctgcctcagcctcccgagtagctgggattacaggcacacgccaccacgcccagctaatttttgtatttttggtagacacagggttttatcatgttggccaggatggtctcaatctcctgaccttgtgatccatctgctcagcctcccaaagtgctgggattacaggcatgagccactgcacctagcctgtttttttttgtttttttttaagtagagacagggtttcactatgttggccaggctggcctcccaactcctgacctcaagatccgcccactttagactcccaaagcgctgggattacaggcatgagccactgcatccagcagaaaatttaaaaattaatataggttattgtttatatataattgcatgcatttaaaagttcgatgtttaacataactttaaaaactgattcttaaaaaataaattatcctattaaaatatttgtgaattagtcttgatttcatttttgacaccactgattcatagtaattttgtacatattataaaaggaatgttatgtcatttacctctaaaagatgcggtaaattttactttctaaagtacttttgagcaatattttatttatttatttatttatttatttatttatttttgagacagagtctcactctgtcgccaggctgtagtgccgtggcacaatcttggctccctgcgacctgtgcttcccaggttcaagcgattctcctgcctcaacctccccagtagctaggactataggtgcgcaccaccacacctagctaayttttttgtatttttagtagagatggggtttcaccacgttggccaggatggtctcaatctcttaacttcgtgatctgcccaccttggcctcccaaagtgctgggattacaggtgtgagccaccagcatcccgccgagcaatactttttaatgtagttaataagatctggcgctgataatgaatagatttaaagatcttttacatcttaggacattaaccaaggtatctggaatttaaagaaacaacttcaagctgctttctctttaattaccctatttggggatttattctaaggttattggttgtaacaataatattttaatacacagaagtctgtgaaggatactcaacaacatggttggatgttaagaccattttttttggatattacacataagaaattgcctccaaaattttgaactgatagaattgctgttgaataagatcctaacagcagtggcccaagtatggtccttgaaggagacatgacaacaacctgaatcgtctctacccctctgccatacattcactgtctaaaaacaataaaaagccctttcttcccagaataaaaacgctgagctcgccgggcgcggtggctcacgcctgtaatcccagcactttgggaggccgaggcgggcggatcacgaagtcaggagatcgagaccatcccggctaacacggtgaaaccctgtctctactgaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagcgctgagctgctaattttacagatgctttccaatctttacttttgatataagataaaatccactttttaaatgtgataacaaaacattctagaaagcaatttgccggcaaaatttaatgctttagtgtgttttctgaaatccaatcattaactgtttaggctccatatttaatattttcttttttctttctgctctctttaattgtaatacgcttgcttaagaaataagcctgtcaattctagggtttgggaggtagggcatggggagaagagcttttattttcaagcttcttgtggctccaaaagataccctaatagtaagtattttcattgatgaaaaatgtaatttgctagagatctttgttttagtgatagttataaaacgtgagaatttaaatattccaaatacctgattttagacaaggaaacaggcacagagagattgtcacctgtcccaagatacatgtagttacctgtaaagtcagtcctcatctttagttctcttaaatgaatcaattgatagttttaccacaccaggctgataatggttattttaaaataaaacctgcataacaaaaagtaataattatctttatgtgtaggaaaataaaatatacattaaataccttctcattacagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtaattttttttaactaattgaaagtaacaactttattttaaaaagttaactattatctattacatgtttaaaaagtcaaattaccctttgtatataggtgctttgttctatttatgtttatcagttggaaaaaacattttatacttagctatttaatattaatatctgcattcttataaactttactttgacagggccaggcgcggtggctcatgcctgtaatcccagcactttgggaggctgaggtgggcggatcacaaggtcgggagattgagaccatcctggctaacacggtgaaaccccgtctctactaaaatacaaaaaaaattagccgggcatggtggcgggcgcctatagtcccagctactctggaggctgaggcaggagaatggtgtgaacctgggaggcggagcttgcagtgagccgagagcttgcagtgagygccactgcactccagtactgggtgatagagcaagactccgtctcaaaacaaaacaaaacaaaaaaaacaaaaaaaaactttactttgacggagttaattggcagttagggataaaaacttatagcatatactgacattcaggatagttgggaaaatcagctattttaagtcactttgcagttgtcaggattaaagaaggtaaagcaaattgatggaagaaaggaggaaggaagaggtaatacttttcactgcatccaaattatttttttaaagtgtgtctgtaacttaaaaatgtacttttaatcttcatttcaacaatgggttaggtcagtcatcatattaaaaccaacttttccgtatagaaactactttaatattttctcaatgtaaccacaaaaagtctttaacccatagattttcatttccagaaggcagtagaaaatatagttatttttattccattggcaaaatctcaatatgggcaaaattctgcagtaggtggtttgtgtttggcagtcttcctctgtcaacatactccccaccccttaactagtgtacttacctaagccagtcatacttccctcagtcttcactgcagcatcctgtgcaggcctgctgaatccctctaagttctttgaggctcacctgtacttgctttctcacctccaagtaaaacttttcactccctcagggtagctctttttaactcgttttaaaggaagaaatccatccttacagaaatttataccaatttgttaatggctgatgttccctccaaagttttttctttttaagaaaaagggcttattaacatcaatgaaaattttactgatgaaatttcagagtgagtgagcaaaagtaaataaagtaaaaaaaataaaattaggctagtaaaggtaacttgcagtaggatcagagtacctgtcaggaaactgggaatatttggaattcttacccctaagctattggcactttttacaacttcttcctaaactccacttctcaatctgttctacctaatgttttttcagtgactacaatgcctgcatagttagagctctagcttttgggtggtgtcggagatagagttttttgtatgttacggtactgcttctaattaaatttcaactggcaaaagttgaaaacaaaaaggaacaaataattccttttaacatctttaatttgttaacctatccagaaaaagatttaaagctatggatttttgactaataaaggcagaagagagctttgtttattggtttgaaaaagttcctattgtaataatagagtacgggctttgaaataaacacatgtaggtttgagttcttgctcagccactcagcatatttgtaatcttgggaaagttacttatctgcctatcctatatgtaaattggaacaggtaactgaatcacagcattgtcaaaagggttaaatgatataggtaaaacacttttagcatagtaccttactatggtaaatgctcaataaatgataaccttataattttgagcaatgaacctcatcatctttttctataaaatgatgataataataggtcctatatcacagaatagtagagtgattgttgataattctagctaataattatttaggatagttgagattcaatacattctattttataactatgacaattaaattcataatctttttttttttttttgagacggggtctcgctctgtcgcccaggctggagtgcagtagtgcactctcagctcactgcaagctccgcctcccgggttcacgccattctcctgcctcagactcctgtagctgggactacaggcgcccaccatcatgcccggctaatgtttttttgtatttttagtagagatggggtttcaccatgttagccatgatggtcttgatctcctgaccttgtgatccgcccgcctcggcctcccaaagtgctgggattacaggcgtaagccaccgtgcctgtcctaaattcataatcttaattgatctatcataatagtgcttatattttaaaagtcaaagagctctcagaaatattaagaaatttttttgatcttgatgtcatcatgtttagacagtgaatattcagattactttaaaaattaagccaggtgcagtgagccaagatcgcgccattgcactccaacctgggcaacaagagtgaaactccgtctcaaaaaaaaaatgggaaagaaagaaaaagaaaattaaactgtatttaaatcgtattcttgacaatttactttagaatagtaaattgtattcctaataggaaaaaagcaagaaaaaggtaaatttttaaaacgttatattcctaatagatatttcatttttaataagcccctcaataggaccttatttgcagttgaatctaactttgtaaaaagtttcctgttttaatagagtccttttgtatttctgtgtagtgcatattggaagtcagtcaataaataatagttaaatgaattttaaaaatcaggataatcaactcttagaaacataaaatcttagtattattattatattttttgagacggagtctcactctgtcgcccaggctggagtgcagtggtgcaatctcggctcactgcaacctccgcctcccaggttcaagcaattctcccgcctcagcctcccaggtagctgggactacaagtgcgtgccaccgtgcccggctcattttttgtatttttggtagagacggggtttcaccatgttagccaggatggtcttgacctcctgactttgtgatccgcctgccttggcctcccaaagtgctggctgggattacaggtgtgagccactgcacctggcccaaagttctttaattccagaaaattttagatctatgtaaacacctcagtaaattgaagaaatttctattaccttgccatcagacagctttgtattaaattaaatctctatattcaggtcagtttcttttgcattttccataattgcgttagttaattagcaaacatgagttcacttaaaatgttcagttcctctgtgatatcatgaaataaacctgattttaaaaattcagatatagttataaaacrcacagaatataaattttatacatagagactttaagtgtcttgatcatccttgtatctccagcacatagaacagtcacttggatgtgtagtaataattcattttgtgaatgaatatctgcttataaatatatatgattagaaaaaatctggaagaatatgcaaaaatgtcaatagtgatttctgtaaaattataagtgactttaactttctgatgttgctatattaacataatatttgttttaatgacataaacaataaaacttaaaattttattgaaaaatttttttttcctgagatggggtctcactctgtcacccaggctggagtgcagtggcatgattatgactcactgtagcctcaaactcctgagctcaaccagtcctcccacctcagcttcccaagaagctatggggactataggcactcaccaccatgcctggctgatttttttttttttcaatagagacagaatctcattatatttcccaggctgatcttaaactctggcttcaagccattcttccaccttgacttcccaaagtgctaagattacagggattagccaccacactgagcccttaaaaagaaatttttaatcttttgagacagggtcttgccctgtcatgatcatggttcactgcagcctcaatgtcctgggctcaggcaatccccccacctcagctttctaagtagctgggaccacgacacatgccaccacacccagctaatttttaaaaatttttttgtagagatgggggtctcactatgtcagccaggttggtcttgaactcctggattcaagtgacctgcctgccccagcctcccaaagtgatgggattacaggcatgagctaccagcctggcctggaacaagaaaaggatacccactctcaccactcatctttaatatagtactggaagtcctactagccagagcagtcagacaagagaaagaaataaagagcatttaggccagttgctatgcctcacgcctataatcccagcactttgggaagccaaggtgggtggatcaccttaggtccagagtttcagacaagcctggtcaacatgtggaaacctcttctcttctaaaaatacaaaaaaattagctgggtgtggtggcaggctcctataatcctagctacttgggaggctgaggcatgagaatcacttgaacccggtaggtgaaggttgcagtgagctgagattaagatctcaccactgcactccagcctgggtgacagagtgagactctgtctcaaaaaagaaaaaagaaataaaagagcatcccagttggtaaagaggaagtcaaactgtcactgtttgcagatgatatgattgtttacctagaaaactctaaagactcctccagaaagctcctagaactgatcaaagaattcagcaaagaaggccaggcgaggtggctcacgcctgtaatcccagcactttgggaggctgaggtgggcggatcacctgaggtcaggagtttgagaccagcctgaccaacatggtgaaaccccatctctactaaaaatacaaaattagccaggtgtggtggtgcatgcctgtaatcccagctacttgggaggctgaggcaggagaatcgcttgaacctgggaggcagaggttgccatgagccgagatcacggccattgcactccagcctgggcaaaagagtgaaactccatctcaaaaaacaaaaaataaagaattcagcaaagtttccgggtacaaaattaatgtacacaattaattttgtgcggtagctctcctgtacaccaacagcagccaagctgagagtgaaatcaagaactcaacccctgttacgatagctgcaaaaaaagtaaaatacttaggaatatacctaaccaaggaggtgaaacacctctgcaaggaaaactacaaaacactgctgaaacatagacaacatatacaaatggaaacatatcccatgttcatggatgggtagaatcagtactgtgaaaatgaccatactgccaaaagcaatctagaaattcaatgcaattcccatcaaaataccaccatcattcttcacagaattagaaaaaacaatcctaaaattcatgtggaactaaaaaagagcccgcatagccaaagcaagacaaagcaaaaagaacaaatccggaggcattacattacctgatttcgaactatactataaggctgtactcaccaaaacagcatggtactggtatcaaaataggtacatagaccaatgaaacagaatagagaacccagaaataaacccacatacgtaacagccaactgattttcgacaaagcaaacaaaaccttcaagtggtgaaatgacaccctattcaacagatggtgctgggataattggctagccacatgtaggagaatgaaactggatcctcatctctcaccttatacaaaaatcaactcaagatggattaaggacttaaatctaatgtgatgttaatttttgtttccctaatgactaatgctgatcagcatcttttgtgtgcttacttgctagctatatatcttctttagtgaagttgtatcgtcaaacatcttgccaatttttttagttgagttgtcttactgagttgtaaaagttctttagagtttgaatataaggtctttgtcagctacatgttttgcaaatattttttcccatctgtaatgagaatacattttaaattttgacaaagtctaattcatagatttttttcttttatattttgtactgtttgtttcaggtttaatatatctttgccaagtccaagggtacaaagattttctcctgtgttttcttctagaagttttatcatttgatagtctgtgatccatttcaagttgatttgctatctggtgtgaggtaagggtcaaggtttattgttttacatacggctatttagttgttttagcaccattagttaaaaaatgtcctttttctcttgatgtattgatatatttgtcaaaaagcaattgactaccacctagaaatagcttctcagctccatctcgaatctgtccagttcagcctgcttgcctctactccatcctccaccatatctatcagggtgacccagaagtcctacatggtatccacctctggtcccttggtggccaagggcctccttggcagctgcttatacaagaatgggccagatgtctgcattaactcctagaacttctcctggatgggcaacagcagcagcttccggggtagcctggacactggcatgggtctggagggaggctatgccaggtctggtggtatggaggagcatcacagctgccacagtgacccagagcctcccgagtccccttaagctggatgtgcacaccaacacccaggctgtatgcaccccggagaaattgcagatcaagaccctaaacaagtttgcccccttcactgagaaggtacccttcctggagcagcagaacaagatactggagaccaagtggatccttttgcagcagcaaaaagtagcttggagcaacatggacagcatgtttgagagctacatcaacaacctaaagcagcaactggacacactgagccaggagcagctgaagctggaggcagaacttggcaacatggagagaccagtggaggactatcaaaagtgtgaagtttaaataaccaagcctacagagatggagaatgaatttgtcctcatcaagaaggatatgaatgtagcttacatgaacaaggtagagctggaatctcacctggaagagctgactgacaagatcaacttcctcattcagctgtatgaagaggagatctgtgagctgtagtcccagttcttggtcacatccctggtcctgtccatggacaacagccactccctcgatttaaatggcatccttgccgaggtccgtgcccagtatgaggagatcaccagctgcagctgagctgaaactgaaagcatgtacaaggagtattaggaatatgatcaagtgtgaggagctgcagacgctgcctgggaagccaagaatgacctgcgtcacatgaagacagatctctaagatgaaccagaacatcagcttgcttcaggctgagaatgagggcctcaaaggccagagggcttccttggaggctgccatcccagatgctgagtagcagggggagctggccattaaggatgccagtgccaagctggaagccatcctccagagagccaagcaagacatggcctgtcagctgcttgagtaacaggagctggtgaatgttaaactggccatggacatcaagatctccacttacaagaagctgctgaaaggcaaggagagccaggtggagtctgggatgcagaacatgagtatccatacagaaaccaccagtggctactcaaggggctgagctcggcctgcgaaggcctcacaagcctttggccacaagtatgacctagggccccttccaatccagcttagactctggcaggggctccacctccttcagctgcaccagctccttcagggccgtggttgtgaagaggatcgagatccacaatgggaagctagtatctgagtcctttgatgtcctgcaatgaatgccactgcaactcctcccagcctacctacctcctctggccgaccagagcctgtgggggaggcaactgtgcagggaagcatagggaacaggagaccacctgaggcccaattgtggacctcagcccacccttaagggaacctagggtggttcctagacgaccgcctctttttcatgctcgcaactgaaaaccagtttatacctttgggagccttctggttaaaacaaaattttaaaaacagacaaaacctagttcaattgttttttcaaaataaagcctcagctaagccaaagaaaaaagcaattggccagataatgtgtgggtcaatttctggattgtctattctgtccattgatctatttgtctatttttacaccgataccataataccttgattgttatatctttgtattaagtctaaaaatcagtagtagtgtaagaactccaaccttgtcttcttttccaaagttgttttggctgttcaacctttgcacttccgtatgaattttaggatcagattctcaattttaaaaaacctactgggatttaggttgggatgatatacaatacatagatcaagttggaagatataatatcttattgagtcttccattttatagacacagtatatgtcatcactcattcagatattctttaatttctcctacctaggttttgtagtttacgatacatatatcttgcatatctcttgtcaagtttattcctaaatttttatttttttgagacagggtcttgctctgtcgcccaggttggagggcagtggtgcaatcatagctcactgcagctcaggctcagatgatcctcctaccttagcctcttgagtagctgggactacaggcatgcaccaccatgcccagctaatttttatatttttttgtagagataaggtttcatcatgttgcccgtggctggtctcgaactcctgagttcaagcagtgtgcccatctcggcttcccaaagtgctgggattacaggcatgagccacagtgcctggcttatttgtgcttttttttctttctttctctggaggcctgtccttccctttctctacagaaaaccagtttgtggcgttgttgacatctgcattatgtctttttattctgtttcattgaattacatcctttaatatggccttcatttttatgtgctcacatttcttagtttctggcttttcaaaatggacacatagttcattaattcagtcttttttttttccataaaagcaagcttttaaaaatatttttaattgacaaaaattgtgtatattgatgatatacaacatgatgtatgtatatatcctggatgggttagagcaggctaattaacatatgtattactcatatactttttttgtggtgagaatatttaaaatctattcttgcagcagttttcaagtatataatgtggggtttttggctttttttctttcattatttttaattgacacataattgtataagttaatggggtatagtgtgatattttgatacatgtataaaacgtgtaatgatcaaatcaggatagttagcatattcatcatctcaaacatttttcatttctttgtattgggaccattcaaaatctgctcttctagctatttgaaaatatacgatatattgttaattatagtcaccctatagtgctatagaacactagaacttattcctcctatctagctgtcttttttttttttttttgagacagggtctcactcttgtcccctaggctggagtgccagcggcgtgatcacaactccctgcagccttgatctcccaggttcaagcaatcctcacctaagcctcctgagtagctaggactacgggtgtacaccaccatgcccagttaattttttaattactatatttggtagagatggggtctcactatgttgtccaggttgcctggggtcaagcttgacctcccaaaatgctaggattacaggcatgagcaaccgcactctgtcctagctgtacytttgtaaccatcaaccatttggctgttcccttccctaccctacccttccccacctctagtaaccattattctactccctacttctatgaaatcaaccttttaactttacacatgagtgagaacatgcagtatttgtctttctgtgcctggcttatttctcaaacataatgtcctctaagcccatctacgttgctgtgaatgacagaatttcattttttttaatggctaaatagtattctattgtgtatatataccacattttctttaccagtttatctgtttacggacacttaggttgattccatatcttgaccattgtggaataatgatgtaataaacatgggagtgcagctttctccttgacttactgatttcctttcctttggatatttacccattagtggaattgctggatcatatggtagtctatttttagttttttgagtaatctctatactgtttttcataatggctgtactaatttacaccaacagtgtatgagttcccttttctccaaatccttgccagcatttgttattttttgtctttttgataatagmcattctaaccgaggtgagatgatagctcattgtgattttgatttgtatttacccgattcttagagattttttttaaagatatatacccgttgaccattcgtatgtcttcttcgtcagacagggtctcattctatcgtccaggctggagtgcagtggctcaatctcggctcactgcagcctcagtctcccgggcttaggtgcgagcagctaggaccacaggtccgtgccaccatccccggctaattttttgtgtttttgtagagacagggtttcaccatgttgtctaggctggtctcaaactcctgacctcaggcagtcctccagcctcagcctcccaaaatgtggggattacaggtgtgagccatcacgcctggcctgtatatcttcttttgagagatgtctgttcagctcatttgtccatttctaaatgaaattatttatttattaatccctcgtggaatagtttgcaaatattttcttccactctgcaggttgtctcttcactctgttgcttgtttagtttgctgtacaaaagctttttagtttgatacaaatccatttgtctatttttgcttttgaggtcttagccataaaaatctttgcctagaccaatgtcctgaagcattacccctgtgttttcttctggtagttttatagttccaggtctcacatttaagtctttaatccatttttagttggtttttatatatggtgagagctaggggtctactttcattttactgcatacagatatccagttttcccaggaccttttatcaaagggactgtcccttccccagtgaatattcttggtacctttgttgaaaatcaattggctgtaagtgcgtagattttgtttgtttgtttgttttctattctcttccattggtgtgtctgtttttatgccagtactgtgatgttttggttatatagctttgtaatatattttgaagccagatagtatgatgcttctagctttgttctttttgcttaggattgctttggctagtcaaggtcttttgtggttccatacaaattttaaggtttttgttgtttctatttgtgtgaagactatcattgggatttcggggcttttgttgttgttgttgttttgtttttttaagagatagggtcttgctacagtacccagactggccttggaatcctgggctcaagcaatcctcctgcctcagccttctgagtagctgggactatggatgtgtgccattgtacccagctcattggtatttttataaggattgcagtgaatctgttgatcgcctttggtagtatggtcattttcacaatattaattattccactccataaatgcgatgtctttccattttttgtgtgtgttctccaatttatttcattcaatgtgtgtggggggttttgttttgttttgttttgagacagggcctcaatctgtcgcccaggctggagtgcagtggctcgatctcggctcactccaacctctgcctcctgggctcaagcgattctcatgccttagcctcctgaatagccggaattatagttgtgcatcaccatgtctgcctaatttttgtatttttagtagacacagggtttcaccatgttggccaggcctgtctcaactcctgaccccaagtcatccacctgccttggctttccaaagtgctgggattacaggcctgagccaccacacctggcctcgttcagtgttttacagtatttaatggtatcccataattcttatagactttctttgttcattttcatcattatttccttcttttctctctctgggtaatttcaaatgacctatgtccaagttcagaaattctctctgcttgatcaagtctgctaattgaagctctctattgtatttatttcattcattgaattcttcagcagcaggatttttgttttgttctttttattatttgtatctctttgttgaatttcttgttcatattgtgagttgttttccgacttcattgaattatctatttgtattttcttgtttcttgttaagtttaagaccattgttttgaaaaatttttggcaactcgtagcctttttatcattagaatctgttactagagttacaactcccttgatcaacatggttttaaactgcacaggtcctgtactcaggttttctttagcctctaccatccctgagacagtgggaccaacccctcctcttcttcctctcccttagcctattcaacttatatttagatgatgaggatgaatacctttatgatgatccacttccccttaatgattagtaaatacattttctcttccttatgactttttttcttttcttttttttttttttttttttttggcaacggagtttcactcttgttgcccaggctggagtgcaatggtgcagtctcggctcaccacaacctccaccccctgattcaagcgattctcctgcctcagcttccttagtagctgggtttacaggcatgtgccaccaagcccggctaatttcatatttttagtagagatgggtttctccatgttggccaggctggtctcgaactctcgaccttaggttatccgcctgccttggcctcccaaagtgctgggattacaggtgtgagccactgctcccggccatgactttcttcataaacttttatttagctaacttaattataagaatacagtatataatacatataacataaaactatatgttaattgactgtttatgttattggtaaggcttccagccaatagtaagctattagtagttaagcctttgggcagtcaaaagttatacacacatttttgaccgtgtgagcagttggtgccccaattcctgcattgtttgagggtcagctgtattatgttcctttggtagcgtcatacttccttgtgtttctgtgtcaatgtctgtttatttggtggaacaattgccttttctaaactttctagagtagctttgtagagaaagacactcacctgcagttgggttttatcatgccagtcaggaagggtgtagtgtctgtttgtggataggtgcagtggtatagtttccatgcagcttcttcagctgcattcaacgtcagcaataactgggtgctcattctaattttaattaataacgtcaccaataactgggtgctcattctaattttctccccaaagggaagacttaaccaagatgtcaggtctgaatagactacaagtagctacaggagcgctgggttccaggtactggcacagggtctgtattagtctgttcttgcagtgacataaacaaatacttgagactgggtgatttataaagaaaagaggtttaattggttcatggttctgcaggctgtacaggaagcattgtggcttctactggggaggcgtcaggaagcttccagtcatggtggaaggcaaagggggaaccagcatttcacatggcaggagcaggaggaagacaaagagtggggaagtgccacacacttaaacaacgagatctcactatctcaaggagagctctgggcagatgacgttaaaccatgagaaacccccaccatgatccaatcacctcccaccaggccccacctccaacattgggggttataattgaacatgagatttgggtggggacayggacccagaccatatcagagtctcacaaacctgttatggcacctgagttttggggtacaggttagcactctgtggcagagttggatgtagattgaccacagagctagggtctgtgactctcagataccctctagcagctcaggcccagggagctaggttgtagctgtgattctacctctgagaggcagggcacagaactggcccaagcctaggggaacggagggggtaccctggaggtttgggagcagggtacagctacagtttgggaacatgagccaatagggctcggtggtaagtcaagtcccagggggatgaagcactgtgtaatagtaactgtagtccctgggaacttggcagtatctcagactctgtgaggccagttgcagcagcagcagcagcagcagcagcaagtgccccagaatggtggagtacaactgttgtttaggccctgggggtgtagggaacagcatagcaatgactgcactccctacggagaagggtgtcttagcagctcagactctagggggctagtccagctctggggaagatgactactagataagtttggtctgtagggcagagtgtctcagctcaaccactgctgtgtttccctaggacacaggatactgtcagctcagccctgggatgggcagctgctcaacttggccacagcaccagttctccaggggcccatgtgctgcttcagcttaagcctggggggcatgactgttctgggaggcccaggcatcatttcctggaatgtgggtagttgcttcaccttatgcactggagaggcatgactgctctgagcagctaaggtactgtttccctaggaggcaggatactgcttcagctctggcctgagggggtgataggaggggtaggtggggtggctccacctctgcttcccccgacccctgtacaggggtataagagctgtttgcagctcaacttggggatgttgggccactgggctagtgtgattcagtcttggcttagcctcagggataaaggggaactgtggctactcagccccagagcaagacacactccagccgtagttcggattccaagatgacatagcacagtagctacatgaactacagtgcctgggacacagtgtcggtttcttctctcggggtagcacagcagtgtggactccagagagcttcctcagctgggcttggtgcctgtgaagactgcagggaacctcagtggtgaggtctattggtagggttggttactggaatcctcttgcttccctccttgctgcagggagttcttcctggttcctagctcttcccagttgggggattgggtggtggaggccggatgcttccttccattctctatgtggccatcccgagtttctgtgctcgtcaatgctctccctcatttatttttgttaaaatgtagttgtttattcattgttttgattgtctttgtgggggaaatgaatgctagggacttctagtgggccatcttgctgatgtgacgtgactacagtatattgctattaactgtagtcactatgaacttattcctcgtaattgaaattttgtatcctttgaccacagtctgcttttcttttctttcctttcttttcttttcttttctttttttaaatttacacaccactatacaaacagggaacacagctttctttcctaatatgagggtttaaagaaggagtgtccaatcttttggcttccctggaccacattggaaaaagatggattgtcttgggccacacataaaatacactaatgttagctgatgagttaaaaaaaatatcaaaaaaaaaatctcataatgttttaagaaagtttatgaatttgcgttgggctgcattttaagtcatcctgagtcacaccatgggccacaggttggacaagcttagtttaaaggctataaatttcccttgaaattttatattagctgtattcacaagttttgatacatgacatgttctttatggttcagatctagtatttgcagttccatgtgaatttgagaggaacacacgttctttaattgtttggaatgaattttaaatatatccagtaattcaagcttattctgtttccttaacttggctgagataattatcatgaggtcttgcactatgtaatacatttgtcaatttggctctaagttctatccacttttttaaaagttggtttttcttgttgctgtttgattgttttttgagacaaggtcttgctttgtcacctaggctggagtgcagtgctatgatcacagctgactgcagtcttaacctcccaggatcaagtgatcctcccacctcagccatctgattacctgggactgcaggtgagggccaccacacctggctaattttttgtgtgtgtagagacagggtttcaacatgttgtccgggctcgtctggaattcctgggatcaagcagtctgcctgccttggcctcccaaagtgctagaattacaggcatgagccactgcacctggcctaaaagtttttaaagggaaatttcaaaaatatacaggagtaggctgggcagtgactcacatctgtaatcccagcactttgggaggccaaggtgggtagatcatttgaagtcaggagttcgataccagcctggccaacatggtgaaaccccatctctaccaaacagtacaaaaattagctgggcatggtggtgtgcgccagtagtgccagttacttgggaagctgaggtgggagaatcgcttgaactggagaggtagaggttgcagtgagtggagattgcgccactgcaccccagcctgagggccagagtgagaccttgtctcaaaaaaaaaatacatattatatataatatataattatatataattatttataattatataatataattataatatatactcctgtatatatttaaatataaatataaattttataaatatataatatataatatattcatttactatactaatatatatattatatatttgtatattatatatttatatattagaatagtagaatattctacttatatatattatatttatatttatatttgtatatttatatatatatatatatattagtagaatagtaaatgaagccagtgtacaattatcagtgtatgaccaatcttgttttatttatttctctatcaattgtacccttttctctgactttggtatttatttactttcttgagacaaggtctcattttgtcacacaggctggagtgcagtggcacaatcacagctcctgggctcaagtgatctcctgcctcagcttgccgagaagctgggactgcaggcacacaccaccatgcccagctaatttttttgatctttagtagaaatagggtcttgttatgttgcccaggctagtgtcaaactcctgggttccggtgatccacccacctctgcctcacagagtgctgggattacccgcatgagtcaccatgctcagcctgactttgatattttttaaacaaatcctggacattctaataattttatctataagtattaatattatcataccattcacatacctaaaaacaccaaaaatactttctttagggacagagtctcactctgttgcacacgctgaattgcagtggtacagtcacagcttactgcagcctcaaactcctgggctcgtgccatcctcccacctcagcctcccaaataattacgactacagacatgtgccaccatacccagctaatttgtttttattaagtttcttgtagaaatgggatctcaggctggtcttgaactcccatgctggtctcaaattcctgttctcaagtaatcctcccacctcagcctcccaagtgttaggattgtaagtgtgagccactgtatccagccccaaaattccttttttttcatggaatgcctgaacatcccaagaaaaattccttaatatcaaatatctagtccacgttcatattttcctgcttgtgtatacacatgcatatatatgtacacacacattgtggtggtactattttactttttttaattgaggtgaaattcatataacttaaaattaatccctttaaaatgaagaatttactgacagttcattcacaaagttgcaaaagtgccatgtagagcttcaaaacatcttcatcacctcaaaataaaatttggtacccattagtccattataccttccctcaagcctctggcatccaccagtctactttctttctctatggatttacctattttggatattttatgtaaatagaatcatataatatgtgaccttttgtgtgtggcttggcttctgtcacttagcataatgggattttgtttgtttgtttgtttttagacagggtcttgatctatctttgggctctacctttgcccattttgtaattgggttattttggattgtagtctttgttgttgaattgtatgagttctttacatattccagacccttatcagatacatgatttgcagatattctttcccatctatgggttgtcttttaactcttgtcatggtgacctttgtacaaaaatttttattttgatggtgtccaatttatctgttttctcttttacttgtcctattggtgccatatctaagaaaccatcaccaaatgcaaagacatgaagatttacccctatgtttttcttctaagagttgcatggttttagttcttatattcagctctttgatccattttttatttttggtatgtaatatgaggtaggagttcaacatcattcgttttcatgtggatattcagttgtcctggcaccatttgttgaagatagtattctttcctcatcaaatgcttttggcacccttgtcaaaaataatttaaccataggtatgttatttctggactctcgattctgttgtatttattgctctaaatttccctctgagcactgcttttttgcagcccatagattttgatatattgtgcatattatcattgctatattttataaattgatatattatctatcatcacaccctgtagagttacatgcattttttttagttctatagtattttatttctgtccttaaaacacacatacaaaattacaatattgagattattattttatacagagtgtttatttagatttttatagagttgtaatttgtttgcttgccattttttcaagcatctcaggacttttttctgctataatatttgtttttttgaaatatttttttttgctaaaataatgtgctttattcagttacctaacaggtaagaaatacagaggtaattcctgtaccaaatattttatatttggtgtatattttttctcttcccttctataatgtgcttgtatggcatgacttaactgttccttttttttgttatttgtttatttattatttttttgagacagagtcttgctcttgttgcccaggctagagtgcagtggtgtgatcttggctcattacaacctgcgtctcttgggttcaaatgattctcttgccccagcctcccaagtaactggaattataggcgtgcgccaccacgcctggctagtttttatatttttagtagagatggggtttcaccatgttggctaggctggtctcaaactcctgacctcaggtgatccacctgcctcagcctcccaaagtgcagggattataggtgtgagccgttgcacccagccaactgtaaaaaaaaaaaaaaaatgttttaattgtagtagttgtagatatttatggggtacatgaaatgttttgatactgacatgcaatgtataataatcatagcatgtaaaatggggtatccatcccctcaagcatttatccatcccttcaagcatttatcctttgtgttataaacaatccaattatactcttttaattatttttaaatataattaaattattgacggtagttaccctgttgtgctatcaaatatgaagtatgttgtttagaaatttctttcatatacgagacattgattgtaaactctcagttttttgtttttattttttattatgattctttttgagacggagtcttgccctgttgcccaggctagagtgccaaggcacgatcttggcttactgcaacctccacttcccagattcaagcagttttcgtgccttagtcacttgaggagctctggttacaggtatgcaccacaacacccagctaattttttttatttttttattttttttatttttagcagagacagggtttcgccatgttggtcaggatggtcttgaactcctggcatcaagtgatccgcctgcctcggcctccaaaagtgttgggattacagggtgagccaccgtgcccagccaactttcagtttttttttaatcttaaagtatcttcctttcactctcttttctgaaaaaaaatggggggttttgtgggggggttttttttgttttttttttgtttttggttattctgaaggtaagacagtggaaaaaaatagtttggatcatatacaattgtttattgatagttacttttcttttttttcttttttgagatggggtttcgccatgttggcaggctgatctcaaacttgtgggctcaagcgatccactctccttggcctcccaaaatgctaggattacaggcatgagccaccacacccagccaatctactttcttaaaaccttaaatactattcctatgacttctgctaccatgttgctattaagaaggccactgtacgtctaatttcaatactctgtagggagtctgtcttatctctctttctttaatttgtattttttgttacctaggctcaggggtgtttttatggtctgtcttatctgtccagctgcattttgctgttcctctttagaatgttgcacgttcactacattgagtatgggtttctttttatttctcttggaatacttaaaagtaaggcttcgtttatctgtggattcatgtctttagttttgaaaaattgccagccattatctcttcaaatacagatgatccctgacttatattaattcaacttatgattttccactttatgatggtgtgaaaatgatatatatttagtataccccttaacctatgatggcgatggcattacatctggataaacccattgtaaactgaaaatactgtaagtcaaaaatgcactttcaacttataatagtttccacttaaggtattttcaatgcacagtgtgtttatcgggatagtaactccatcataagtttaagagcatctatattgtctctcctccattttcccttttctattcttttgagacttatatgcatactatactttctatttttcttatttttaagtctttgtcatacattttatgttctgtttttgctgtgatacagtctagataatttaaaaatctatcttccaatttaataattatttcttctgcatctaatcatctatttaacttacccattgcctttttttctttttttttttttttttttttgagacagggtctcactatgtcacccaggctggagtgcagtggcatgattatggctcactgcggcctcagactcctgaactcaagagatcctcccacctcagcctcctgagtagctgggactgcagacccacaccaccagacatggctgattgttaaatttttttgtagagacaggatctcattatgttgcccaggctggtctcagattcctggtgtcaagcaatcctcttgccttggtctcccaaagtgctgggattacagacatgaacctctgtttctggcccattgacctagtttcagcagtttttcattgtttctttgtttgtttgtttgtttgtttgttttgagacaaagtcttgctctgtcacccaggctggagtgcagtggcgccatctcagctcactgcaacctccacctcctgggtttaagcaattcttctgcctcagcctcccaagtagtgaggattacaggcatgcatcactgtgcccagctaatttttgtatttttagtagagacagggtttcaccatgttggccagtctggtctcaaactcctgaccacaagcgatccacctacctgggcctcccagaatgctgagattaccrgcatgagccactgtgcccagcctgtttttttaaaaaattaaacttttgatagtttttattatttgcttatctctgtggttcatttttttagacattgaataattatattcaatcttagatgtttccaatatggggagtctttaggggctgtctgaatctggtgactcaatctcatggtggctaatttcctgtttttttggcattctttgattgttagcttatatttgattgatcttaatatgaaaggatactggagtcttaattgggtttgtttttctccaaatagtagctgcatttttttcttaccagaagccaggttacactcttcacccagaacctttcagattgttatccttatcttgggaattttaagttttcctcccctaccagctatttgtcccaacttcagtttcttagccacaaaactaatgtattagaactacccttggggaaagtttcctctttgtttatgctcagctcttctttttttgatcttttggagttggggggaggggagggcggtcactggagtggggaatgggctttgattgttggcacttcttgtagcagagcctggacacaaaataaagattttattttcggtcaactttctgttttttgttttgtatgttttgtagcaagacagttttttttacagtatctatttgccatattgacactaatgggaggctctttttattttgaaactccttctaaataattttattctcaaataatataggtataatatataaaattcaaaaaccatccagaaagttataaaataaaattgcttttacttctatagcccaaggtaactacaggctttttggaatttttgcaattgattttttacttgattaggatataagtgataatttaaaatcttaaaaacgagaagcaaytaaaagatattttgtagccatatattaaaaatggactgattttgtagctttacaaaattgccccaattgagaactactgtagtagacctaagtggctcggagttattggtatatatttcttcattttcttttttwaaatatatcttccttttcaaagcttgtcaaactaatgttaagtgggatgcttgtctattaatggtaaaaattgtatatatataatctctgtctacaccaggatatctattttaaaattatatactgctacaatagggcatacccaactcataaagttgaaaaactttatgtgcattaaatctctggtaatatgagaattttagaagtatttgaaagggtataccagtaccttgtcacataaaagcaatcttaaaaagccagtacagaagtgtagttaaagataggatgagggaactatataacactaatttttgccctgcattgaatgtattctggtgccttggcaagtcattttaaaaagtgttaattttttaatctatagaatggaattgattttacctaaattatatagggtaccacagtagtgaatatgagagatttgtttaagataaaacagtccacaaaaatactaagtgctttagttgatcagctatttaaactctttcagctattaaataatagaagaaaatggaattgaatatgatgtcagcatggaacaatctaatgattcattaagagtcaaccataatgacggtgaagagtcaaaaaccagtgctcaagtatttgaggtatggattcagctgggaacctttttccatcctagggtaaaacagcatgccatttaacagctctttatgctcaagggatagctgttatatttagtgtattcaagaattttgagctgggcgtggtggctgacacctgtgatcccagcactttgggaggctgaggcgggcrtatcacctgaggtcaggagttcaagaccagcctggccaacatggtgaaaccctgtctctactaaaaatacaaaaattagctgggcgtggtggtgggtgcctgtaatcccagctactcaggaggctgaggcaggagaatggcgtgaacccaggaggcagagcttgcagtgagctgagatcacgccactgcactcctgcctgggcaacagagagagactccgtctcaaaaaaaaaaaaagaattttaatatttaattatacacatattttatgatatatttaatattataatacagaacttaatgctaagatatattcataaaaattttatatacagagaaaaatctataggttgaattatgttatttcaggttccattcctgtggacaattttggtaaaattaagatagtaagtataataatcaacaattttacttaagaaatactttctgtgtatagcaatttgtgtgaattgacaactcttacaaaaaagtaaaaacaactgaaaaatggatgtcttttcatttttattatacacatctttaaaaaaaatggtgatagactgaagtgattttttttttccttacaaaagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatggtgagtatattttataagtaaccagttttatgccgtttagcaaaatgtattagtcttactaaatgaccttaatttcttgacacttttgacttacattgtgtttatttatttatttatttttgagatggagttccactcttgttgcccaggctggagtgcaatggcacaatcttggttcactgcaacctctgccttccgagttcaagcgattctcctgcctaagcctcccaagtagctgggattacaggtgcccacgaccacacctggctcatttttttgtatttttaatagagacaggatttcaccatgttggccaggctggcctcaaactcctgacctcaggtgatccacccgccttggcctctcaaagttctgggattacaggcgttagccaccatgcccagccacagtgtgtttaaaatactgtttccatgactttcatttttatgtaaggattttaaaagatttgcattcaggactacaaatagtactttaaacagtacttatgagtctctgtgtttgggcacacttgtgctttgagatcaattggaaatgtaacatattctgtaactagttctgaagtgccagagttgacatggaacttacatttaatggaatgtacacacacacacacacacacacacacacacacacacacacacacacacacacacatattaggctaactccagttttgtttttttttttctgagatggagtcttgctctgtcgccaaggctggagtacagtggcccgatctcggctcactgcaacctccgcctcccgggttcaagcagttctcttgcctcagcctcctgagtagctggggttacaggcacctgccaccacacccggctagtttttgtatttttagtagagacagggtttcaccatgttggccaggcttgtcttgaactcctgacctcgttatccacccacctcagcctcccaaagtgctgggattacaggcatgagccaccacgcccggcctaaactcctgtttttgatttatcaacatctcactgacctgcaagccactttctggtatgttttcttgaagaaatagaaagtaatggaggtactgcaatggaggtactactagtatatggggaattagacatatccttgctgatctttgtgggtaaatgtgtgccacgtgagtaataatgcataaagataaaaagatgaggatggctaaatacttttcaaactgttggctaaaagtatttttgaccaagttcatagtttgagccaaagaggtgaaagattgttttgactgacatatggaaaattactaagcctctaagttgctctctggttatttagaatatacttaacataagtaatactgtgaaggataatgtgtttcttgtttacttgaattttctgaattttctacaataaatattttattactttcataataaaattaataattttaaaagcataataactttaattataaattataccacaggtaaacattttacctagaattaacccttgtttctgttcataatctagagcattctagagttaatctgtgccattttgctcctttatgatccagccaaattgagttttctaaattctagggttaacagtaattggttgagaggtgactgtgtgcaggggaatcctttttgtttatgttcaggttttctgggcctatgcccagaaccatactgcatcaccggcagaggttaatattcaacaaataatttaaatgttaaccaactacattttaatttttcatgtccagaatgaaatacttctgtagtttcccctttatttgacatttattctagtttctatcagaacatttagaaagtttgtgtttttttttttccaacaggaagatcaaggagtctgaatgtgtaaaagggttgtcattttacctagggtacctttccgagcaaaattgtttatttgagtccaaaaaaaagttaattaacactctttgtaattggattaaactttctatacaaagtaagtacaaaggtggttttacattgtttaggtaggcgatgacacagaaggttatttgaaaccatgaaataggaaacatggtatgaagcatggaaaaaaaatgtgagaaacagattataagaaagaattttcttcaaagaactgaagatcagagagagaatattccgggaaacttagtggaacttttggttttgtttgtttcagtggactgtattttttagagcaactttaggttcatgaccaaagtgagcagaaggtacacagattttcatatatatatacttcctgtacctgcacgtgctacagtatccccctttatcaacatctcctaccaaatggagctatttggtgtttttttgttttattgtttttgttttatttacttttaacttttactttaggttcgaaggtacatgcgaaggtttgttatgtaggtacactcagattgtacaagttatttcatccacccatgcattaggcctagtacccaatagttattttttcagctcctctccctcccaccctccactctcaagtagaccccattgtctgttgttcccttctttgtgttcataagtttttatcatttagctcccccttgtaagtgagaacatgcagtatttggttttttgttccagtgtagtttgctaaggatagtagcctccagctccatctgcgttcccacaaaagacatgatcttgttcttttttatggctgcatagtattccgtggtgtatatgtaccacattttctttatctaatctgtcaatgatgggcatttaggttgatccatttatttgctattgtgagtagggcattaatgaacattcatgtgcatgtgtctttatggaagaatgatttatattcctctgggtatatatccagtaataggattgctgggttgaatggtggttctgtttttatctctttgaggaatcaccatactgctttctacaatggttgaacaaatttacactcccaccagaaagtatataagtgttctcttttctccacaacctcactagcatctgttatcttttgactttttaataatggccattctgactggtgtgagatagtatctcattgtggttttgatttgcatttctctaatgattagttatattgagctttttttcatatgcttgttgactgcatgtatgtcttctttttgaaaagtttatgttgaaactagataaaactactttaaatttcatatggaaccaaaaaagagcctgtatagccaagacaatcctaagcaaaaagaacaaagctagaggcatcatgttacttgacttcaaactatactacaaggctacagtaacccaaacagcatggtactggtatcaaaacagatatacagaccaatggaacagaacagaggcctcagaaataacacgacacatctacaaccatctgatctttgacaaacctgacaaaaacaagaaatggggaaaggattctctatttaataaatggtgctgggaaaactggctagccgtatgcagaaaacagaaactggaccccttccttacaccttatacaaaaaattaattcaagatggattaaaggcttaaacgtaaaacctaaaactataaaaaccctagaagaaaacctaggcaatgccattcaggacataggcatgggcaaagacttcatgactaaaacaccaaaagcaattgcaacagaagctaaagttgacaaatgggatctaattaaagagcttctgctcagcaaaagaaactatcagagtgaacaggcaacctacagaatgggagaaaatttttgcaagctatctatctgacaaaggtctaatatccagaatctacaaggaagttaaacaaatttacaagaaaatccatcaaaaagtgggcaaaggatatgaaaagacacttttccaaagaagacatttatgtggccaacaaacataaaagttcatcatcatcggtcattagaggaacgcaaatcaaaaccacgatgagatatcatcacacgccggttagaatggcgattattaagaagtctggaaacaacagatgctggcgaggctgtggagaaataggaacgcttttacactgttggtggtagtgtaaattagtttggccattgtggaagacagtgtgatgattcctcaaggatctagaaccagaaataccatttgacccagcaatctcattactytgtgtatacccaaaggattataaatcattcttctataaagacacatggacatgtatgtttattgaagcactgtttacaatagcaaagtcttggaactaccccaaatgcccatcaatgatagactggataaagaaaatgtggcacatatataccatggaacactatgtagccataaaaaagaatgagttcatgtcctttgcagggacatggctgaagctggaaaccatcatcctcagcaatctaacacaggaacagaaaaccaaacacctaatgttctcactcataaatgggatttgaacaatgggaacacatggacacagggaggagaacatcatacaccagggcctgtcgggggggtagggggaaagaggatggagagcaataggacaaatacctaatgcatgaggggcttaaaacctagatgatgagttgataggtgcagcaaaccaccatggcacatgtatacatatgtaacaaacttgcacgttcagcatatgtgtcccagaacttaaagtaaaacaaaaaacaaaaaaccagaaatgtctgtttgtgtcctttgcccacttttcaatggtgttgtttttcttttgtaaatttgttttaagttcgatatagatgctggataatagacctttgtcagatgtatagtttgcagatattttctcccattcttcaggttgtttgtttactgtgttgatagtttcttttgctgtatagaagctcttaagtttatttagattccattttccaatttttgcttttgttgtgattgcttttagtgtctttgtcatgaaatctttgcccattcccttgtccaggatggtattgcctaggctgtcttccaggtttttatagttttgggttttatatttaaatctttagtctatcttgagtttatttttgtatatggtgtgaggaaggggtccagcttctgtcttctgcatgtggctaacctgtaatcctggcaccatttacttagcagggagttgtctccctaatgcttgtttttgtcagctttgttgaagatgaaatggttgcaggtgtgcagccttgtttctgggctctctcttctgttacattggtctatatgtctgttttcataccagtaccatgctgttttggttactgtagccttgtagtatagtttgaagtcaggtaacataatgcctccagctttctactttttgcttaggattgccttggctatttggcctttttttggttctatatgagttttaaaatagtttttttctggttctgtgaagaatgccattggcagtttgataggaatagcattgaatctgtgaattgctttgcgcagtgtggccattttaatgatattgattctttctgtccatgagcatggatttttttttccatttgttcgtatcttctctgatttatttgagcagtcttttgtaattcttatggtagagatctttcaccttcttgtaatcctaggtattttattctttttctggcaattgtgaataggattgccttcctagtttggcccttgtcttggttgttgttggtatattggaatgctagtgatttttaaacattgattttgtatactgaaactttgctgaagttgtttatcttctggaagagcttttggacggagaatatggggttttctaaatgtaggatcatgtcgtctgcaaacaaggatagtccaacttcctctcttcctatctggatgccctttatttctttctcttgcctgattgctttggccgggacttccaatactatgttgaataggagtggtgagagagggcatccttttcttgtgctggttttcaaggagaatgcttctggcttttgcctatttactatgatgttggctgtgggtttgttagctaagcatcttgtttttcttaatttattttaattaaataatttattttttaagagaaatgtctcagctgggcctggtggcttacgcctgtaatcccagcactttgggaggctgaggtgggcagatcacgaggtcaggagtccgagactagactggtcaacatagtaaaaccccatttctactaaaaatatgaaaattagccaggcatggtggtgcatacctgtaatgccatctactcaggaggctgaggcaggagaatcacttgaacccaggaggcagaggttgtggtgagccaaggtcgtgccactgcactccatgcactccagcctgggcaacagagcaagactccatctcaaaaaaaaaaaaaaagagatatgtctcactctgtcacctaggcttaactgcagtggcatgatcatagcctccagagtagctagaactacaggggtgtgccactgccatcagccaaatggagctttttaaagaaatataccttcctttttttcaatatgactttttgttatttatttattattattattattattattattattattattattattattattattttgagacaaagcctcactctgttgcccaggctggagtgcagttgcgtgatctcagctcactgcaacccccacctcctgggttcaagcgattttcctgcctcagcctcccgagtagctgggattgcaggtgcctgccaccaagcccaggtaattttagtatttttagtagagacgggtttcatcatgttggctaggctagtctcaaactcctgacctcaggtgatccacccaccttggcctcccaaagtgctgggattacaggcgtgagccatcgtgcctggcccaatatgactttttatataaaagttattagtaaagattctgtagtgggtgaatctgcaatggatgaagatgttttggagtgaagctgaattggtcttttgaatttattagaaatattgtacacaaagggcctagtaggtaaaagaccactcagctaaagttttctgataattttcatggtctgcctgaaatagaatgtgttgtagcacatgactcttcaaaaccatgtttgctttcatagcaaagattttaggtaattagctgggttttctttaaataggaaaagtaatattaacattgtcattgtcagattatatgaattgtaaatagttttttaggtaccagggggacttagctaagaagggagaaaataaatgagacttttatctactatgcttgggaaacatagtttcaaaattaagaggatattccacagatcagtcttaattatgaaacttgtatatgattgaataacttataaaaacttatttgtgtttaattttgatttaaaaataaccacagcacttattttctaagaatgaatagaacacttttcatacccccattcctaaaagttagaaaatttgtatatacatatttttttcacagatatttaatcttattataaggggtaaagaatttaaaacaatattattactgttgccttttaatgtccagcagggttttttatattgttttgcttttgtcttttcttaggttaagtaacattgtcaaatattgggagctagtacagagtggtagtttgaaggagtcagattgcttgagtttcaattatagcctaccactaaatagctctgtgtaaccttctatgagttttgtaacctctgtgtgacagtttcctcatttataaaatgtatatacttgwgatacacgtgatgaggattaaatgaggtaatacatctgaagtgctgccacttcctatgaactgagcacgtgtaagcagttgtcatcagtttgcagttgctgtttcatgctaaagtgataagagttatggcaggacatttttatctcaagaaacttgttgaacattggggaaggaaggaaacaattcccattcttaattttgggaactatctatgattatattaatatttaaagcattctagtttgttgaagtttttcccctaacattaaattttttaaaaaatttttttcaaatttatatttgcattttttcaaatggccctttttttttgagacaaggttttgctctgtcacccaggctggagtacagcagcatgatcacggctcactgcagcctcgacctcccagcctcaagtgatcctcccacctgaacccccagagtagctggtactacaggcacatgccatcacactcagctaatttttaaaattttttgtagagacaggtagcccaagctcaaactcctgggttcaagtgatcctctcaccttggcctcccaaagtactgggattacaggcatgagccactgtatctggcctcaagtaactcccttaaaagttggaatacagtccctgtcaagcatcagcaatattttcatgttttacctagcaaaagaggagtctgggaacgtgggttggaatgattaaggattgttacctgcactaaagaggtaataggagagtagtatgttaagtaataaaatttatgtggtgctgatggaagtctgatgcttccagactttttggaagtctggaagcatcagatagacttaaattcaaatactgtattagctatacttccaaatgataggtccaaaagtttttcttcaacttcatatgtctttttagttgatattgctctaaatttgatagagtaggtttagttgttaaactgaaaaaaagtacaataaatatactattttccctgtgttttcagacttttgaggcactttgtagtaccgttctttatgaaccatagagactatatataaatgctgagataccaaaataaatcctatttaattagacatttatcaagttaccttttttttttttttgagacagagtctcgctctgtcgcccaggctggagtatagtggcgcgatctcggctcactgcaacctctgcctcccagattcaagtgattctcctgcctcagcctcctgagtacctgggattacaggcgcgtgccaccatgtccagctaatttttgtatttttagtggagacagggtttcaccatgttgatcaggctggtctcgaactcctgacctcgtgatctgccttccttggcctcccaaagtgctaggattacaggtatgagccaccatgcctgaccaacatgttaccatttttaaacgaaggaagatgactttaaatataagacaaatggttgccacacaaataggtgaaacatgtatgaataatacagtaagtggcaaaaggtaaatgtattacatccagacagacttgttcagattaccaagtaattagacttcatccatgtgtaatgattaagaccattggtggttaagaccctaggattagggtcaaattgcctgtttttaatcctggcttcaccacttataagttgtgagaccttggaaaaaaatgtttatgtgcctcaatgttttcatctataaaatgggggaaatcatagaatccatcatagagctaggtatgtgtttaataatttatttaattaataatttttgttaaatcagtctaggcatatgcatttgattttttttttttaatgcttccaagatgatcgttgccagcccaacagaaaatggacaggtacttcgtgtaattccacctacccagacaggaatggcacaagtgattatacctcaggggcaacttgtggatgtgaatagtcctcggggtgagtaacaacgggatataggggatttgagagtgttttaaaaacataaatattttagaaaaatcaccttatgaaagtcagtgctaaagttgatttctttaggtaaaagattatgaattaaataattagaaaacagctctttgcccaaataaattcaaagttcatttttcaactcctgtctaggttagctatttcatttaagaattctatgaagctgattgactcctgcttcctcccaaatgaccaatgagcataaaataaattattattaatgataacagtaataataacagcaacaatagcaagaatataatgttaatagcttcagaagtttttatttatatctttttttttggaggcagagtctcgctctatcccccaggctggagtacattggtggcatgatctcggcttactgcaacctctgactcccaggttcaagcaattctcctgcctcagcctcctgagtagcagggattacaggcgcctgcaaccatgcctaatttttatatttttagtagagacgaggcttcaccatgttggccagactggtcttgaactcctgaccttgggtgatccacctgcctccgcctcccaaagtgctgggattatgcacgtgagccacttcgcccagccatttatatctttatcaatatttttattagccatgtgactcattactttttttttttatcctcttgctcttttcctctttccttggctccttcagattcagaaaagagaatcatgctccctatttctccttgtatagtctttctttacctgtttggtaatatgcctattactctttttttgttgttttttttttttttttttttgctttcctcccttttccctctatttgaatctcttttccaacctcatagctatactgttatgttgcttcttcatagctaatggtttagggcagatatttttaccttagtgttatcattctttgttaatagtcattaagacattaagagaaaaacatagattgcagaaaacattatgagcacagtatataaacaaaattagttttacattttcctatatattgcagaactcttaatatacaattatttctaccacttttatatcctggctgttcaatataaattctaaaaattataaaattacagtagtcagtattataatttaaagtaaacaagtrtcagagaaattctcaataaagcattattcctttactctcaataaagcataaattttctttacctattacaaatacataagttttagttaggtatattcttatggtcttattcaagatattgatgttactttgttcttgtttttgttgttaagatgtccctgaagagaaacccagtaacagaaacttaccaactgyaagagtggatactctagcagacaataccagcaattacattcttcatcctcaaacatccttcccattgcccaaaaagtcagtgaccgggtgagtccacgggaaagagaagctcatcttttaatatcaccatggaaatctttttacaaattacacatttaaagctggcagactatagagaaaatcagaagatagaaggaactatcattgaatatatctttagttattttaaggcatcttggtcataaggcggctattctggaagctataaatgtcaaaagtgccacttttcctcagtgacatctgttatcttttgaaacagtatgaaaattttattagtttatttagtctgacattaacagacttttcagaataaagaaacattcatggccaggtgcggtggctcactcctgtaatcccagcactttgggaggacaaggcaggtagatcacgaggtcaggagttcaagaccagcctggccaagatggtgaaaccccatctctactaaaaatacaaaaattagctgggtgtggtggtgggcacctataatcccagctacttgggaggctgaggcagagaattgcttgaacccgggaggcggaggttgcagtgagctgagattgcaccactgcactccagcctgggtgacagagcgagacatcatttaaaaaaaaaaaaaaaaagactgggcacagtggcttatacctgtaatcccaacactttagaatgccaaggcaggcggatcacgaggtcaggagattgagaccatcctggctaacacggtaaaaccccgtctctactaaaaatacaaaaaaaaaaattagccgggcgtggtggccggcgcctgtagtcccagccacttgggaggctgaggcaggagaatggcgtgaacctgggaggcagggcttgcagtgagccgagattgtgccactgtactccagcctgggtgacagagcgagacgctgtctcgaaaaaaaaaaaaaattcattatagttcctaaatttttwaatttgttttatcacatttttatgcatagaattcctctgtggcaaaatgtttaaaatgctttttgctaacttttatttcagtttttgtttttgttttaaaataatactatgatattttagggaaatatgtacatggcttatgtattgtttatgttattttaattgttccataaaagtatttttgaattaagacattatttttgacatttaatttcagaccttaataatgttgcttttcacttgatcttagccaaaagtccaagaagtgacacataatgttacttcaaactagtcaaatttatcatttttttgataaatgaaaacagttatataataagagcacaaaataagctttgggagagatatatgaaacacttaaagttgttgggactacgtgtatctggaagaagaaatttaggtctttgacttagcagttaataaaatagcagtggttaaagaaaataataactaatgcacccatcagatcaatctgtagttattgttaaaatttgttattgatgacttcaatatttgtctttgatactaagaggataaagcagttgaatgcattttgtgtgttcattgaactgcatatttatatatattcctctcctatcccagaatgctggaagaaccccttctggggcctcttcagccactttcttctaatacacctatatgggcctgccrtcttaggagctgtgaggtgagttataaataatcattacctagaattacttaactgattataaccacaggtcatccccaaatgccacttttgagtacaactaatatagtctatagttacagtattttgtttgtgtttatgttaaatctgatctcatctattgttgaattcttagagattctaagctctgttaaagcagaggttatatatatctctttacatttcactattatttcttctcttgcaactctcttccctcgtagtccatgaaacttcactatcatgtttctctactatttacttttcaaccatttattttctttctttgcttgcacttattttttttttttcatattatcagtagaaaattcttcaaggctcactttctgactttgtcttttttctctatattttgtcttttggagcacttacctactttgttgactttcaactgacatctacaaaaatgattttcaagtccgtatcaccagtttatttatttatgtatttatgtatttatttatttatttattgagacagagtctccctctgtcccccaggctgtagtgtagtggtgcaatttcagctcactgcaacttctgcctcctgggttcaagcgattcttgtgcctcggcctcctgagtagctgggactacaggcatgtgccaccacacctggctaatttttgtatttttagcagagatgggattacaccatgttggccagactggtctcaaactcctgaggtgatctacccacctcaggctcccaaagtgctgggattacaggtgtgaaccactgcgccaggccagattttgaattctgccttcctcttgtcccagatatctggctacttgcttgaaggtttatttgaatttcacctcaaattcaccatatcccatactgaaatcatctaccatgcaacaactagctccacttccaaaattccatgtctgtgtaatgacaaataccgtttccttagacacccaggcataaagttttgtactaatttcttgctttcccacatttaggtagtcaccagattctttttcttttttatttttttgagatggagtctcgctctgtcacgcaggctggagtgcagtggcgctgtctcaggtcactgcaacctccacctcccaggttcaagcgattctgctgcctcagcctcttgagtagctgagactacttgcgcgtgccaccacgctcagctaatttttgtatttttagtagagacagggttttgctatgtttgtcaggctggtctcgaactcccgacctcaggtgatcctcccgcctcagcctcccaaagtgctgggattacaggcatgagccaccgcgcccagaagtagtcaccagattcttttagtttttcctttaaagtatctttttctttttggcccatttttcaataggcctttgtcctcttgtgcttgattacaggaatagcctgccccctaacatctttgaccctcccatttctggtccctaatgtatatttttctaaggctacttgtatttgaagattgttttaattgtcttttctcagtgcccaataagtcatgttattttttccacattatttagccactgtagctagcttcaaaggcctttcataatctggtatcatcctacgttgtcctactttatttcctacttttctcaaactcatcttcattcttgctagcctagtcctcctacttttgacagatactccagaatttttctttagctctccctttacccatttttatttccttttcctatatgttacttttttcttctacttaccatttctaactattcttcaaatcccaatgcaagtcctacatgtcttttctataaattatctaatgattattttagcctttatctatttctctctttaaattctttagtattaattgtcattcttaattatttactagcttaggccgggtgcggtggctcactcctctaattttagcactttgggaagccaaagcgggcagatcacttgaggtcaggagttcgagagcagcctggccaacgtggcgaaaccccatctctgctaaaaatacaaaaattagccgggcatggtagtgggcacctgtagtcccagctgctgaggcaggagaatcgcttgattttaggagatggaggttgcagtgagccaacatcacgccactgcattccagtccgtgacagagcaagactccatctcaaaaaaaaaaattaaaaaataaaattatttactagcgtgggttgttcactgttacataaaaattagactttttgaggaaagggaccatgcctactctatatacaaaccatagatggtagtgaatatttaactatcagaatgcttcattgttttaaacaaatcttaaaatgtgggaaagaaaaaatattctattttaataatttgagaaaatttctcataaaaaaccttgtgctatatatattacatttgttaggacattattgttgttgcttttctaagtagagtacatgtatgtatatacatatakgtgtgtgtgtgtgtgtgtgtgtgtgtgtgtgtgtagttttagctttttgtccccctaccttttgttagtcatggtttttcagtggtttcctaaagttactgttgtgattgtttgatgagggttttaaaaatcattattacaagcctcatggaatgctatggatattagagcatttattaaaacaatcatgcaaccaaatcaccttatgttacaactatagtgcattgtgtggcttacctaaaatcatcgtatatcttgtaagaaactgagtactcctgtccaacagacttgagtatggttgtccaagatgaaccacttctttcccagtgaggggttctttctcctctcccaagctgtatcagtgataaaaaaatttttgagttggctgggtgcggtggctcacgtctgtcagtactttaggaggttgaggcgggtggatcacgaggtcaagagattgagaccatcctggccaacatggtaaaaccctgtctctactaaaaatacaaaaattaatctggcatggtggcgcatgcctgtagtcccagctactcgggaggctgaggcaggagaatcgcttgaacccaggaggtggaggttgcagtgagctgagatcataccactgtactccagcctggtgacagagggagactccgtctcaaaaaaaaaaaaaaaaaaaaaattgggttaatggctgaggaaatattttctgcattttggttcaaaatattgtttagtaatcttttattttttgaatttctcatttaatgatgttttactataggcatttttttcagatttgactaaagtgtattaactggacaaatgtcaatactgtattaaaatgttatctgtaagcctatttataagtatatatagttctgattatattatactgattttttctttattgacatatattctaattttatttataagtaaattatagtatagctaaaatttatatccatttatttgtggtgaatattttgatagagttgtctaggttagcagaaaaattataagcattttcattattttagaggaaattgcagataatgtattgtttggcatcagattatctcttaactattataacgaaaagtacagccacaacagtattttgatacctttctatttgttaaatgtattcttcctttctgcccacatctctgttcttatttcctctaagggggaaacatacatggagtcaattctaggtctctgcatttcattgtaagagatcacagttaacatgttttttctgttggtattgaaaaaaaagtttctccccagctgggtgcagtggctcatgcctgtaatcccatcactttgggaggctgaggcaggcagatcacctgagatcaggagtttgagaccagcctggtcaacatggcgaaaccctgtctctactaaaaataccaggcatggtgatgcacgcctgtaatcccagctacttgggaggctgacgcaggagaatcatctgaacccgggagatgaaggttgcagtgagatgagatagtgccattgcactccaacctgggcaacaagagtgaaactccatctcaaaaacaaaaaaaaaaaaaagaaaagaaaaagtttctcctctagtacgaggatactcaaatggttgtatatagataatatcaattaatttacattatttatttacacctttccttgttttagaaggaatttaagagagcttacaaaaaatacgtaaaatatattagcaaggtagaaattaaaagtgggagctaaacaataaagaaagacaaggatgggaacataaatggaagtaagaaaatacatgtcttaaccaactgtgtgtgtgtgcatgtatacatgtacttgtctataatctaggtatatgcttttcaaaaggggaagcatagttactaaattctgtgccttttagatttaaaaattatgctaatttccataagataaaagcaaaccattaactatttttggtactaagaccagacagaaatttctctcagagaaggatcttctttttttttttagacagagtcttgctctgttgcccaggctggagcgcaatggcacaatctcaactcactgcaacctccgtctcccaggttcaagggattcttgtgcctcaacctcccaggtagctaggactacaggcaagtgccgccacgcccagctaatttttgtatttttcgtactgatggggtttcaccatattggccaggctggtttcgaactcttgacctcaggtgatctgcccaccctggcctcccaaagtgctgggattacagacatgagccactgtgcccggcctcagagaaggatcttcataaaaagaatgttgatataatgagcaaatttttctacagcctttttatcaatcactcacagttttcattgggtttctaacagatgcatggcatcctatcaaaattaatctcaggccttcctgccttcctgccttcccaccttcccgccttcccgccttcccaccttcccgccttcccgccttcctgccttccctccttctctccttccctccttccctccctccctccttccttccctcctctttcctttctccttccaacctcactccaccaaaaaaaatcagtttcagtaaaggaggccccataggaaatgagtactttgtggctagttttacgctgatctggattgatccagggtaaagttttaaatatctgaaagaattgatatacattatatgttcttgcaagttatcttttctaaatattctttgtctcaaacaagacgttgataaagatagtatggcaatgagtttggcattatattccctaacaaacacctggttgaactcaaatcagacccactgattgtaatagaccattgatctgagggcacaaatgacattctcttgtgaaaggtgatgagtcttccattttggacaaccatctcattacatttattatgcaatgaagtgtattgctagtaattttgtttaatttctaccacatgcagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcaggtacttttttaaagaattattttaaaaggttcagcagcagccatagtccattgtcaaaatgtgattttcctaaggtgataacatttttattttggtagctgacaattgaatgctaattgattaaaatgcatattaaattgaaaaaacttatagaaaatataatcaattactttataatattgcattttaatatatcaatgaataaataagacttctttcatatattatactgaaaaataaaatatcraagtttccattaaacctatttaataaaatgttaaaagagcaattttattttaaatatgtacatcagctgtgtttttccccttcagattaaatattttagccttctctcttaatttgtattgtgggagaaatttatgtctattttatgtagcttgtaactctggagttactgtatagaatttgtatacaatctagagttatagaattctgatactaaagttctcaagcattaggtatgttatatacagtattctcagacactgggttagttgtttactaagggagtagagtttcaagcaaatctcttagactagttagagccccaaagaatctaaaactaagcgatttattttaggactatgagggcactaatttagctgaaagagttgcagtttcatcctggacctctgaggttaatgagatatacttaagatgagataaatgtaaccacttctgcctgagtttcatcagtattctataaaagaaatgcagcattaaaaataaatgagctgggttatttatatatttatttatttattttaaacgtggaggctcatgcctctaatctcagcactttgggaggccaaggcgagaggattgcttgagctcacgagtttgagacccacctgggcaaaacagggagacctcatctttacaaaaaataataaattacctggacatggtggcatggggctgtagtcccagctatttgggaagctgaggtggaaggatcacttgacccttggaggtcgaggctgcagtgaaccgtgatcatgccactgaacttcagcctgggtgacagagtaagaccctgtctttaaaaaaaaaaaattaacaaataataaaatgaacttgaaatcctatagtcttcctttttcccatcctagttttaatctccttaaccctccataggtagctactacatgaatttcatgtgtatcgttctagtctgtatttttatactttaccttacatattgtatctacaataatacattttattgttttggatttttaaaaaatgtataaatagtaaaatgtagatattgttttgcaaatattttcattcacccttttttttacatttattggtattgatagttataaatcctagttaatccaatttaatcattgtataatattccagcatgtgaccaaaccacaagtatttttctattgatcatcatttaggttgtttccaacttttcattattacaaagaatgctgtagtcaaacctccacactatatatactytaatgaaaagctgtaattagtttttctagagtatatgccttaaagtagaattgctggttgtgaattatgcccatttcatctttacaagattatcttaaaattgctctcaaggccgggcgcagtggctcacgcctgtaatcccagcactttgggaggccgaggcgggtggatcacgaggtcaggagatcgagaccatcctggctaacacggtgaaaccccatctctactaaaaatacaaaaaattagccgggcgaggtggcgggtgcctctagtcccagctacgcgggaggctgaggcaggagaatggcgtgaacccaggaggcggagcttgcagtgagccgagatcatgccactgcactccagcctgggcgacagcgagactccgtctcaaaaaaaaaaaaaaaaaattgctctcaaaagtgattgtacaggtccagaatccctttgaatttttttggaccaggtatatttcagaattctgaattttttgaatgtaatatggtaacattatggaatactcctagcaggtattctatagaccagcagtccccaatatttttggcaccagggactggttttgtggaagacagtttttccacggaccaggatgggggatgggggatggtttcgggatgattcaagcacattacatttattgtgcactttatttctattattactacattgtaatatgtaatgaaatagttacacaactcaccagaatgtagagtcagtgggagccctgagcttgttttcctgcaactagcaggtctgagctggaggtgatcggagacagtgagagatcatcaggcattagattctgatagggagccagcaacctagatcccttgcatgtgcagttcataatagggttcgtgtttctatgagaatctaatgctgccactgatctgacaggaggcagagctcaggaggtaatgcaagtgatagggagtggctgtaaatacagatgaagctttgctggcttgcccactgctcacctcctgctgtgcggcctggttcctatcaggctacagactggtagtggtccagtctggaggttagagacccctgttatagccaatatcacataatcaaacaccaattctttattagatagatagccacaccaagagaaacaaataaagactataacctcacacagctcaggcctggtttcgcagccaagtgagtcctgaaaaaaccgttttctgagctttttggatttcagatttgtacataagggtttgatagcttgtaccaattttcactcctgtcagcagtgtgtgaaaatttcatttccccacttttacttcatgacttagcattgccagatgtttaaaaatctttgtttgtttgtttgtttgtttttttgagwcggggtctcactctgtcacccaggctggagtacagtggtgtgatctcagctcactgcaatctcaatctccttggctcaagagatcctcctgcctcagcttcatgagtagctgggactacaggtatatgccaccatgctcagctaatttttgtatttttttggagagatgaggttttgccatgttgcctcggctggtctcaaactcctacactcaagcaatctgcccacttcagcctcccaaagtgctggtattacaggcatgagccactgtgcccacaccttaaaaaggttttttaaagccttaaaaaacctttacattatggaaatttttacatgtgaatcaaagtagagataataatataagaaaccccatgactctaggtatctatcttccagcttcaacaactatcagtatatggtcaatcttgtctcataccccttacacttcctcattccctagatggttttatagcacatttcagatatatcattccatctgtaattactaaagtatatggtgtatactaaagtatatatctctaaaagataaggactccttatatatatatatacatatatgtgtatatatatatatatatacacacacacacatacatatatgagaatcctgtgatcacacttaataagaaaattaacagtaactttgtaatgttataaaatgttcagcatttacattttcccacttacctcacaggttttttttcctctcctcaaaggttgttgaaattcaaatccaaacagggtccacagactgcatttagttaataaatctcttaaacttcttttcatttgaagatttctctcctcttctaggtagtttgttctgtaatatttgccatattctgggttttgcttattccatctgtgtgatgtagtttttgttctttatctcttgtattttctgtaaacaggtctagagccttgattaaatgcagatttgatttttgcaagaatacctcctcggtgtgctgtgtacttattgccatctgtatgtgtctctctgtttgtggtgttcagattgatcagtggattcagtttttatagagtattatggaatgtttttatttttgccattccaaggagtatgaaatagtattttactattgttttaatttgcatttccctgtttacttaaagttgaacatctttttctttgttcatttactaccttttttttctttctgacttggctattcatagcctttgcacatttttctgagtggttgtttattaattatttatgattgtttgtagtctacatagtaattctacatgggcaattactatgttatatatcttataaaatgctatttctcacactattacttttatatttacttatggtgtcttttaaacagaagtttttatattttaatgtcagctttattaacatttgtattagtaattggtgtttttattttatattttaaaagtttgttgtatcctacagtagtgtaagatattcaacttaaaatcttaagttatataattttcacatctacttatttgtattatctattgctgtgtaacaaattatcccaaacgtagtggctgaaaacgacaaacgttaattatctcacagtttctgtgagtcaggaatccaagagtgactcagcaaagtggttctgctgcagttgtctcatgacttgactgagggagggtctactttcagattcactcttgtggctgtcagcaggccttattccttgccacgtgggcctttccacagagctcccttaccacttggcagmtgattacctccagagagagcaattcaagcaagagtaagagagagtacccaaatgatagttacagtctttttgcagcctaatatcaaaaattacttcctaccactttggccatatttattaaacgtaagttagtaagtctagcccatattcaaggggaggggattactcaaggacatgaatgctagaaggcatggattactgggggccatcttagggctggctgctgtattaacagcccaaataaaaacaagaaaataattataaaaggaaataaaaatttaaatgataccaatatttattaaccaaatgtaacatttgctcactatttataaaatggtataaaaaccatatgtcaggtgggatgcagtggctcatgcctctaaatcacagccctttgggaggccaaggcaggcggttcacttgagtttaggagttcaaaaccagcctggacaacaagacaaaactctgtctactaaaaatacaaaaattagcctggcgtggtggcacacgcctatagtcccagctacttgggaggctgaggcaggagaactgcttraacccaggaggtggaggttgcagtgagccaagattgcgccactgtgctccagcctgggtgacagagtgagactccgtctcaaaaaaaaaaaaattatatgccagtagacactcagtaaatgtgatattcactaattttcttaccataattatggtacctttggtaaattttaaaataaacttttaaatttatatgtttgtatatgtaagtaagacttactaatgttttctttccttaaagctgtatatttgaaagattttgacattgccaccaccaagttacttttawtctagtgtctagaatagatggacacttgaattaatatcaatagttggttttggcccacagggagtagagctgtggtaatggagtgtcagtatgggccaagaagaaaaggtttccagttaaaaaaagtcagtgagcaggaaagcaggtcttgtcagctctacaaagccacttgtccagctcggtaagctttattttcttttatttgttttctattaagaacttatttttgaatagctaatacacatatttttattaggtttatacagtaccaaaaagtatacagtgaattctaagttttctcttacccacatttgttctgtctttaaagcaacaactcttactagttttttgagtcatcttccaaagatattctgtgtatatggatgcatataaaggcagagagacagagatctccttctttacccctataaatgttgttgaaaatctcagtaaagctcactaatattttctttccttaaacttacatagtagtgtaccttttttcttgatatgaattcacatagatttattctcaatctgaatgcctattgtggttatctgctgcacagatatgttacatactagtgtgaatgtaatgacatactttcctttttttcattctcagtgtatctcaaagctgactccatagatgtacataaaagtactattttttaatagccatataatattccatttatggatgaattatttaattcatgtaagctgtgaaaggtattccttattagtattatacaaagctgcagttattaacattgtacatatttgtgcactcctacaagtgtttcagtaggaaaaattcctagaaatgaaattgctagggcaaaggctgtatcttttaaaaatgttgacaaatattgcaaagttgctttttagagcgattttatcaatttagcagcaaattatgagaccaaygtagtaagttttagatagattaggactacagagtagtcattgctcttggtaagaatgaaaaatgtgaaccaatgaaagattttacaatgtcctttatgaatgtaaattttttagacattgaaagtattttaagacttaaaatatattgaaagtgttttaaactattaagtaaaataaaaaatttaaaagataatatgtagtggttggacttagttgatctttgaaacacttttagcatcacatctcacattataaataccttagcattcttggccgagcatggtggctaacgcctgtaatcccagcactttgggaggccgaggtgggcggattacaaggtcaggagttcaagacaagcctggccaactggtgaaaccccatctctactaaaaatacaaaaaattagccagccgtggtggcgggcccctgtaatcccagctactcgggaggctgaggcaggagaatcgcttgaatccaggaaacggaggttgcagtgagccgagactgcgccactgcactccagcctgggcaacagagcaagactctgtctcaaaaaaataaaataaaataaataccttagcattctcaagaagtttttaaagcccatttacaaggcttttcatatttaatcctgcaatattaactttaggtaatatttaaacctgactgtgaaacaaactttcagttgcttttttttttccatttagccttgacttgaaacttatcaactgcttcttaaatataagcattataaaaactttaggtataacttgggagaaaacctctacatgtgaagaaataattttattttccatcattctacaagtactttttgactgtctactctgtgcccagaaactacattgggtgccataggaaggagggaaaccaaaagaggaataaaattttacttaatcccagggaacggatcaggaaacaaaaactagtagacaacatgatagtatagaatatagtgtgaaatatatgatttaactacctatttaggtatttaaagaaggaatatatccatacaaattcatggcaggaaagaaagtacaatttaaactggatgttgaagtttaaattgaatttgggtgggtagagagttagagggatgatattgtaggttaggagaaccatataaataaagctatagaggccaggtgtggtggctcacgcctataatcccagaactttgggaggctgtggtgggcggatcacttgaggtgaggagtttgagaccagcctgaccaacatggtgaaaccccgtctctactaaaaatacaaaaaaaattagccaggcatagtgacacatgcctgtaatcccagctactgggggaggctgaggcaggagaatcacctgtgacattgaattatcaagtggatttaagtaatgaaagattggaggcacaggcctggaaggaggctattaaagtaatccagggccaggcatggcagctcatgcctgtaatcccagcacttcaggaggccgaggtgggtggatcacctgaggttgggagttccagatcagcctgaccaacatggaaaaaccctgtctctactaaaaatacaaaattagccgggagtggtggcacatgcctgtaatcccagctacttgagaggctgaggcaggagaatcactggaatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatctasgggaaaaaaatagtaaaatctgtaagtacttagatatttttaaataatgtttacttttaatttgctaagtattaatacaactgagaatatggcatatattttacataagcctctgaatactttacagataaattgaattttctctaagcttaaatgcttaaagtagacttctggttgataagatagattatcttgagattataatataatgaaacaaattcttctttatcttgtataaaggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtatgacatttttatagttcttttattttacaaattaattagctcaatttgcaagaattattttgtaagggaaattatagttttccaactatttcattaagtaacggttttataaggtagagatatcaatagttccctaggtattaaattgatttgccactgtgtaagccattgagtttcttagccccaagttgtagataattcagaccaaagaattattccatactgtatagcatatactctgtataccatataccatgtaaaagctttttctcaaaatgacaaagacatacttaatacactttattatatatttagtactttgttttagctacttactatgagcagaaacttcagccgcctgtcatttttttaaaactaatctttgattmcttacggcagccagaaatgaattccaagccgtaaataaaattccatttcacaccttttatgctttaggttttaaatgtgaaatattagcattcttttttactttcctttatgtgtcagtctgggtgaataatttgttattgtataatggatttaagtgtatggaatatcgttttcgtgtgatctttaaaaaaaacttttaggtatgtgaaaaataaattgagtcaacaattagatccttcaatgaaagtcaaaaatatcactaaaaaaattagatcctgcagtttgaagagcattgcatataatttttaagtaggcattgtcagttattgtaataattttatacagaaatatcaattaaagcagtatcctaccagattagttcattttcctaccgtctacttttctttttttttttttttcatggctctccaagagatctgcattcacctttagttaattctcttgctcacttggccagcaggagctgggagtgctgtagaggcagtatgttgagctcctgtgaggaaagaatcaaccataaagttcagtcttgacaggttctatctttggttggaaggatggtaggtgtaacagagaagtgtaatttgggacgaatgtttgatgaatgggaaaatacacagttcaaaagatgatgatttacaatgtcttctctttattttgaggtaaaatgtacttaatatgaattttctcatgaacccaaaataatacaattaatatgaaatttaaaatgccattttcatatatacttaaaatccctgtatctccctcaactgtaggaccacagtgaaagtctataaatatttacaaatattttaatttaattggatataaagcaaatcttagaagagttaagagatcattttwaattttatttgatatgaaataaccatatataattttttcttaaaggattaatcctttcctttatgagtattaacctaagtaattatgattcctactttggtctaataatattaaataattttaatgtttaaattttagtaattttaaatattttctcttaccaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaaggtacaatagaagagcattgttcttttacatttttcagttttgtttsttgctttaaataatacagtgaacattggagatattttccaaaatatatgctatcagggtagataaggaatatagtttattaatttattaaaataatcttatttataaactgatcattttctaacaaatgcttggcaagcaatggtgtaatatggtttattataattctgattactcacttgagacattctatatttggatttggcaaattggactatgtctaaatgatgtataaaattaaatagttaataaatacttttagagaagaaaacctttgtagcaccaaagattttaaaacccaggccaagatactatttgaaatgcagttaaattttattacaacacaataatttggatagttctttgtctaatgaaattttatttgtagtactctggtctaagttttttgatcctcaggaaataataataattatataagtaattatataattacttattttgtgtgtgccaggtactgtgctaggctttttacatgtatgatctcatttagtcttacaatagcactattaagttggtatatttatcccaattctacacatgagaaactggagtctcagagtggttaaataattggcttaagaggcagtggcagagtcaggcgcagtggctcacgcctgtaatcccagcactttgggagtccgaggagggcagatcatgaggtcaggagatcgagaccatcctggccaacatggtgaaaccccgtctctactaaaaatacaaaaactagctgggcatggtggcacgcacctgtagtcccagcttctcgggaggctgaggcaagagaattgcttgaacccgagaggtggaggttgcagtgagccgagatcgcgccactgcactctaccctggctacagagcgagactccgtctaaaaaaaaaaaaaaaaaaaaaggcagtggcagaactgaaatttaggcctaacgctatatagcctgtgcctattaccgtgatttatgatacttagccttgctcttactgattattgtgtaatctgatctgaataacaaaataaatatagtaagccccctcttaaaggcatgaataggttctcgaaaactgctactttaaccaaaaggaaatacagcaggtccttgagttatatcgttctgttcaacgtcttttcttttgttgttttttttaactttttttgtaaaagaagcaggggtcttgctatgttgcccaggctggtcttgaagtcctggcctcaagtgatgcacccaagaagatgggattgcagaagcaagccactgcacctgattcggtgttttcttatagcattggagaaaataatttggttttgttgtatgtcctttcacttaaggtctcagtttccaggagcctaacaatgatgttaactgagagcttactgtaattcctagaattatttcctaattaatacatgacttttctatttagcagttttcttagacattttatatttatttccactggggcatcattagcataaggcaaaaatttggtaaagccattcactatttactaaacctgaatcttaacaatggaagtataatacagttctgcgatttggtccaccaaatgtaataagcatatatatgttaaattttatcatttcttttatatattgattttttatacaattaaataacagtgctgccttctatttctatcttcttttgtctccgtgtaaaattcaagcccatcatatttcatataatattaattgatacttttggaagcaatgtaacatgatgtttacgcacataacctgggtataggcccaagctctcttatttactaggtaggtgtatgattttgggcaaattatttcacttctacagtccttagttctatcatctgtaaagtgggaatgataattgtacgtatgtcgttgatcattaagggttaaaggagatatttgatgtgaagtgttccatacagtgcctgacatagcattaaaaacattattatacttaaactgaaaataatgatttctttaaattcataaaaatatcaaagctcagctgggcgtggtggctcacgcctgtaatcccagcactttaggaggccgaggcgggcggatcgcgaggttaggagatcgagaccagcctagtgaaacatagtgaaaccctgtctctactaaaaatacaaaaaattagccgggcgtggtggcacactcctgtagtcccagctactcgggaggctgaggcaggagaatcgcttgaacccgggaggcagaggttgcagtgagccgagatcacaccactgcactccagcctgggcgacagagcgagactccatctcaaaaaataataacaaaactcactctaatatatttagatgttttaccaatgaaaatattacatttctatagtctgcaataattctatgttgtatggaaaaagtttaaataggaaaatataaattacttacagagctataaaccatactttatagaagtttatactgaaagagaacctttctgtcttttgatctaaaggcatattgctaaatggtttatgtctttattccattttgtattctttacagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaayggtatgattacaaccataattccttattacagagtctttctcagcttctattaatatttagtctaataagaatggctagtgttaggccatctgaataactgcaatataagcaaatacaataggccgggcgtggtggctcatgcctgtaatcccaacactttgggaggccgagacgggtggatcacctgcggtcagaagtttgagatcagcctggccaacacggtgaaaccccatctctactaaaaatacaaagattgggtgggcgtgatggtgggtgcctgtaatcccagctacttgggaggctgaggcaggagaatcacttgaactcaggaggcggagtttgcagtgagctgagactgcaccactgtactccagcctgggagactcagcgagactccatctcaaaaaatatatatatatagcatctttttcttaaaatgtaaatactcaatgtttagaaaatgactaaaagttttttattactttcacaagaagaaaaatcagtgaattcccaactccataataaaaacactggccaggcacagtggcttgtgcctgtaatcccagcactgtgggaggccgaggcgggcagatcacctgaggtcaggagttcgagaccagcctaaccaacatggcaaaaccccatctctactaaaaatacaaaaaatagctgggtgtggccgggctcagtggctcacgcctgtaatcccagcactttgggaggctgagatgggcagatcacaaggtcagaagataaagaccatcctggctaacacatctctactaagaatacgaaaaattagccgggcatggtggcaggtgcctgtagtcccagctactctggaggctgaggcaggagaatggtgtgaacccgggaggcggagcttgcggtgagccaagatcgtgccactgcactccagcctgggcaacagagcgagactccgtctaaaaaaagaaaaaaaaattagctgggtgtggtggcgtgcgcctgtaatcccagctactcgggagggtgaggtaggaatcgcttgaacctgggaggcggaggttgcagtgagctgagatagcgccactgcactccagcctgggagactgagacttcatctgaaaaacaacaacaaaaaaccactaatctttatttttaaatcaacatgtattttctctgtaaaaattattcttactcatttaacagacatttattgagtactattgtatatatttcccctcccttttttaataaatgggcaaatttaaatacagttgtttgggctgggcgcgttggctcatgcctataatcctagcactttaggaggctgaggcaagtggatcacctgagatcaggagttcgagaccagcctggccaacacagtgaaaccccatttctaccaaaaatacaaaaattagccgggcgcggtggcaggtgcctatagtcccagctacttggcaggctgaggcaggagaatcacttgaatccgggaggcggaggttgcagtgagccatgatcatgccgttgcactccagcctgggtgacagcagcaaaactccatctcaataaataaatatatatccatctatccatccatccatccatacatacatacatacatacagttcttcatacttgattgcccaaagtgataatgttggttccatatgccatctgtggatatcagtttaactcatacttttttttttttgagacagtctctctctctcttgctcaggctggattgccgtggcatgatcctggctcagtgcaacctccatctcccaggttcaagctattctcctgcctcagcctcccaagtagctgggattacaggtttcagccaccatgcccggctaatttttttgtttttattagagacgggtttcaccatgttggccaggctggtctcaaactcctgacctcacgtgatctgccctccttggcctcccagagtgttgggattacaggcgtgagccaccacacccgaccttaactcatagtttgatatggtagtttctccctgaatattagtcatctctgtgaaaattttgcctactctgaagagattaattacccagaaacaactaattacaatacagccagtgattatgccattaaaatctgagatgtagtatattttgctttcctaacttgttatccaaatgcagtatctgaaaaaatatggatattttaaaagccaaaactatttcttacaatccataactctttgtcttttttttttttttttgagatagagtttcactgtcacccagccagagtgcattcacacaatcacggctcactgcagccacgacctccaagactcaagcagtcctcccaccttagcctcctggcagctgggactacaggcaccagccattacacccagctaattttttaagtttttgtagagactgagtctcactttgttgcccaggctggtctcaaactcctggcctcaagcacctctccagccttggcttcccaagccttacgggcatgacccactgtacccagcccaataactcttaattattcactatctaaatgttagaagtagtccttgtcatctacactgttgtctaaatccttgctatctgaactcaggaatttaatgtatttgtatagtaaagtatacttgtgcttgaagaatatgaacaagtgaagagagtagttgcagaataaatcacatactgtgaataaaatatgacagtcgtaatgacgtcttaagatatttttcaatataagagctttatttttactgaaataaatgttcccatttcagcttcaatggactacagacagtggraatattctcaaagagaccatgacagttmcatttgcagaaggtaggttttcttgaatacctttaaaatataaattcaaatggtgtttaactggaaggaacttaagatattatctcatctaatcaaattttatagataaggaaaccaggatccaaagacgtaggagcagctatgttatggtttatcaacatacttcctactattttaatttcctcttatactttgtttttaatgcttttttatgactgacattttgaagctgataactagcacagttaactgtagctaattcactaagtctggytaattccagtagtaataaccctaagatgccctgatctgggaactatggtccattttttacggttgctttttctcatgtgttcttactgctgggccctttcaatattccaaacttatttccacccttttgcatttcttctctgttctggaaatgtcttttttcttatgcatggcaaactcctcttagtactcaaattgtaatctcttttaagtacattcataacttcaccccctatataaagttaaacctctgaatttctttttttgtttttgagacggtctcactctgtcacccagactggagtgcagtggtgcgttctcggctcactgaaacctcagcctcccgggttcaagtggttcttcagcctcagcctcccgagtagctgggatcacaggcgcacgccaccatacctggctaatttttgtatttttagtagagacagggttttggcatgctggccaatctgatctcaaactcctgacctcaggtgatccacccaccttggcctcccaaagtggtgggattacaggcgtgagccactgcacccggccaaacctctgaatttctataatgagcatctgactgatagcatttactgagctcagcaacactggcaaaagaatagagcattggtaggacaggagagagaataaaggacttactagatttgtaaagttgagtatctgagccatttcagtggcgtggattgggaggaagccatattggggtgattgaagtgtgaatgggagatgaggaaggagtagggactccttaaaaagtgtaccactttttcaggaattttgcaatggcaaatggggttgagggaacgtattttaagagtagagaactgaaaagatagatgaagatggtgatgggaagttgaagaaacttctgttggctttccttttctctgtaagagtgctaaggataaggaaaggtttcaagaagggtggcatggatttgagggaaatgcaaattagaaattatcctggatagagagtgaaacattgccagatacaggtgaaggtccaatcaaagttaatagtgaattggtattagtagaattagtgagtttctttttcagtggcactcagcttcccatgtattggtgcaggaaagccatttttatgcagagttagggttttactggagggatatgaccaaaggacagagaggcaagagagtttaggtacttgtaaaagagtgactgaaattttatagacctaggactgtaagctggatgggggaagaattttattaagaaagaggttgatggatctgaagaaaactgagggattaattgactggaggttcacatgaggttgaagaacaattgtagtgaaatacatgagcaaaatctctggaagaataagaggttgtagctgggcacggtggctcacacctgtaatcccagcactttgggaggccaaggtaggtggatcatttgaggtcaggagtttgagaccagcctggccaacatggtgaaacctggtctctgctaaaaatacaaaaactagctgggcatggtggcacatgcctgtaatcccagctactcaggaggctgaggcaggagaatcgcttgaacctgggaggcagaggttgcagtgagctgagatcatgccactgcactctagcctggatgacagagcaagactccatctcaaaaaaagaataaaaatctaaaaataagaataagaggttgtgatcagagaatgagatgtttgaacttgagattttagaggtaggatcatccagagtatgatgatagtggtgggtgactacagcagtgaagtaaaaggacattaataacgaagaaaccaagaaatgcatgattgctgtttagtcctctcagtggtccattgagaaaggactcttaagctgattttacagatgaggaagctgaagtttagaaactaagttataggatgggtgcagtgactcaacgcctgtaatcccagcactttgggaggccaaggcaggtggatcacctgaggtcagaagttcgagactggcctggacaacatggtgaaaccctgtctctactaaaaatacaaaaattagctgggcatggtgtcacacacctgtagtcccagctactcaggaggctgaggcaggagaatcacttgaacctgggaggcagaggttgcaatgagccgagattgcgtcactgcactccagcctgggcaacagagcaagactgtctcaaaaaaaaaaaaagaaagaaaagaaaagaaactgagttatatagcgtattgaaggtgacacagaaagccagtgcttaaatccattcttctctgatactctggccattttaaaatcagtcagttgtattatggaagcaataaatgttcattgataattaggttttctctttctgttttgagacagggtttcactctgtcacccatggttgagtacagtgggacgatcttggctcattgtatcctctgcctcctgggctccagtgatcctcccaccttagccccccaagtagctgggactacaggcacatgccaccacgcctggctaatttgtgtatttttactagaggcaaggtttcaccgtgttgcccaggctggtctcaaactcctggtctcaagttatccatctgctctggcctcctaaagtgctgagattacaagcgtgagccacttcgcctggccgataattagttcttcactgacttaaagagatgaatatatttgggttaacgtataagaattacatgagaatgattcaaattccctacaattagtttaaatttgagatactaagaaaatagagtttttatttttattcatttataccaaaatgagttattgaaataaatttaatgctgttatcattaaagaccaatttttccaggtattgtcctagttactagggctacaaaaggtgaattaagtttggtgttaattgagaagctccttagatttcacacttctagagaagtttagtatagtccagcattatagtacggagamcacactagattcgagttacagatatagcgtctttcaagwatatatatatatatatatatatatatatatatatatatatatatatatatagttgtgcctctgtatctatgggttctgtatccatggcttcaacaaactgctgaccaaaaatatatttttaattggatgtataccaaacatgtacatattttttccctattataatctagagatgatttaaagtatattggaagacttctacattgtattgtgtattataggtaatccagagaggatttaaagtttgtgggaggatatgcttagattttatgcaaatacgatgccattttatatcaggaactgagcatctgyagatttttatttctgatggaggtcctggaaccagtcttccatggatatggagggacaatcccattctagatctaccgaattaaaattaatggaggttaaacctaggaatctatgttttcttaaacatcccttagagattcttattatctgccaggttctgcaaatagtgggctacatcagcagtccccagcctttttggcatcaaggaccggttttgtggaacacaatttttccacagacccagggtggagagttggggggatggttttgggattaaactgttccacctcagatcatcaggcattagattctcataaggagtgtgcaacttagatccaagaatctaatgtttctgctgatctaacacgaggtagagctcacgcggtaaggcttcctcatgcagtaaggcttgcttgccccatgctcacctcctgctgtgcagcccagttcctaacaaggcacagactggtagggtcagggacccttgggctagatgacttattgaagtcctttgcaaaactttgaaagtatttcctattttagttctgacagaaagggttgtaataaagtatttttatgacttcatagaagccataaaaattattttaatagtttctttaatataatttaggaaattcaccaggagaatcaattaccaccaaagtggaaacaaatcagaccaggggttctttgtctcctgagccaacccacttgctctcctcactctcctcatttcagcccaaaatatttacacaactacaggtaggtatccagtaaaatatccaaatttgaggtccttctctttattcctccatttacctcttcttctcctagggattttagagaattgttacagaattataataatgatgaaatatgttttcattgttaatttcctgatctttttgtttcttgatttaagataattcaaacagtatgttttttaaaagtttaaagttgactatgaatgcagtaaatttagttgtactacttttcccttgattcttgtttctttcttcatttaataattatttttaaccatactctttttatttgttcggattttttgtcaaaagaattgtatatcctatgagaatatcatacataggaaattcaaacattttgatgtactctttttggtttaaaagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttagtaagttgaaatcaatttatgatgttattgttgtaacctttgtggattatcatcactatattatactatagataaaactattatttctacccagtgggtctatgatattatgtaaatgaagcaaaattatgagagagaaggaggagatttcattaccctgcgtttcagaacttttaaccttaaattttcttcttcttatttctaattatttagtaccgtagaaattacttattccctaattacctgttttccatggaaaatctgtggtaatgtgaaaccaggaaggtcattttagagtacatgaaaaaattaataggaaaaaattaaacaaggaaaaatattttcatgcaaaggttattatggaagaattgatgtatgcacacatacacaaagaaaaatgaaagaagtaggcatatatgaaggttaaaaggaagattttcatttttggttttttgttgttttgagacagagtctcattctgtcacccaggctggagtacaatgatgcaatcacaggtcactgcagccttgacctccttggttcaagcgatcttcccacctcagcttcccaagtagctgggaccacaggcacatgccaccatactgggcaaattctttaattttttttttttaaaccagcctgttgcgcaggctggtcttgaactcctgggctcaagcaatcctcccacctcagcctcccactcctcacgcagtgagccactgcacctggccaaaaggaagatttggaattacaaaataaatgttgagttgaaagggaactagtaagacttgggcatttaggtttagcccaagaccttcttaccttcactttattactaatctctgtcaacatagaagtaaactctgttaactcctactttatctgttacttctttgcacatgaattgttctggattgggcacttttgtgggaaaagatttgcagtttgctttgaagaacaaaagttttcacagaagttatttttagaatataaaatatttttcccctctcttccagtgtcatgaaatagattaacttttaggatttttctgtttgtttttaaagttgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaargaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaaaaaaaaaaagattggtaaactagaaatatcaactataattgtcaggaaattaacctaaaggcttttgtttctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataataaatcgttacgtctcaatagtggtaatagtggtaatggtttattattagctgtttcaccaattgaactacattcttttggagacattcctttcttttttgatgttgatttgcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattacagctcagcttgtttattcattatagtttccacatttccaacttccaagtgaactttatatatactacagtgaattatagataaatacagccatggtggacctttccctcaatagtgattttttgtacaaacagttagtataattaaaaggaaaagcttttatattttatgcaaggtaaatgtttcctaaatgtcacaaaagtgatagaaaacatagcttttgggatctggtcctgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatatatatatatagcaacttgatgtatagtgtccttgttaccatgtatttttttcattaaaaatcctgctttttttttatacttgttagttttctttttatatttttcttagagatagtggcaattttgttcatcttgaagatgctgaataaacacttgaatacccgagaattttggccagagatttatgtccaatttggaacctgaaagttttaagcataactacaagtaactcctgttagcattacattttggggagacatatatgcatttaataccctgcaactcagccaagcatcaacattttaaaacaatgtgtgtaataagtaattctccacgcccacccacccccagccccccgatgttttggcaccatgacattttcaagtatagctttatattttaggagtaatgacaaagtatgtgatcaaaagagaagggattattaattttttccctctttgcttttttttaaactttattccactctgtacctatttttgaggaccttgaaaatcttaatctctccagaagggatactgcattggttcttctccatcagctggcttagacatcaaacatcttaaatgatacactgttttaatatctaaaaatctgtcattctacttaattaacttagtcataaggacaaagccttagtatatttttgccacatacatgttatgtataaattttactgttgaataatacaagtattcattgctgactgaattcttaaaactttgggaatagaaaaaacacatttattaatggatgctaaagtgattcctgagaaaaataatgtgtatggttaatatggaaaacctttggtaatgtgatttgggtataagaatactaaaaccagagtacagggtgtgaatcatgtaccaggagggattttatttttaaatatctttattgaggtataattgaaatacaataaactgtacatatttaaagtacccaatctgataagttttgtcatatgcatacagccatgaaatcatcaccataagcaaggtaatgaacatattcatcactctcaaagtttcatagtacctctttgtgatcccttcttacttaatcctccttgccaccccaccatcaccagaccactgatctgctttctttatgatcagtttgctacaaatgaaatcacataatatgaaccttttttggtctagcttttgtcacttagcatagtaattttgtgatttgtctatattgttgcatttatgaataaatcatttatctgctgctgagtagaactgcattttatgaatatatcaatttgtttattcttttgatgatggacattaatagttctaggctattatgaataaagtttccatgaacatctatgtacaagtctttgtacagacttatgctttcatttctcttgggtaaacatctaggagtagaatgcctgggtcatatgttaggtatatatttaactttttaaccaactgccaaaagattttccaaagtagttgtaacaatttatattcccaccaacagtgtatgaaagttccagcttctctatatcctagccaacacttgttatgaacagtttttaggttttagagattttaataggtgggtagtagtatcttactgtggttttaatttccatttctctaataaccactattgagcatcttttcatgttgtatttgccatctttatctctatatcttctttattgatgtgtctgaatcttttgcccactttttttttttttttttaagaccaggtcttgctctgtcacccaggctggagtgtagtggtgtgatctcaggtcactgcaacctccacctcccaggctcaagcaactctcctgcctcagcctccctagtagataggattacagtcatgcgcaccatgcctggctaattttttgtagagacggggtttcaccatgttacccaggctagtctcaaactcctgggctcaagcaatccacccaccttggcctcccacagtgctgggattacaggcatgagccatcgtgcccagccttgcccacttttatttttgttttcttatttgttttttattctttttttttaaccacagccagcatcatagctcacccacttttaaattgttttcttttttttttttttttttttttttttgagatgcagtttcactcttgtcgcccaggctagtgtgcaatggcatgatcttggctcactgcagcctccaactcccaggttcatacaattctcctgcctcagcctcccgagtagctgggattacaggtgcccaccaccacacctggctaatttttgtattattagtagagacgaggtttcaccatgttggccaggctgctctcgaactcctgatctcaggtgatccactcaccttggccccccaaagtgctgggattacaggcatgtgccaccacacccagctaatttttgtattttttagtagagatggggtttcaccatgttggccaggctggtctccgaactcctgatctcaggtaatctgcccgcctccctaagtgctggtgctgggattacaggcgtgagccaccactcccagctccacctgcactttcaactgactacaaatctgagaggttctcacatccccttttaggtttgataatttgctagaacaactcacagaactcaggaaagtactatacttacaaccacagttttattagaaaggatacaaaccagaaatgaccaaatgaacagatacgtaagatgaggtctgtgagggtcctgaatgcagaacctctgtgccctctcgtagaatcaggacatgttattcacttttcatatcaatgtattcaccaaccaggaagatctactgagtttcatgtccagagttttcagggggttttattacataggcatgattggttcaatcattggcccatgattggactaattcttcagtcctcctgtctttcctggaggacagaaggctgagttgatatcattggctcaaagccccaacccaaccctctaattagatgtttggtctttatagcatgactagctcccatcctgaagctatctagggacccactatgtgtcatctcattgcatatactcaggtgtgattcaaggcgctcatgaataacaaatacactcctagtacttgggaaattccaagattcactatcaggaaccacagataaaggaaagtcaaattatttattatatagcagtgtaatgcatagttttgttgttttaattgtggacacctactttagtctgagatttgttaccatgtcacactatactaggttcatctcatttttcttcaaggctattgtgtgaagtgcaacatgttttatatattaagtgtatcaactctctgttacttttcctggtttgtagtttgccttttaattttgatgacttctgtgcttaaacaattctcctccaactagatagaagataaacatttatctaaaatttcctatagctttcttatgtgttgtttttagtatagtgaaattattttgttgcagaggataagtttaagtagatattttttcaattaaccaactctcccaatatgatgggttttttccccctctcttccaatagaaacctaactcccaacacaatggaatgaatttttcacttttttaattcacctttgaaaggagtaggcaggttgtaaggaattggagattttgtgtcccattttttttagatgaagaggtccaaagtggtaaataattttccccaggtcatctggaaagggcagaattgtctgactccaaagtcttaaaaagacgtttacttagtgtcactattgcgtcacatgtaattacccaatgacttcaaatgtacctgacattatcaaataatttgttctgatatgaaaattgaaaattaaatggaacacagaagaaaatatagttatgacattagacaagacaatgacattaagtttaaatctggatcgccaaacacaaggtaagtttcccttgagttgatcaatttaagttaaatcaagtctctattactgaatcatacaaaaatgaccaaaaatgttcaccaaacttaggggcatatgtttatgatgatccaacttgtagattttgtggttcacatgaaaatccactttaggaagttcaaagagccacatcaaaaagatagccatcttccagagcagctaaaattcag

SEQ ID NO: 17844 - DNA, 14165 bp, Homo sapiens
agactggtaagatctaaatacacacagagcagaatgggaaggaaactgcagacaggagacaagcgaaagatttgtaaagtgggaaggaagcagcagtgaacaaagacaaaaagaactaagcaaccaaagacaactttgaagtgaaggagatgcatttctttagagccaaactagaaatcatgatgatgggaaaggaaaagaaataacacgaaaaaatactcgcgatcacaaactgtggggatacttgagttcctgtaattggtaatgccaccactgacaccattttagtcaatcatatgctatcattaatcacatttaagtacagcatccagtaaacactaacagtgtaactggagcaacacttttcacaaacggtcaacaggactaaatgctttgtattctcccgcggctaggctatttggctgcagtattccccaataatgagacatgtttcatctgcagttaaggaaacccatggagcagtaagacattatttcctcttacctgcttctagatagcagcctacatctcagcaaaattcctgaatttagctaactttaagggataaatgtaaatctgtctagaataaaactgagaaaggggtagcagaccccacttgtttgccaacagcctcttcaaacatgtgccctgtctctgagaaattatatggtaaagcatttataactgtggctgtctatggaatccacacttggcagaagagcctaaaactcatcctatataggaaagaggtcaaactcagaaataaacaagtcttcaactgaaatggcataggttaaaaataaaattacaaattcaagtctctgggctttagatagtgtaaaacaccaggcccctccaattttggtagagcgaaaaaaaaaaaaagagaaacaaaactaggtctcccaattctagattaagaggaattccagtacatgaaaaaaaaaactgaaagtgtcagaaagaatatttatttgcttttaatggatgattatgagttagaaaatataaccatacttgggtctgcaatgagtcaatttggagtatatttctgcttctgtctttacaactaaataggaagtcactcctaattttatttgcccttctgtaacattgggaaattctgtttatttccttgaatttataagagttgcacattacagaaaaataaatgctatctatcccaagatatatacaacaaatttaactgaaggtaaaattctgattactaaagattttcttttaagcccaggtctgtgggaaaagaggaacttagccttttcagggagactttaaggtcatgaaaagccccatatactcctctatgaagctgttctcccattttcaaacttgagaaaaatgttaagaaaatggatacatgatagtatacacacctgatttgacccaaacctcaggaaagttccttaacctcactaatcctgtttcctcatctataaaataatgacaggccgggcacagtggctcacgcctgtaatcccagcactatgggaggcagaggcaggtggatcacctggtcaggagttcgagaccagtctggctaacatggtgaaacaccgtttctactaaaaatacaaaaaattagcccagcctggtggcgtgcgcctgtaatcccagctactcaggaggctgaggcaggagaattgcctgaacccagaggcagaggttgcagtgagccaagatcgcaccactgaactccagtttaggcaacaagagcaaagctcagtctcaaaataataatgacaaatccaaatctcctgaatagtatctgtaaagcatcaacacaacatcaacacaaagatcggcacaaggtatgcactcagctctgacaattctttttactcaccaatctttcttctttctctctttttttcctcttacatttcaggtatcattttgctttctgtctttgggcaatccactcgcaggaagttactaaccaaccttattggtaatacctattattcattccctggtccaatctctccccttagctctaggataaatatggccaactgaccaccaatccattccaatctttaaataccctgagaattgattatataatcttccctccaaatctgctcttcctctatttacctatcttggttgtcatccacagtcacacaaaaacaacttggaagccaactgagctcttccttcaccctctgcatggccctccatcaaatttattgtgaagtccttagaaattctgtttcttccttcacttccatccccactgcctgtttgttcctcatcatggtgcatgaactcctgtcagaaccttgtaactgacttccctacatcctttaaacatgtgatatcttcctaaagttcaactactaatcttcccttccaaggtaccaacactggcttcatgatagtatctaaactccttggcaaggaattcaaagcttttcaggatctgctcctgcctaccagctgctcccaacttggaattctgatattctaggagtgtcaaacaaactttaataactagccaccctctactcaggctgttatttctgcctgagacggcttaccctctatccccttgacctgggaaattctcttaagaattacttattttacaaaacccttccatacctttattagaacacctaccacataagatttcacttcttgtttactgcattatctcctctactcaatagtaaaccgctgtagagcagaaactaagtcttgtattacaaccaggtgctggctgtacatagtacacagaaacgggtagaatttgctaactactcaaagagtggggcagccaagattaatataaacagtatatttaagggcatggaatgggaaatggtgtctacaataaagacgtgaattttaaaaactaatgttttgaaaggagtcattgtttgcactattgatcatagaaatatttttaatgtttttaaaaaggagtctttttttaacatttggtctatagacttttgcaggaaaaaaaacctgaggttttaaaagctataggaaaaaatgtttcttgcttatttcaagcaggagcagggggaaggaaattagactagtgtggggagaaatgagaaatgagagctacttcaactcagcacagttaacatttaccaaattaaaataacagtaagccaaaccaaacttataataggtggaaaacaactaaatacaaagctagaaataaattcttttagttcaactgtaactttcatacttgaatatgtaacagcggtgtacctgtgacattagtatttctgaggcaaagagaaaacctccctaccttgaaaacaaactccctttttggactagatgacatttccagattatttccataatacagaaaaatcctagttgcagattcaataaaaaactggagaaacaaaagacaacaaaaaagtctcaatttataacaccccaaaatcaaaacttaagtgtgggaaatacaagacaatcttgtggacaagagaaatcaggaagaaagaaaaatgacattttccaggtttccgcaggactttctgatgtaaaatggttgaatcagaattgaaaagacaaccaagagtcaagggcagtgtcttcccagaactgctttcttaaggtaagggaggggaccaaagacactcattctttccactaaaaatttacttaatgtttccccagaaacgataactgacacaggcctcagttttatcttctgtaaaatgtctacttcccagtgttgtgaggacaacacagctaatatttatcaatcatgtcactggcttaattacaacttatttaaaataggtattactaccattttacagatgaaaaaaactggatcacaaagtgactataagatgatgacagctttgaaacccaagcattactaacccagaaacctctgaacagcaaaacttcgtgcctcaatacatgtgttccttttctgctcaaccaattatattcctaccatctcttaagaaaaaacgaaaatgacatacttttaaagcaacctactatgtgcctggcatggtaaattgattaatttatcctcataagagccctgtatagttggtttagatttaaaagtttatgctttccccagtgaaaaacttttattttacatgtaaaatggttcttaaattgcttctctgacataaatatgtctgagtttgagccctatgagtcaggatttcccaggacttgataaccactctgggggaaaaaaaaaaaaattgaccattcaggttccagatatacagaattaagaatactgtgcaaggacagacagacttggggcctgctgtccaccagtgatctagaatattctaccaattgaacttcgtatctccaacctcccacaaaagcaatacaaagagaaggcagtagagaccttgtctgtgggtctttcccaccctgaattcattcacattgataatccaaatctctgttttacatcatctaattagtaaaacaaaaaccattaagctctgtatgtagtatatgaaatctgctaggaaatggaaattctagccataacttagctatgaaatactaattaagaaaaacaactcaaacaatctcagcgtatttgcaaagcacctcatatgcattttaaatacaggacccagagaaatagctgcgaaaggaaagccaaagttattaaatccaaagtttttcattttcttgacatgctctttctatttaatacagaaatgtactaatataggttgccttttggtattgtaatttggtcaaccaaaacttgggaaaaataggtccaaagtttttcattttcctgacatgctctttctatttactacagaaatgtactaatataggttgccttttggtattgtaatttggtcaaccaaaacttgggaaaaataggtttattaataacaaaataatgaaaaaaaatggatttcaactagtatcgatttttaggtgtgtgggggcaggggcattcaagggtattatttcctagtaatgatcacttagattctaggccttacacatgattcaaatgcaggagaaatcaggaaagaagcaacagatatggtggtgggtatcggatgtctagactacaggcaaaccccaaataccaaagaagcatccatgtgtcaaaccagcataatttttgagctatgcctggggccacatacaaaaaaagaaaaggttagcttgaaaagaaaaatctaggagaggtaaccagaaggtcaaccacagttcacgggatctgggaagaagctagccgttaccctgtgtcatcttcctgagcagcttcctccccagccagctccccagcctccttacaatgtttccaaaaggcccaactccctaaacatttgcttcttcaaggtcatcctaaggcactgaataaccaccaaacactgagtcacgcatacctttcgcctaaaaaagatcccccttcccaaaatcattatataaatactttaaatgccatgagggttttctccgaaactccaccagaaacaaactcccagacttttagattgggcaactaaatgtgttcaattttgcgacataaaattttaaaaggcttttcaagtctggcaaattccagttcaaaaacaggtgctttcagcgtactctgaataacaaggtcaaattcatttttaaattattaaaagaaaaagaaaagcttttcttaaccctccttaggacaacttaagaagggggagaaagaattgctggggtaaaactgtctcggatagggtccctgtttaactcaagagtaaatcctaatcttccgagtgcctgaagtaatggaaggttacaggaagaaaataaaaacaaagaaactgactagggtcatagttaccagaacaaactgcaccgccctaccacctcaagaaaccaactccccctacaccaaaacaaaccttgcccttccccgctccccccaccccctagaaacacacaaagaaactggccgcacgcacaattcgcccacagtcctcacttcccttagtagggcaacagggagccccggaacttccccacggtggtttatcgggcgtcgtcggggctgggtcccctggacttgcgggccacagctcggctggggaggaggtgctcgccgccctcacccgtttctctgaaagcagtaaaatgcctccccgctcctcccagggccctcgggtccccaccttccgtaaatcgtgcttccccctcgggcactccggtgactgccgagagagacgccgagccagcaagtaagaatgctccctggtggatttgttggtaaataagacatctcgcgtcgggaggaaagttcctgcgggggccgctcgccggggcgagggcgagggcagcgggaggtgaaccgcgtcgctcgccgccacctccctcacctgcgccggaacaacgggccccgcgccagcccggcccggcgcctcccgcaggccgcgcctcccgcacgccgcgctgccggggcttgttcctcctcatggctttgccctgacgtaattcaaacatggcaacagttcgacttcaaaggcgaacccacagacctcccagacacaggctcccgggccacgagaaaccggccgagcagtccgggccaagctccccggaaccctcggccgtcgcaacccccgacgccagggctgaagcgccgggcactgccgcctccctcggtcgcccgcccgcacgcccggagcggggaagcacgccgcctccctacgcaccagcatggcacctcgcacaagtagcgccgccaaagtttccccacgagggggctgagggacaaaagcccctcccgaaactcgcccgaacttcgagggcctccgacctgcacggccctacgcccaggcggcggccccgagcgccgggggcccgcacgggcacatgcagccctttgttttctgtccagccgggcgctgcctacgtgcagcatcagggatgtcggagcgtttcgcaggggccggacactggacgatcaccctgggtaggggtccggaccccgcgccccgaagagtccggagcctggccccccgaccctcccctcgggagcaggcccatttaatcaaagttttgcagtgtccttgatgagaaacgcccggagtatccgccccgcacgggcggagagttggcgactttcactctgctttttaaactggcaagacgccatcatcagcaaaccacattgtcctgccggccggacctgcccgacggcggccgcatcccacggctcacgcggggctggacattcggacaaggaccagggtcgcagcccgaagcacgtggtctgtcacgtagagcacaaaaagcagtgccctgcrgagttcactgactcccgcggcgtasacaacgccgccgcctccatctccagccaagttggcttccctggccatcttacagcgcggacggccgcccataaacgggaagccctcgcggtgtcgcccacacctacgctacaggtgaacgcaccgggagcaaaacttcgggctccgaaagcaccccggacaccagaggctcttgggcgcggtccgaagagggcaggcgagtggaagacgggctgtttttaagcgaccgcgtgttgctctcattgtcgcatccgcatccctccggagttgagcaaacaacgccacgccgcgtgcgctccggcagagcccagcactgacccccaaaggccgatttaaagaccctcggccgccagctcggaagcggatggcaacttagtttccgagcgaatggcgtttattgtccaccctagtccgagggctgcagtcaactaaaccacgaggtttcacaacggcgcccgaccctgcccgcgcctcgcgcccacgcggacgcaccgaccccggccgctgcgcggtggccaacgagtcgctttcctctcgggcctttcggccgccgggctcctttccgcgagagaacactgcggcggagaaaagtcattgtcaccttcaacgtggatccctcaactccggcgactcctcaattatgcccaggctccactcacttccccgccccgagactttcggtttgcctcaaataccctccccaattaataaatacacactaaacacgagcgtaccaaagaacctggggtctgaagatcacgaaaacagcgctcccaacaatgccacctccaagacaaaacttcctgtgtgtatgtggaaggacggggggaggtgggtggaggtgaaaagagaaaaaaaaaaacactgaaatcaaagcctcgtgagacagttttgcactagaagcatggtgagagtcactcaccttccaaaagcagccgttccacgcgcaataatgtccccgaggtgcggagtgcacgccaggccagtccccctcaagcgctccctcctcctcaactgccttgtctagaaagatagtctcctgcagttctgcagttgctaccgctggccgggaaggtgtagattccgctttccctctgcgcacgcgcggctcccggcacaaaattctcttgaatcgaacttatttgcatacgggcgcgcgcacgttgcgggctgggagggggagaagtcccggcgaccgcgcgcgctcccgaggcctctattgtccttttaaggggagaagctccgcggcgcgggaaacgcggcggccagagggaaacgggggcggggactgcttactacggcggacgtcacataaacaaacgcccccccccccggctgcaggccgcggcggagagggagaggcgaggtgggaaagggaaaggttagcaactgaggggagggctgcgctgcttggcgtgttttccgcccccgaagttgttaggggcaccattgagcgctgaaaaattgttctgaaagctgcttttgcaaaattctcacacctgtccccactgtcggtgacagaggaggtggtcttgtaagcacccagactgaatttatactaatcccacgtttcctaaattttgtttgaagttaggtttttgaagcttgtaaaaaaaaaatcctctggggccagcaaaggtttagtttttgtgcagttgtaatgagtcgtttaataaagtcccattttaacaccctagccattcgctaactcccgcttgcccttctcaaatagtaacccaacccataacaatccagttttttcctccacttcggccttaagatttcaagtctctccgaattgaatgattgttaatttccgtgggaacagtgccgctttctttaaaagactaggcattggaaagccaataacctagggacaggcatacctcctctagcagcttgtaaagggtgttccactcacccagaaataattccagtaactggtggtcttgggaatggaaaaaataacgagtgacgtacagacttttcaatgcagaatatgtaataattcaacaatctaagcgctttctagactccggaagaaaaaaactgaagtaactcttctcagattgataagaggaaaatgaaaaccgaatgattgattcgcctttgtcccaaggacacacttaacaccaacaggcagaaacccggggttaatgatagagggtggggagagaggaaggatgtttttcccagaaacttgatattggtcccaagttacaaaagtgtgaaaatcaaccataaaacttaatcatctgctgacacgtttcgctgctttcactgcagtgtcaacaatacagatttaaatagttacttctgaaatgttaatttaattcaacaggcaattcctagtacatacagtataaacccacttctgaactcctcaactaatacttctttatttttctttaggttctgtaacatactattcctgtaactgtatatgaaaactatattataaatacctgaaaagatagcctggcgtggtggtgggcacctgtaatcccagctattcgggagcctgaggcaggagaatcgcttgaacctgggaggcggaggttgcagtgagcagagattgcgccactgcaccccagcctgggcgacagagcaagactgtctcaaaacaaaaacaaaaacaaaaacaaaaaacagaaagaaaaaggacacctctcattaaaatatgagctccttaaagacaaggattttatgcctttcttacccatctttgtattccagtgcctgacacagtgcacatcagataatatatactgacatcttgcatgcattagttggctaggaaaatttttttttaatgtaataaacggctgggcacagcgcctcacacctgtaatcctagcactttgggaggccaaggcaggcagatcacatgaggtcaggagttcgagaccagcctggccaacatggtgaaaacctgcctctgctaaaaatataaaaattagccgggcatggtggctcacccctgtaatcccagcactttgggaagccaaggcaagtggatcacctgaggtcaggagttcaagaccagcctggccaacatagtgaaaccctgtctctactaaaaatacaaaaattagtggggcatggtggcactcacctgtaatccctgcaactcgagaggctgagatgtggtggcacatgcctgtaatcctagctactcaggaggctgaggcaggagaattgcctgaacccgagaggcggaggttgcagtgagccaagatcacgccactgcactccagcctggacaatagagcaagactctgtctcaaaaaaaaaaaaaaaatatatatatatatatataataaatatataaattagctgggcattttcgcacagacctgtaattccagctacttgggaggctaaggcacaagaatcacttcaatctgggaggctgaggttgcagtgagccgaaatcgcactactgcactccagcctgggtgacggagtgaaactcttgtctcaaaaaataataataatggccaggcgaagtgcctcacgcctgtaatcacagcactttgggaggccaatgtgggtgaattacctgaggtagggagtttgagagcagcctgaccaacatggagaaaccccgtctctaccaaaaatgcaaaattagccgggcgtggtggcacatgcctataatcctagctacttgggaggctgaggcaggagaatcccttgaatccaggagacagaggttgtggtgagccgagagatcaagccattgcactccagcctgggcaacaagagctaaactctgtctcaaaataataataataataataaatatataaatataattttaaaaaattaatggacattttcaaggttcttacaggtttatcgctaatcagaactttagtttacaatttttgcatttgacctaaaatgagtttggaagttatagtggtcacattggttgatatgccagccctgtccttatgacaataaaaatgaataagcttaatagctgtttctgtgttccactggtggcaaattggaccctaatcataaatttctgccttctttctaaagagaattttaacaattgtcctgggttgtctcaaatatttatttggcttatgacagatcttccaaaaataatttcaaattattatatgcctctgaaggtatgaaaactgcaaatactggccaggcgcggtggcttatgcctgtaatcccagcactttgggaggatgaagcgggtggatcacaaggtcaggagtttgagaccagtctggacagcatggtgaaaccccgtctctactaaaaatacaaaaaattagccgggcatggtggtgcacgcctgtagtcctagctacttgggaggctgaggcaggagaatcgattgaacccaggaggcagaggttgcagtgagctgaaatcacaccactgcactccaacctgggtgacagagcgagactccatctcaaaaaaaaaagaaaagaaaagaaagaaaattgtaaataccataataatattttttaaactccaattatggtttacaggagtatatatatacatatatgtaagtgtgtacacacacacacacgtaccttgaatgctttttctcttgaaagtttatgtaaagaatatttattgtggccggacgcggtggctcctgcctgtaatcccagcattttgggaggtcgaggtgggtggatcacaaggtcaggagtttgagaccagcctggccaatatggtgaaacctcgtctctactaaaaatacaaaaaaattagccgggcatggtggcacgtgcctgtaatcccagctacttgggaggctgaggcaggagaattgcttgaatccgggaggcagaggttgcagtgagccgagatcacgccactgcactccagcctgggtaacagggcaagattccatctcaaaaaaaaaaaaaattttattgtaatacagggatggaataataaacgcaaatgtgcaagcaatgcaggaattacagtacttaggatacaccgttcaggtaaaaaagtacctagaagttgcagagctactgagttaatgtagccagacttcctctgctctcaaagtataggtcaagaagtaatctgggtaagttttttaggaagggtagctacaaaattcttttttaaaattttttattactttttaatttttctttgataatcctattgcaataaacaaaattctcaaagaaaaatcggaattccatagtctttttttttaaagcaaccacctgctatttttgaacaaccaagtgcattccgaaggttcttttgtccagtttgttgcttgaacatgtcattatggatggccctacccaggcccaatagctcatgtatgggttacttttaactactactacctaaattgcccaagtgaatttttcaacgtgaaaaaggaaagaaggaaatacaagaagtaatttataatatatcaatttgtattacaagagattgaattacatcatgctaggaaaatatctgcggattttgttttgttttgtttttgtttgttttttttgagaaggagttttgctcttgttgcccaggctagagtgcaatggcacgatcttggctcaccacaacctccacctcccgggttcaagcgattctcctgcctcagccttccgagtagctgggattacaggcatgagcctgcatgcccggctaattttgtatttttagtagagatggggtttctccatagttggttaggctggtctcaaactcccgacctcaggtaattcacccaccttggcctcccaaagtgctaggattacaggcgtgagccaccacaccctgccctgagtattttttaatgactacaatgctatgttgaactcataagtagttttcaaacattttgaagttgaaagctaactactttcttataatgtatgtctcgctgtagaattatccctaacgcttgaatttttattcctttagcaaacatttaatgatcatcactatgtgccagatagtgaaatcatttcagaacttgaggggctcaagcctctctaattcatttctatataattctattttatttgctcctttttcttccgtagaatgtgttgccttcttttgagatttattgtcagccactttagaatttaatattcttggaatggaggataaattatatataaaggattgtagaagaggacaaatcttgcttgattatgaaggacattgctagcaatttagtcatgtttgtaatgacaaactaatgattgtttttaaaataaaggcagataccctcatcagcggctggtaccaaccacatgaaaacatgtttgccaaacccaggaaagagctgatgattattattaagcatagggtttggttcctctttttctcacaacaaaacaagtacagtgttttaataatttgtttaaatctctttgaagttcaaatagcaagccgtcagagcaaggcagataagtttacactcgaaggtatagcctggattatgccatctaagttaccccaatcctccaacaagtgtcgacagctgccagaaaaagttatttattacttaatcaaaattaacttttcaaatttctggacataaaagcttaaagaattatcaaaaacttattcttagagtatcctgaacttatagaaatcttgttttataatagtatcttatgacatttgaacagcatgattttatttatttatttatatttatatatttatttatttttgagacagagttttgctcttgttgcccaggctggagtgcaatggcatgatcttggctcactgtaagctctgcctcccaggtccaagcgattctcctgcctcagcctcccgagtagctgggactacaggcgcgca

SEQ ID NO: 17845 - DNA, 13816 bp, Homo sapiens
gcatgtactcacttttctctcagaccctgcgggttcgagggctcaggtttttcttttaatgggtcacttttaaaagcagacagtgctcgactgaaagctagaagaccctagaaaaccacagttggtttctgtttctggcttttcactttttccattctgtgctctgttattactgggaggctcacatgagggtacctgtcaggaaagcacctaatatgatagagagagtttacacaattggagcgataatgaaggctgccattacccggggtcccactgttcacatgagtttgttgggcactttctatacatgcccgaaacctgcccactttggacagtgccctgttctgcaggtaaggccctcaaggctcagaagctcagcaacccagggccacaaagtacgggagtaggagggtttgggtttgaccccaggtcttaggctgtgacaattgtgcagtgggccaggtgaccacccctgagtgtgggaatgcaagaacaggtcgataaacctttagggagcccaaaatttattttcttctggcctttaaaccagatttttactcctaacattgaagctttgtttgtttgttttttgtttttgtttttgagatggagttttgctcttgttgcccaggctggagtgcaatggcgccatctcgatcttggctcactgcaacttctgcctcccgggttcaagcaattctcctgcctcagcctcctgagtagctgggattacaggcacctgccaccgtgcccgaataatttttgtatttttagtagagacggggtttcaccatgttggtcaggctggtctctaactcctgacctcaagtgatctgccctctttggtttcccaaagtgttggaattgacaggtgtgagccactgcgcctgcctgaggctttttataatgcactagaaataatgtcagttcaatcatttgtgtgtttcaggtgacaaagttgttgtcacgtactccaaaggttatccgtgtggtggaaataagaccgcatcctccgtgatagaattgacctgtacaaagacggtgggcagacctgcattcaagaggtcaggagactgggggctcagagcgggactgtgcagtgagcatactggagggaattcctccttggggttttcatgggcaggttttggctgagtcttaggagctcagggccagagccgctgattgtgctgtattgggcggggctgctccaggcagggaagacctccagatacagtgctgagacactgttacaagaccagtgcaacttctctgggctagcttgtctcttgaactaggtttagcactggctgagcagtacttaactgacctctacctttgaatgtcatagtagaaacaaaggggcgtggatttgtcccacccgaggtgttcaagcagcctggctgggaccctcgagcagctgggacctgcatctggacctgggatgtgcttggattatattcaagttttcccggccacattgcatctggtgccagggagagcttggccaacagagggtgcatgtgagctgctgtttgtgaacagaactgattccttccagacgctgagtttggaaaaggggtgactcagaaattgccaaaggatttatgaatgtatgagtctgagaagcttaaacaaaaatctaaaaatctaggagcaaattttccaggttttgaatgttgcacggtttacaaattttaaaaaatttatattgaatgcttgcctgctttgtcacattactgatgtgtgcaccacagtcatcttccctgtccattgtggtgatgaaaagaagtgagtaaaataaccaccctcgctccgagctgccgtcagtgttgagtcgggaaattctgcctaggcctgcgcagcccggggagtgggggcctcgggacccaactgaagtctcgcagcaccttgactgaaagccagtgagctgcttcaagggctccgcagtgttcattgttttgcagtcttcccttatgtctggctggggaagtgactgtagcctgtgcttccctcctcctaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttattttaagtaagtaaaacgttttccttctgagctgtgaaatgtgttcaaaattaaaccagcaatgccgctctttccctatcggggagcactgcaggataaataggtctgtgttttagttactgttgctggagtcatcgtcatcttttgcttaaactgaggaaaagcgttactcaatcattaagttttaacaccaaagatggtgaattctcatgagtgtaaaaataaatcccccgtccttctccctctcttcatgataatctcaggggttgaagccgaagccttctgacatgtttgagcaggaatcttctgggcttaccagtgtttagaaaataagtttctcagcagtgttactggggctgctcttgggggtggtggccgaggtgcacagacagggcgagggccgtgtggtgctggatacggcacctgaggaaggtggattagcactcagaggccagaactggttggggagaaagcctcttgagagggaaactggtgtcctcagaattgctgtggggtcacagacgtgctgccctagcgtgtccgtgcttcctttccctaggaaaggaagcatcctggggccctgcagtgattctgaggactgagggtttatgtcatgaatgccttcttgaaggacttccatgtcactgtgatcttttctgtctcttcaggctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccaagtactaccttcaaggtaatccgtggcttcccacaaagttccacatttaacttcctccaaggaaggggattaaaattttcaactaactcccttcagttgaaatctcggaccacttttaaaacaaaaaccatggtctaattctttactttgttatgaatttcttgacagtggattgagcgatacgtgtcagaactaagcatttcactgtaggcaaattgtgtcttagttatcaagtaaatgtacaaaaaaactaaaacctggtctgatccagtggttctgaggttgggtggaggctgagctgtgcacagtcagaattgcctttgatttggttttaaccatgacacttccttattttggaatgccaaataatattagagaagggtaagagattttatatttgtaagaaggatgaaaggaaactggcctaaatgttaggatgtaggttaaaatcaaccaggacgcacatagggcagagtccagggtgtgaaggaaggttttaaactggcactaataagggtgttgccctttgttccctcacataatcgtgaaaggctgcttttgttttgaacagctagtcttaactatatacctttcataatttgatttttgaaccgtgtgtggatgtaataactctttaaaaaaaaatgaagtgtgtttaaagaaaaccccagcctgctctgatgtcaaagagctgccgatcatgtcctctgggaggggagagtagtgatagctgagaaggagcaggtgctctgtgccctggtgctgagcacattgccgagaaggagcaggtgctccgtgccctggtgctgagctcatcgccgagaaggagcaggtgctccgtgccctggtgctgagcgcatcgccgagaaggagcgggtgctctgtgccctggtgctgagcgcatcgctgagaaggagcgggtgctctgtgccctggtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctctgtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacaggttgtgccttctcttgctgtcctctttcccagtgctcggtaaatcttgattaaaggaaggaaggaaggattgtttcagaagccttcaggggccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctggtgggtttacatatgctgctcttggtgctggaatgccttggcccaccttcctcatccttccaaacctacttctagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcagggtgacaccgctggtgtgtctgcaggattccaaacctacctccagtgcccctcctgggaaggcccaccttctcatagcaggtgatactgctggtgtgtctgcaggagtcttcacgctccatcgcgcagcactggccacttgtctggttacacataagacctccacgttcacaagtggtatgtctagcagacctttgaggatccccagctttcagagtgcttgtgcatgcgcatttagtcattcttggtaaataaaatccctttcagaccttttcactttcttcattcaccagccccaggaagtagctttagttttaagacatcttttcatctttcatgaagaaatgaagtttctatctcttcctgaggcttgccattccttcgggagggcagagctgtctctcatcaggacgtggagctgctgggcggtttgcttccccacatcagccctgtggaacagtccattcagcagcccctgcttcagctactcccaagcgagaatgtggggccctcccggagcggagccgcaccgcctgtctctgggccccatctgtgtgtggacatgtccgtctcctaccctgcactctcgcctctgcattcctggcacccagcagcaccagccacaaagattttcagccagtgacaaaggttgggagcagcagagttcatgcaaggagtccacacaagggttcctcacttctgacagcaacagcacactgaaggggttcccaagccaacttcagatttaccctttcaccataactcacagagctccctggaagcagttacacttatagttatgatttactgcagcaaaaagatacaggttaaaatcaaccaagatgcacacagggcagagtccaggagggaattgaatgcagagttcccaccagctctcccgtggaatcagatgtgttgtgttcccagcacccacgtgtggcagtgcacatggagtatcatcagccggaggtgcttccccragccttggtgtccagagtttttcccggggctctgacatgggcaggattggtccattgatcactcaggtactgcatggccagcccctgctccgtatcctgtcattagccaaggagcaaggccagccctctttttgggcaaggttaaattcttgccttccctcttgttgccgttgcttctgttcctggaggagctcctggcacagtgatggggtctcaggcctccaccttactgcacgatgaagagtttgaggagatcaagaaggagactggcttttcccacagtcaaatcacacgyctgtacagccggttcagcarcctggacaaaggagagaacaggacgatttccaggggattccagaacttgccatcaacccagtgggggactggatcatcaatgccttccttccagagggagaggaccaggtaaacttccgtggattcctgcaaactctggctcatttccaaaccattgaggataatgaaaagagcaaagttgtgaatggacctgaaccactcaacagccgaagcaacaaactgcagtttgcttttcgactatatgatttggataaagataacaagatctctcgtgatgagctgttaagggtgctgtgcatgatggtccaaataaatatctcagataagcagctgggcagtatcgcagacaggaccattcaggaggctgatcagcatggggacagtgccatatctttatcacagactttgctaaggttttggagaaggtggatgtagaacagaaaatgagcatctgatttcttcactaaaggacagacagcaaactattccttgcagtctagtatttaagtactggaacttgacagtcctcctgtccaccagccctacctccaccccatcattccccttctcccaaagtactactgctgttgcataacaaccccaaatatgttctgtcaacacaaacctgcttttggtctataaacagggcgttacagaatggtacacccagtctatttcttctcagtatccattcgccagttcttcatttataaatatcgtcttcctctgttctgctgctgaatgccacacatccatccagtctgagaaagtaagatagggaatcctgccgaggaacaagccagcaaagctctttcactggatgtagactgcacctgctgccttccctctggcgagtctgccagcatgcttctccatcctttttatatgtcctttgcttcccacttctgtgtacattcaacatactgttcacgtagtcatgcagtctttctgctttttgtgaagcctcagaatctcctctgttctacttggcaccccaagctatgcctggtattgtatttctgacttggctcgatagttcggtggtctggcagtttttatctaccttcattattaaaaggccctctggagctgggcgtggtggctcacgcctgtaatcccagcactgtgggaggctgaggtgggcagatcacgaggtcaggagatcgagaccatcctggctaacacggtgaaaccccgtctttactaaaaatacaaaaaattagccgggcgtggtggcgggtgcctgtagtcccagctactcgggaggctgaggcaggagaatggcgtgaacctgggaggcagagcttgcagtgagccaagatcgtgccactacactccagcctgggcgacagagcgagactccatctcaaaaaaaaaaaaaaaaaaaggccctctgggatgttgcctctccaggagctttttggtaaccaacacttctctcgggagtatgagatcatcctctgcactcttctctgtcatcaaagggctgctgggtggagatattcttgaaaggtggccttggtgagaggtgtggagtcaagtcttttaggttgcttgcccacgtcactctacctctggcctctgattctcaactttgtacctatggggcgtctcttgttagtgcagtgttgactattcaaaaagtagcaatatgcctgcagatttgcttagtcttgggacacggttaccaccagaacggctgctcagacaatatgcttggggactttctcatggctttttgaacaaggaggctgcgcaccctgtgaagcctcctgcattcacacctctgctgcatggtttatgcctcagtgttatgtgcactggaatgcttttcactatacgtttccaagttagaaagattagtgttatggaagtgcctaatgtatcctagtccaaaatatttaaagattgttctctgtgtcttgaagttttgcacaaaattctttatgaattttacacttggcaaatgttaatgctagaagccatagtccgcttcttatacaagtccaaagcgttgactgttgtatcattagctccctggttacactggtttcccagctccttgtgtagaccactgctaatcccttagaaacaagaggtctggcactagtagcacaacctaaggtggcattccaagtctttaagcaagtcacagcaacttttctgccaaagtcagcttagtttagacttcagtgaatcaggctgttgccatcctaatgtatgtctctgtgagtctgttcattcacatatctgccgttggctgactttcttgactcgctgcttgcttgcttgtttccttgctttggaaagctattgaagatgtgtacataattctttaggaaggggattgctaaaaaatacactgcaaagcgatggaaaacagtggagaacaggggagtagccaggctggatggctcaaatataaatgaatgaggaattctttatgaagtgtcagttggactttgtgattgagtgatgtaatacaggaattatatagaaagggaagaatatctgatactgatctgttagatacttcagaggctccttgatttgcatatttaaagttcctaaaattgtagcttttcccttcttttggctgtacagcagactgttttaatccacggttgtgccttattgttccattaaaattgtgtcttcagtccatcaataaatactcgtggttaaaacaaaacaaaaattctttactgcatgctgactaagggcagggctctatccatgtgcatcgagtggcctcgtaagctgtgaacagagtgcctgtgggacgtgggatgaagtctcttctgcctgattttaagtctttgcaaactttttagaccgtaaggagctaagctcagtctgctcgtgaaaaatgatggtgacatgccatgtgtgcccttcccgtttgacagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctcttggtacacctcagccgtgtgtcctctggggtgagtatgacatccggaagcttagcacttgtaccccacatcttcccttaagaataagtgtatgtgtgttttttccccaatgttttcttgtgaaatattcagaacatgcaccaaaaaatagagaaaatgatagaagcggaccccacatagtcagtgccccgctccgttgcttgtcagcatcctgccactgatttttggtccatggctgcgtcacctcccaccacccccagcagcagtgccattgtttcctttgtgtgtaccatgccccgaatagggtccagtcagggcaccccagctctgtccctctaccctgttcccattgctgcctccctctccttagctcctgggaggcaagtactggtggtgcctcctctgtgtaatcctggaacatcttttgtgtcgtaatacaaatgattgtttggtaaagtttcactttgatttgagtgcagtatttttactttgatttgagtgcagtatttttacgtttgtttgaatgaatgaaaagcttactctccagattttgagaatcagcatgagaacagagggagcagtttctgctctgaaggaaggtggcacctccattggttgtcttgtgtcccacagccgttttatactttgccacgaataacatgttgtcagttgctttcctcttggatttattttcttcttatgttacccccacccatcattgtatttatatttatttttattttttatttttttgggatggactcttgctctgtcactcaggctggagtgcagtggtgcggtcttggctcgttgcaacctctgcctcctggttcagacgattctcctgcctcagcctcccaagtagctgggattgcaggcatgtgtcattatgccctgctaatttttgtatttttggtagagatggggtttcaccatgttgaccaggctggtcttgaactcctcacctcagataatctgcctgccttggcctcccaaagtgctggcattacaagcgtgagctgccatgcccggcctggcccaccattttacataagcttttcattctctgtcctgagactttaagattgggggaacatgaattcttgccatgtaattgtttccttcatgtcctgaaaaagggaccgtagagtcagcagacgacagtggtgggggtcatgggggaatgaagatcacacattttacatcttaaatcagcactccccctgcccacccttaacagtggacatgagctcagcaaaaaccagctttgtcctgtgctgttcaggcctgtgtacttagggatcctcagctgcacagtcagggaaagaggcttttggttgaaatttcacttgtggtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcaccgtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcaggtaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagatagagctgtcttacaccttcctcctactttacaaaaatggttctttcacaatatttgattaaagtcaaaaaatttacacaaagctaaaagacaggcatctacagatggaaggggcaggctatgtgcccagcacagttattgatgacaagacccacccacttatgaaataccaggagagcagatacaaagaaaagactgtaaaagctttaggggaggctaatttgttgtattagaaaataattcaagaaaggttaaaatactttaaatcctcactttatatcatcgataggttcttggaaactgcaactttatgtgaaatgatgtataatgaaaccagttttttttcctcagctttatgttatgttatgttatgttatgttatgttatgttatgttatgttatttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcgaggacctcccatagtcgcttcacggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataagataaaataggatattaaagaaaaatattagggataaagaataaagagggtcattataattttaaaagggctaatttcctaggaagatacaagaatcctaaacttccatctacctaataaaaaagccttgatatgtaaagcagaaattgacaaaaccacacacaagaaacaagcctagtgattgctgggttgagtagacaaagagtaaagctttttttggaagattgagacagcacagtgaaaagcaagatttaatagacatgcgcagaacactgttccctgcgttgggagaacactgtttgcccaagcttacatcaaacacttagaaaactttagcaaaaattaaccacaaagcaggcaagtcagcaatttcctttttttttttttttttttttttttttttggagacagagacttgctcttttgcccaggctggagtgcagtggtgcgatcttggctcactgcaacctctgcttcccagattcaagtgattctcatgcctcagcctcctgagtagctgggattatgggcgtgtgccactacctcc

SEQ ID NO: 17846 - DNA, 17263 bp, Homo sapiens
ttgccctaacttgtcctgtagacaagcaaccacctctctctttattccaagcctgtaaatcagagcatatctgggagggcagctggactctgataagggatgtgatttattttagttacaaataacttggttggcatctctgatatctgtggccaaacctggccaaacctggggagagacaggccagggcagggcagccaagagtccacagcctgccggggatggagagagaagccacccatgcaagagttcacttatgctggccacaggggacaggtagtgtgggagagccacgtatagcttccaaagtcctccagacacataatgaattgaaggagcataagcattggagtctaacatgggaggatgttagataatgcggaaatcccaactccaccactggatcctggggcaagtcatgccatctccacaagtctcgatctctttatctagaaaatggagttaaagagagtgctaggtgtattgggctgttgggaggcttagataagatatcctgtgctacccccggcttcacatctagtatagagtcagtgctcactgagcagtatttcctagagactcaggacttaggaccctgctttacacaggaccatatggtaccacagcagagcatcaggtttttaaaactttggtgctcctgaccatctagcgatgttccaggaggtgctagaagccccaggacaatacagagaatcattgtcgaacaccaacattgctatatggtcaaaaatatatatcattattattgtattaaactcaaattgggtatattgtagagtaatatataaaactgtaatgagtctgtaaggtagtatttaaggtgtgaaacaaatgttgttaccccagtagaccacaccctccccacccactgcagggggtggggttgaggctcccacagtcctcatgatagagatacatgagagaaatgccctgccctaatatcttaacaagtcgcagagaggggaagtcactagtccctctctttcagattttctaaatgatccttagagttcccatctctgagtctatgacaatgagtcaggaaatagttcctgaatgaatggaagggaatctgtcatgaactaagaatttcatgctgtccagcatcccctcctttgtggggaaatttgggaaaaaacaaatggaacattttcctactggctgccagcctcccacacaaggacttgtcaccatgcctttgcagcaagtagatgtccaatgtgtaaatggggaatacctgaattagttgatgctagccccaacagagatgaagctttgcctctttgctccttcacatgggaaaacacagctaaagttctaactcccagcagggggcggagtctctaatgctcaattagagagaagggagcagaaaggtgtgtgccagccctaagacccagggctctcagacgctctcctctttctcaacaccaggcatgcaattcccaagcaaagatcccctcacccagtctatcattgttggacatttgggttggttccaagtctttgctattgtgaataatgccacaataaacatacatgtgcatgtgtctttatagcagcatgatttgtagtcctttgggtatatacccagtaatgggatggctgggtcaaatggtatttctagttctagatccctgaggaatcgccacactgacttccacaatggttgaaccctaaaacttaaagtataataataattaaaaaaaaagatcccctcacccacagagacaaggagatgcatgtgcatgaaggactcatcccccctggcctccaccaagggccactttcttcctcctgcacaagaccccgaattcaagatatctgttccccaactcagagtttctgggtccaatgtcacttaactacatttggccatttctccactttttgctttcccatacaaagactggactcctcctcaaagccttgctcctttccaaagtttcctcgtggttgtccagagtccaccactccccagaatggggcaacaagagctcctttccttcccctttcctccttctccccttcgccacccacaccatgcccagccccaagccctctgacaaagtcatgtctcctttccaagtcccagttcctgccaaacaactttacaagcacatgaaagcgagggccggggcagttattgctactggcacttcattgtacttcctctaaatgatgctgcgcaaaggggccgtggaaacacggggcaggagggagactgcgggtctctgggagaacctcaagggttaggacagtgccaaatatttggaagtggggccttttagaaggaacggggagacaggttggaaggagtcaggagtcagaatgcccaaagacaaagcagaagatggcactggtaggtaacatacaaataaacttccctagagactatagggaaaccaccagggccctcttctttcaggccaggcccagggctctccctgatctccagcttgactcttctctcccatcctgaatgtttccacttttcaagggcttatttgagctccagtcccttttggaactttccctaaggcctagagtccaccaaaatccttccctccctgaaatccttccaagttcgtccatcttatacagtctaacatattctaagcctaggctttggagctcagtggagctgggtttccatccagcactgctcctggctatgtgaatgccagcaagtcacttaacgtctctaagcatcagttttcctcctgtcaaacaggcctgataacaggaagcttcttactaggccattgtgagggtagaatgagataacacatggaaaatatttaacataatgcctggcacagtgaaaatatacagtaaatggtagctagcactgtattcatttttttttttttaacagagtcacgctttgtcacccaggctggagtgcaatggcataatcttggttcactgcaaccttcacctcctaggttcaagcaattctcctgcctcagcgtcccaagcagctgggactacaggtgtgcaccaccacaccctgctaatttttgtattttttgtaaagatggggtttcaccatgttggccaaggctggtctcaaactcctgaccttgggtaatttgctgcctcagcctcccaaagtcctaggattacaggcatgggccaccatgacaggctgtgttgttgctatcattattattattatttcagcttcagtagtataaatcctagatccccaaatccccacctagcaaagacctctcactcacacagaaagggagatgcatatgcacagagaactcatcctgcctagcctccacctagggtcactttcttcctactgcagaaagtaggaagatagagaaagcagaaagtaattcaagatactttatactgggtactcaatctaaactacctgggtgagactgtgtgtttcaatttctcagtactcccgtggaactgggttaataaatatttgctgagtagaatttactgcatgcaggctgagctgtcttaatgacccagctggcacttcttaaaagaaagattaattttggccagcgataagcaaatcggccatgtaattatctgtacatacatagacaaagaaagagaatgcttggagttgagccgtgctagaatataccttacacgcagcccctcccctccatagccaccacaaagcactgaccctgtttggatgagatattggagccctagctccagggtccctgatgttgccctggtatcaaggctcttctctctgctctgaggctgccaggcagggaatatgagccaccttactgttgagatttccccacactgattggcagaagcaggaggtggtgaggaccaagcagctggtccagtggttgcctctcatattcatgctccctatcccaggctggaatctcatggagacccaagacctcaccgcagagctggttcaagcttccacagcgctaaggtggcagtgacactgcggactgtaagctttggaacaaggctcagtggggagctgggagaacccaggacccctttctggaaaacccattgccagctagtctcacacttggaattgtgatcccttctgtgaccaccttgataacagccactcgccctgttccagccccagtctctgccccgcccagctctgccctgcctagacacagcccggtggggcttggcgagcccttgggcacaggagcctgttagtccagacaacgactgtgcgcatccgggagaacggttactttctgccatgtgctgcagctctagcgacctcgcccaaaactgcgcgccggcagcctgcccaacaaactttcttctctttctctttttctttcaaccaaatggtgcttccacagacacattctccaacggtttagcgcaaatcccagccctgctttccggagcccaatgcacttcgcagacagctcacttgactccagtcccccagggccgactcagccggaggggctgccgccgggtccgcgctgagcaccccgcacccatcttgctgcccaggctgcggcgggcactcaccgatctgcgccaggctcagcggcacgaggcagagtccccaggctgcgtgccaccaaaacttgtccatggtgtccggagcgaacggagggcgcgggcgaaaggagctggaggatccctgggcgcggggcaggggccggcggaggacgggacgaggatggcggaccgaacctggcagaggctggggtccgctgggcaatgaggctgcctcggaagttggctgcagtttttattcgaggttgaaaacagtgacctaagacggagggagggagcgagcgaaggacacacccaagcaaggggggctgtgactaagcagcccgcagaggttttaagaagtagcagccctcccgggcgggcccctctgcccccgccccgtgctctgctgaggctgtaaataatcggggctgccagggacgtgggtcggggaacctggagtgtcgcggggtgcctgtgcctccgagccccactggcccctgcgcccagagacgcactggctttcttctcccgctggccccgcggcgtcaggacagaggatgaccgaaccgtaaaaccttgcaccattgggttcagcctttggcctctcctttcccgctaaatttctctgaatccggctggagcaagatctctgggtttcacaggatgttggatatcctgggagaggagctggagagagggcgaggtcttgccctgggtggcgcagtgcctccgtgcccacagtggggagtgaggggtggggagttggtgaatcttccaagtggaaagagggagagctcattctttttcccctcaataacaagtccacatggcttgaatgaattttagcttcttggcagaacagctcagggaaagctactgatggcctgtcatagggctggcatttggctcagctaacccatgtgttcaagccagtgtgaatgggcacctctctccacacacatgctcattcatcctcctaaatatccttccatccgcccatccatctatccacccatctttccttatgtccttctggggctctcacatccatccatcctcctgtccatccactaaccacttaggtccatctatcatcccactcattcattcatccaaccacacaccttttaatttattcaaccacctattcttctattcatcttcccatacaacttctcatccatcattccacacttcctttttcacatctcttcataaaaccacaaccatccaccatcctcttctccacccatccacccacatatctgtttattgatatatccactcatttcccatctgtccaagatcaacatatccacctatcattttatccattctctcatccacccatacgttcatctattatttttgcccccattatcctcctttctgtgtaaacattaattcattttctcccatctttcctacccagcagatcttaaagagaggaagagtttgtaatattcttcaggggaagccttttgagattgaaatatcatactttgaatgataactctatatctatctataatatactatggtttaatgtttggaaatcaaacgcagtatttatttgtcatgtgaactactaaaagtaaatctgcatggacttcttgcctggtgagttacacagaaaatgaaagtgattatcagtggctgtggcaagatgaaaggaaccaygccaggacttctgagggaaggtaagattttgttatttatttcaagaaattgaaaagttgagagaaatgcacccagccatccccctatgcattcattcatcagacatgtaatgagtgttgtggggtatcgaggtaaataagacctggcgctatcttcagagccctcaccctctggtacggaataaaactcacaagcaggccattaccatgcaaggtgaaatatgctgcaaaatgtgtgtgtttggggtgctaccattcctagagaagggagtcacactctctcctggagaacaccaggcagtcttcacaggggaagtgatatttgaggcaggcctcaaaggaaaaggaggaggaattcttcagatgaaactacagggacaagtaagtcatccacaggcagtacagtgtagtgacgaacagcatggattcaggagctagaacacctagatccaaaccctattatggctgcttcttagttgtgtgaccttgcctaaggcaattagctcaatttgctcaagtataaaatgggcttaataatagtatctattattactattacaattctattacttcatagaattggtgaggattaaatgactcaaaagccctgcatgtattaagccgtagatttatgtctacatatgcatgcagtaagcactttaaataagtgtttgctatcattactaaaagcaaaattgtgtttgagcatagaaaagtgaaagaacatggcttgtccagagaatagagagcaatgtgagctgatctgaacatagatcagatgaaggggctgggggaagatagcagacatgaggttacaggtatggggactacaaggtgtaagctatgccagggagtttgaacttgrccctgtaggaaataaggaggcaacgtacttagttaaaattattatcattgttatgttaaaatatgcataacataaaatttaccatttcacccatttaaaagtgtttatagcagtgacgtgtagtactttaacaatattgtgcaaccactaccactgtctagtccggtataaatttttcagttgtggagattctgtttgactaaagactactcctcttgcattttcaggaagagtgtttgggactgaaaaatccttgtctggatctagtcctcagccactcagaagctggcatgccatgactcaaagagcyrcccgtctggaatgaagacagtgacccgtaactcccacctgaagagcaggtgcttggaaaatgctgccagtccgcaggaaaaagttgttactgctgctgtctgtgaccaagaggacactttatttcttgaaacaactgggggcaaactggctcycagataaggcttcagtccctactcatgtgaggaaaccagccctggtaggttccatgcacaagaatacaggacaaggagcagcttttttcacctcatgcaacctccagggatttcagcttccttttcttggagcaagaaagtgaagtgacgtggggagtcactaggaacaatgtctgtcttactgtgtttcatggaacctggaggttccttagagacccctcagaagcagacctagtggtcagagtaaaagctgaggagtaagctgtgcctctccctccccaggmcccatcccaaccacagaagttccacttgcatcagttttatataccagactattgcatgaaattacattttgacagatgattattcttaaaaaatatataaaaaccaacaaactaggccatatcaagtcctggtcccttctccattagtgcagtaaacaattccaccaaggaaaatataggtgtgaaagtgctttgcaaactgtagaagggcatgcaaattctaggggctgtaattaggattattctccccagaagcggggattattttgtttgcttgcttcccgatagtttggtgagggactgaggtcatttgcccccataccacaaatgactcatttcaaataacagacctggtgacttactgagtcaaggtccacctttgggaattcctggatcacctctttgagctcccctctcatccactttccattctaaagacaccctgcccacaccactggtcacacaaacccttcccaaactcttagatgcttgatatctgttgtgtgttgcaccatctttctttctaagccaaaccatgggatgtgggaaactggaaaggaaacttgaattgatttgagttgacacgagattacactatttgggaagaatccagaattcaatcagcagccttggaccragaaagtccaggtctgagcattggctttcccccttatcagaggatgacttaacctctgggagtttcggtaatcccagccacaaaacaagggtaatcagacctttcccatagtttattatgagtagtcagtgaaagaagacatcaagaccatttcctggtgtgcctgcctcatggtgggactcaatgacctctaagctacctgagaacagggacatgtccttctggggtgccagcacatactcagctctcagtccctaacatatacactgtgctccataaataagcattacataaatgtatgagggactgttattttttttccctcccatcaaagcgcataggggtgtttcaggaatcacatgaactggtgggaggaaacacatagacaacttgacagtttctaaataaatgcaagcagtgacatcctatttggggtgactggttcagggagacttgagtgcaaacagagcattactcactctggcagactagggttctttgctgaaatattggggmctgatggcttctgactggtagtaataaatcctgttcctctcgagcaaagaaaagccaaatctaaaccaaatgtgagcaggagtgtgaaatggaaagctgggagatcttgggctgaatcatggaattcaaggattacaaatgcagcaggtcacagactcttttaaagggacaatatttaattatttcacgggacagcttcccagaaaaggaatgatctggcacagtaaagaaaaaatgacattccagttaaaccttaactcttaaaaaaattcatccttagttcatattcacagtgtgaattctacacatataaatgagcagtggtgaaaaaagctcttgcgaaataattattagtaaagtctaaataaaccagtagctgggaagcaatcttcatgaaaaataaataacctctaaggattagtctcaagctaaccaaatgtgattatagagctgagcctttaggattaataaggctttcaaattatggtaaataaagaaattggtgtggctgctgcaccctggaagtcccaaggggagagatgcaactggattttttagatagatccatgttagccacaaaatgggttttacgcagacctttggaggttaaaatagtatgcagataggacaattcctagacttggatgataacaaacttagaaatgtgaatttttgacgatgaaatttgaattaatggtatgtggctttatgtagcaagctaactggaaggaacacaagcaaaacagtctatattttatgcactattayttaagggaatgtaattatatttatttttaattatatttattttatgttcatgtagtaactaaaattcatatttattcctcttctctccacttcatacaaagtggttaaacatctattggaaggctttaggaatctgttttgatgaacatttaagcatgatttgttttggacatatccatggttggtatgtaaatggtaactaagagccttgtaattatctaaaaattgcttgttctctgcactcatttactatgtgactactatgtgctgagaacaatttatacattcttggttctgtcataattaatcatcaccactccttcactgccactattgccatcatcaccactaccacctccaccatcaccactgccactatcatcaccacgatcatcaccaccaccactaccattatccaccatcaccactagagttattactaccatcactacaaccaacattatcttcaacatcatagctaatagccagtactttctacatgtcaagcctaatgtcatttaattgtcacaacaatcctatgaaaagttaatttctattttacagataaggaaacaaagtcttagagaggttacaaaacttgtccaaagtcacatttttatttcacttagcaaatctttcctggctttaagagatatggggatagaaaagtttaatccctttttgattcttgatgtagcaaaaatgctaaattaatggagtcctaattcatyagtctttactaaattttattctgaatcatggaaatcagtttcttttaagaaggaagatttcctttggaagcttttgttggagtggaggaggtgaaaagagtattgctaaggtagagaatggagaatgttgactctcacagccctctgacaaattagaatcctagaataagacaactttaaatgtgtagactcggacygtggctattcaatggacaattttagatttgcataggactatgccttgattccttagagtatcattgtgagatggttgtatattctgactagaaataacaccattttctctttrcagcacctgagartttattcagtgacgataatactcacaagaccctttttggatttgtggcccamcccacaagttatagttccttctctgaatatttcatccagattgtgaagagcagcttctggcagccacagttgtactatgtgacccctacttcccatgcccaggactgattcgaccccgtagtagacacctaaagcaatcctgatcagtcagagtctttgttcctgacatttgggattagagcatggctgaaggtttaagacacaaacttggaagctgtggggcagcaatacacctccatgaggacagagaagcaggggaaataagaataaaccagaagctcacagaaacgcaggaaatacttctagagttctaacacttttcgggtttcttgttctagtccattcttgacacacttgtgcctcacagaagccaatggcaagaatgcagtcagatccttccaataaattccttttattctgtttacattagcataagctggtttccgttgcaaccaaaaagacttgatgaatataggagagcatcacaccattttacaaaagagtaaacagtggctcaagtggatggcggatgcccctaccactgggtcttgaattcaggactttgactctaaatcttaggtcttctgattctgaggtctgtgctcttttcaccagttggcctcacctataatccctccccacatcatcccattctacccaaagaatacagttctctctccttcgttgtgatagaaactagacatctctgatactttgcctacagttgtatgtcaatccaaatgagtggcaggtcttccgagtcccatcctcccagatcttctccagagagcccctgtctgcctgaacatgcctcacagtctattttcaaagggcaaaacctttcatctggcagatggtaacagctgcttctctttaaaacacccaaagggtagaaattctgggctctaacgtacaggcataaggctcctgccaagtcctgactgggcttagcatcaaatcctgtagaaaaggaataggtacagaacatggatgtgaggccaggccaaaacgcattttattgctggctactgtttcccagccacagaagaatgctgctgtagaaggcatggcgtgggtgagaaagagacttgttgaactgaactttaatgggagaggatgtggggagggtgggctagggagagagaaaggaagagacgtcttgagagagcttatgaaggtgaaagaaggcaaaagacacagatgtgactccatgatgaagcaatggaaaataaaagtcttttaatcatccaatgggaatttaatggacaccttctgtatgcactacatggattcgccacagaggacaagccacagatgaggaggacctgccctctctcttcagagactatgatctagatcagagttggcagatcagttgccttcattagtttaagaactattttgtatgcacctctatattccaggcactactctaaattccaaaaatacaacagcacaaaaagacagactggcattttattatcatcgaggaagtgggtggagggtgcaggcaattttaataaggtagactaggaaggtctgggtgaagaggtaacatttcaggcaaatttacatgaaaaaaaaagtgcaaagcaaatgtaaaggctttgagattggagtatttttagtgtgtttgaggaaccaaaaaggttaatgtggatggagcagagtgaatgagaaagcaagtagtaggaaatgagattgaagaggaaggtaaagccagctcttgtgcacccttgcaggccccagtaagaagtttggattttatgccgagtggaatggaatgactttagtgggtttcccctaattttcacctctaatcaattaataatgactgcttagttcactgtgatgagaaagattctgaggctttacagttcaatggataaaagtccattgatggattaataatatacatcatgtctgtagcatgaggcagtggtaacactgatgattaatatttgacatctctgatcatgatggaagattaaattgtatttgtcaaagtactctgagttgtgctgcagtaacaacataagcaaagtctcattggtttcacacaatcacccaggtgacttcttgccatgctaagttggctgtgggttcaggaaactctctaaaacaactgtcttccatgcagttgctcactgatcttgtgctacctctgtctcgtaacacaattgctgcagcagggaaaaagaatagtagaaggcctcatgccagtgattaaatgctttgtctcagaaataatagatgtcacttcttttcccagcccattagctagagttagtcacatgatcccacctaagtgcaagatgactggggaagggtaatccttccatttgcctaaaggtagataagaacccaatgtgagtaagcagtaaaaatctagcatataaatcgaccttagaacaagtccagtaatactctaaggaagcttgtaatgcactgggtaaggagtagtaaataataaagaaattcagaggccaggtgtggtggcttatgcctgtaatctcagcactttggcaggttgaggcaggcagatcatgaggtcaggagatggagaccatcctggctaacacggtgaaaccccgtctctactaaaaatacaaaaaaaattagctgggcatggtggtgggtgcctgtagtcccagctactcaggaggctgaggtaggagaatggtgtaaacccaggaggcggagcttgcagtgagcagagatagcaccactgcactccagcctgggcaacagtgcaagactctgactcaaaaaaaaaaagagaaaaaaagaaattcagagtggtgataccaacatgtgtagctcaaaaagtctctatagagaggaagggtactcgggccagatcttgatggatgagcagcgtcctgttactcaatcctcaccatctgatgcccaataaacgccccactttccctggctcaatcccatccactattctgcaagtcactttaactgactctttagtcttattattttggatgtaagatgatatgctgttgaagagcattgtttatttgctgtggaattttgggcactgtactcaacctctttgagcttaagatccccatttaatgcttgatataattatcatgaaaattaaagtatataatgtaatcatgcatctattcaacttatcgaagagtttagaatatggcagggtctaaaaaacagtcattgttattattgactcacccttccttaaaattatattttcccttgtctttatagatacagctatagcctatctttcattctgcctttcagattaatttatctttctgtgttttgggtccaatttcagctacgaggtaaaacggcttaaacacatacacatttatcctgtggttacctaatacttgtaagggtttctggttagataggatggtgaagagggataaacaattcaggctgatagagactctccaattttcttttttttttcttttttttctttttttttttgagacggagtctgagtctggctctgtcgcccaggctggagtgcagtggtacaatctcggctcactgcaagctccgcctcccaggttcatgccattctcctgcctcagcctcctgagtagctgggactacaggcacctgacactacgccgggctaattttttgtatttttagtacagacggggtttcaccgtgttagccaggatggtctcgatctcctgacctcgtgatccgcccgcctcggcctcccaaagtgctgcaatacaggcgtgagccaccgtgcccggccaaactctgcaattttcaatacatgacttccgagttcactgaggtcacttccattcagttggtggaaggaaaaagagtatggaggagaattgtttgtgaggtttttatgggctagacctgatagtgggaccctcacttccatccacattccattggccagaacccagtcgcgttgcctcacctaactgcaaggaaagctggaaaggttatgtggtccagttgtgagtccagaggaaagagaagaacgtggagttcaggaagctgttgtctttgctacacttctctctccatcccttgctcctcctctgagtcttttcccctgtttcttcttctaatggggggttgtgcatgttgatgtcttggtctgtactcatttcttcacttatttcctaggtccactgcacctgtcacaccacaaacaatgataaaaacggagacacctgggtgagcctcactcactgcgcatgcctccatcttcgaagagctcctgttcactgtactctgaaatagactgtgcaaaacattaaaactgaccaaatcaataaggtcttgttttcaacatctctatgtttatctatgaataggaaagggactgacgtgaggtgggaccattggtgattttgttctgaaataagtgaaagtttaatggaaagatacatatggcacaaaaggaagataaaattttttttcttttagaaaaaaagaaaaaaaaacacctctttttcttttctttttgagttggagtttcgctcttgttgcccaggctggagtgcaatggcgtgatcttggctcaccgcaacctccacctcctgggttcaagcgattttcctgcctcagcctcctgagtagctgagattacagacatgcaccaccacgcctggctaattttttgtatttttagtagagacagggtttctccattttggtcaggctggtctcaaactcccaacctcaggagatctgccagcctcggcttcccgaagtgctgggattacaggcatgagcaaccgcgtccggccaaaaacaacctttaattatggaaaatttcaatcataaatacatacaggtaaagagaaaattataatgaatttccacacagccattacccagcttctacaattatccactcatagcccttgttatctgtctgtacctcctacctcctccccaactgctggattattttgaaacaaattccaaacatcatatacacttatctgtaaatattcagtatgtatctctaaaagataagggcttttaaacccttatttaaccacaatactattattacattattggtaattttaaactctttctactagtggctttgtacatgtattataaaaatatgtatattacttttgaattgagcaatattattttaaaaacattaagattcagtaaacatcacacacacacacacacacacacacacacacatgttgagtggctctgagatcacctctatggaaacacccttgtcctgaggacagttttcaacacatgctaggtggactcgatacatctgcattagaagtgaaaaggaagcctctcatgctcacactagtcctgtgggaaatgggggctggggatctggcccaatcttacacccagcccacagcacaagcatagtgagtggtcccaacaggggactctgaatgacactgacaaagacgagaaagcaggaggcaaggcaccctatggtgtccttcagagaaggtccttctggcccctcgtctgccagccagctgatgccccaaagtctaccatctgagcatttaaagtctgatcagtccctttgcctttgggtcaatgagtttagatgatctttcctccccaggatgtttgacccagggtcgtagatgtgggtgagggcatgagaactctgagcactcagaaaaaaaaacaagggaaaacccagaaacacccagctggctttagccccagttatgcctaagtctgactttctcagaagtaaccaatgtcctctgtcccagtccagatggagctataccaatggtggttgctggtactctccaagtcattgcttgcccttgttcatggatggaaaacttcctccattctcacctagtgttgtgggtcaggggacatccagcatgggggagtcatgtctccacagacaaaccaaccaacaacaacatttccgttgcttcgcccaatggagaagccgcccctcatccagtgaacagtgcctgctccccaaatcattgcattcaacaggtgcctcctgctttctccaggatgcagaagaatgatgacgattctaccaatttcccagatatttttaacctttctcaacctccccatcctttttgtcttcttttaatttctgtttttctcccactttttctccccttctctttttctctgtcctcctcactttctcattttgcatcctctccttattttcccttcattcctatctcttgccctagttcccctcccaccagtcaaatatatgactgttttggggagttttttggtttaatttcactctttcttccccaccttggtcttgctgctgcctgccacctcctcagactgggtttgtccctttttcttcccccacccacagagtgtcagctcctagtggcctgattcagaccttttatattaggttggtgcaaaagtaattgcagtttt

SEQ ID NO: 17847 - DNA, 14805 bp, Homo sapiens
ccatcgtggggagcggccccaccgctgtcccgagtgtggtcgggccttcatgcgccgcacggcgctgacttctcacctgcgcgttcacactggcgagaagccctaccgctgcccgcagtgtggccgctgcttcggcctgaagaccggcatggccaagcaccaatgggtccatcggcccgggggcgaggggcgtaggggccggcgccctggggggctgtctgtgaccctgactcctgtccgcggggacctggacccgcctgtgggcttccagctgtatccagagatattccaggaatgtgggtgacggcctaaaaagtgaccatctagacattgtgggcggcccgagatgggctcaggggcccgaacctctgcagcggcctgcagggaggtcccagaatccaccgcaagagctggcctggggtgcggacagtctgatcttgggctctcagcagcctcttctgccagcaccttgctccccgctgccctgggctctccaaggccccctttgctgaggcagggctgaggtgagaaccccccagacctccatacagggaagcaaaagctgtttctcctcccagagatgctaagaggattgaggtagagaagaaccttgttttctctgttgtctttttctttttacttttttaattttttgagacggagttttgctcttgttgcccaggctggagtgcaatggtgcgatctcgactcactgcaacttccacctcctggagtcaagcgattctcctgcctcagccacccaagtagctggaattacaggcacctgccactatgcccggctaactttttgtatttttagtagagatggggtttcaccatgttggctaggctggtctcgaactcctgccctcaggtgatccacccacctctgcctcccaaagtgctgggattacaggcgtgagccacctcacctggccttttcttttttattctttgaccttcccacaagacaatacccattgtctgttttttttgtttatttatttacttattaagacagcatcttgctcctcacccaggctggaatgcagtggtgtgaactgggctcactgcagcctagacctgctgggctcaaggaatcctcctgccccagcctctcagatggctgtgactacaggtgggcaacactatgcctggctaatttttaaatttttttgcagagatggggttcccactatgttgatcaggctggtctcaaactcctcggttcaagcaattcgcccaccttggcctcccaaagtgctgggattacaggggagccactgcactggccttcattgtctttttgctgcacaacctaaaaaaccagtgaccctgtattggatctcgcctgcagttgctgtattgatttgggcccaggcagtgtttttaagtgataagaattagtgatgaagatctaaagggatattttgcaccaaaatccaggtttctggcatctcttgaaaaatccaaagatttcgcaagttcacctaggctctcagaaagtcgcagttgttgggagttgggccggagccagaactcccaacttactgtggtccggccactcatcccatcagctcctgaccaagcatgagtagccattcatcatggcttgcttttagtgtttttggtgtttatcttaaagtacagcaaagaagaaagggaagtatttcttgaacccatgtctgtgtcaaaacagtccttgcatctttcctgtctttaggtacgcaccatctttgctgtctttaagtatgtgccatcatgggcagagggggctaggccaggaacacctggtgttagatttgtagccagtggcaaccgtacccatctgtatccccaagttctacacggaatccctccagcacttcacgactccattatccagctaccactaattcctttgtgggcagagtccagccacgggcagcccctgccctgcctctggtcaggacaacacctgcccaaggagagcaagggcctgtgacctctgctggcctgtgcgccctcacctgtcacccagctcagccctgtgtctggcctacccagggaggaaggaaccagatttatcagcctgaaaggaggtagaagttttggagaaaagacactgttcgggtgtcaagtaatgaactgactttattcgaacctcatctccaatccaatcccaccgtggtctctctctccctcagcttttctggggcgggttgactcgtgtgtcactttatcacaggggcacatggggtgagaagaggaaccttggcagtaggagatacctttgtaccaggttttaatttccagtgtacatctcagtcccctcccctaaccctcaacacagcctggggaaagcccagcttgcaacaccagttctcagcccagactgacagccagatagatcttggccctgagtttgccaattaaagatgccgtgattattacctagaggtctctgagagctttgaagtttgtaaagtttacttatggcccagaaaccaggctccaactcctctgcttcctgccctcatgacccaaccttccagcatttcgtcaattttttttagtgtcgtgaaacccttaagccttagccccaccccattctcagctcctcagttggtggcacagatatttccacctagaggtagggccaggctaagtatcttttaaaaatgtagctattctcggccgggcgtggtggctcacacctgtaatcccagcattttgggaggctgaggcgggcggatcgcaaggtcaggagaccgagaccatcctggctaacatggtgaaaccccgtctctactaaggatacattttaaaaaaattagcctgacatggtggcacgtgcctatagtcccagctactcaggagggtgaggcaggagaatcgcttgaactcaggaggcagaggttgcactgagcagagatagcaccactgcactccagcctgggtgacagagcgagactctgtctcaaaaaaaaaaaaaaaaaaaactagctactccctgggcccagttcctcatctattgaatcagaatctccagggatagaattttatggctgtgaaagtttgagagaaccacggctgggaacaaaacattattttcaaactgctcttagttttgcaagagtagtggttggtcccagggcctgtccccaatgtcaggcatacacaaagacctccatttctttgttctttccaaagggccctgtgccgtggctgctgtcttcctgggtacttaggatcatgttcaatacactggggcatctcctctagcatcggatggaagggctttaagagggcttgtcctttgcatgagggaagggagcagtgcatacggaagctcctctcactgagaacgtctgtgaaggctctctggcctgcagtgttggccaggttggctgaccataagccttggctgcacactgaatggctctgccctagtgctgggcatgccaggagataatgctgtgaacaaagtgaccacctgactcaggacatgcacagggctcatcctcatggatgcagaggcaggacaatgccagtggactccccaagtttctcctgccttggattagctggtgttgggtcaagatgcagcccttatcagaggctttcctgggcttggagcctctcactgctgtggctgtgtgtcaggtggaggctggcttccttgtgaagtccctgtgcatagatggcaccctggtcctagaggaggctggctggaagtgagccactcttactccaggtgccagtgaggctgaatttgcacttggaaatgcgggtgcctgggcagcatgaagtcttggcccagcttctgctacacctgggacttgtggctcatgataagagtgcaggcagtgtacggtgtcagagctgtggctggaggtctcgccacccatttttagggtgtggctgctctcctgtgtgaattttggtggatcagcaagttggatgtcagagaaaagtgtcttgtgaaggagacttgtttcctacctgtgtgagtgctttggggatgaccagagggtaccccatgtccagctcttcccaaaactggtcctcttgtaggctgtttgactgtgggctctagtgctggaccatgtaagccattcttagcaaaggtttcaagacaaacatacattgggatgggagagagctatggggctggaagctgtttctctggagggcagaaagttttccccgcttcattcgtggcataagctcttgtgattttatttgtaagcctttattattattatttgagacggagtcttgctctgtcacccagactagagtgcagtggcgagatctcggcttactgcaacctccgcctcccgggttcaagtgattctcctgcctcagcctcccaagtagctgggattacaggtgcccaccaccgtgcctggctaatttttgtatttttttagtagagacggggtttcaccatcttggccaggctggtcttgaactcctgacctcgtgatccacctgccttggcctcccaaaagtgctgggattacagacatgagccagtgcgccccacctgtaagcctttatttagatagtttctctccactttttaccacttggcattcttcaagttcttgttctcacctcttttcaggaaggagaggccatccttcctcccaaacattctcttcccttcatttgtctgggtaggcgacaagaaaacacgatccatggctcctgctcacacaggggcatcgggctcgttaactgtcaagaacgctgccaaacttgtttcagcacgaagcgtagaaaaaaaagacaagaactggatgatattaagttgtctgtccaggctcacttcctcaattcaaagctgcgcccgaggcagtgtttctcaggttcccttcctctgcaagactccattcgagtcagacaagactggagagttgttagatgcctcgaaggccagatggttctctcagtccaattctcctttgtatcaccctcacctggaaggaatcctgcctccctgtgaggaaatctaacaacagggactaaggctgccagggattgagttaaactcaggcgctggggaaggtggaggggagaggcaaggggtgtgaggctgacgaggaggaagggtgtctgtcctcagatcttctggctttcataaaacataatggaggctaagtgggggcgggaaaagttttgatggcacaggccgggctggaggggagatgcctggcacctccctcccactacctcctgaaggcgcttctggccgacaggggaggcggacccgaccacagcactcccggccaatcaggaaggcgcctggcgttccctggcgaccattaacgcccagccgtccgcggggttggaggaggcggggcggctagagcacgagccccatcggccaaccgccgggcttcctggggcggagaagctgtgcctctgggagccggggcggggctgtctccttggcaactatcctagccctcgaggagggaggagggaggaggaggatcaggggagccgagctgggtgggggccggaggaacgggagcgggcgcgcgcaggtgccggggagcggagttcctggagggggtcccaggctcaaggacctcggcgaggccaaggggagtccgtcccggttcccgaggcgctgccggagctgacccggaggcccgggaggggagggagcgagacaccgcccccgctggcgccgggaagcgtcgctccttctcgctgaccttggtctcgcttgtcgcctcgcccttggccacacgcaccgacgacgcggggcccgggagatggacagacgggcctctggagggacggagacctagaacataggcacacacactgccccggtagccccgcgggctccggggcgtccggtcctcacccaccccgtggccgggcccctccagcccagggttaatgccaacgagtttccacctccagcggctcctagagaggccgcggcgcgagccggcggggggacctggccgcggacggacacttcctgtgcgggggagggtgggggggtgctgggcggccgttggacagtgcagcccagcccggggccggggtccagaaggtgggggctcgggcgggagcgggggccgggggccgccggggtagtcgcgaagcccctcatccccgaggccgcgacgcgcgggggccagtgagggccacggggaggccgagaccttgggagggggcggggccgcgggcaggggaggggcccggcgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggtgaggagggagcgcccgtccgaggagtggacttgcgcgcaggagaaggggctgtggctccagggagggagcgagggcccggggctgggacacctgggactcgaaggaggggccggcggggactggggtgtcttgggtcagctgaggggggcgtgggaatttcagcacttgtctaggggccagcgaccctgcatgtgaggtgggaggtgtgtggttgctaatggaccaaatgaccttccaggtctcacacgatctggattctctcatcctgcaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaarcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccarattccaggaaggtgcggagatgcttctgaaccccgasgraaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgyggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgckccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctyttyttcctcaggctttggagcccctgagtttgagttcaataaaaactttatgtggtaaacgagacttgtccttaaaatgtgtgcgtgcacagcgccctgggaagtgggagacaccagtagtagcctagggccttatccgggaagtgctttgctgttgctgctgttagaaagcgggtcttgctgtgttgcagcaggccaccgcacctggctggaagtgctatttgtttctttttttttttttcttttttttgagacggagtcttacgctgtcacccaggctggagtgcaatggtgtggtctcgactcaccgcaacctctgcctcctgggttcaagtgattctcctgcctcagcctcccaagtatctgggattacaggcgcccgacaccacacctggctaattttcaccatgttggccaggctggtctcgaactcctgacctcacgtgatctgcctgcctcagcctcccagagtgctgggattagaggtgtgagccactgcgcctggcctgtttttctttttttttaattttgaaggcagtatcttgctctgtggcccaggctggattgcagtgatgcgaccatcgctcactgcagccttgacctcctgtgctcacgtgatccttctgtctcagcctcctgagtagctgggactacaggtacgtgcaaccaggctcaaataagtttttatattttaattttttgtagagacagggtttgctatgttgcccaggttggtctcaaactcctggcctcaaaggatcctcctgccttgggtttccaaagtgctgagaatacagttgtgagccacagagcccagccagaaatgttcacttgagtagggctgcaatattgcaccagcacaaaaccaccacaaaactggacagaatttcacatttattggataaatacatgcaggcactgtgcttggcactggggctccaagttagcagacgtggttcccaccttgagctcagtctttctgtgggggccactgcacaggcgtgatgggtcctgggagagggtgtggagctagggcagggcagagcctgagaagacagcctccaagggtggggatgtcacgggcccgtgcccgctttttatttttattttttccttgagacggagtctcgctgtgttgcccaggctggagtgcaatggcgcaatcttggctcactgcaacctccacctcccaggttcaagcaattctcctacctcaacctcctgagtagctgggactacaggtgtgtgccaccacgcctggattttgtatttttagtagagatggggtttcgccaggctggcctctaactcctgacctcaggtgatccaccctccttggcctcccaaagtgctgggattacaggcgtgaaccaccgcgcccagcccagcccctctttttctgtatcttcccactggctctgtcattaattcagtgaaattatgtcaagcacctactagatgtcccacgccctgacatatcatgaggcatcatcccaaggtgaacaagacaagtatagcctttaccctcacagttcactgagagatagctgctaagtacgtcaatcattaaacagggaaaaaacatccaggctgccggatgaagaaacatgacgtgtgctttgagggagtagtgcaggctggtggaagtgtgaaagatgtgaggacccaaccaagtgtgacgtgagctgggatctgctggtcaaggaaggaggggtggcgagatggaaggttcaggcagagggagctgtctgggtgaatgcaggaagacaggaaggagcctggcctgggagaaaggctggtgtcaccagagcttcaacagggaggcatcacggctctagaagaggctggggaaggccacgagggtctcattttgcagggtgctggaaggcatgccaaggaatttggtctttggccaagaacaaggcgtgtgccacagtcacgtagtgacacaggtcacatttgctttctgccagcagaagagactggactccagtgcaggggagtgtgcaaggacaggttctggggggtggaggcatctgtggacatcccagggcaggggtgagggccagaacatccctaggtcctgagactacagtttctccacatttagatcagacattctcttccaaggaaggaaaccaagagaggctggtgaaccgtctggtaatgacaagccctcacttttgcagccctcttggctggtccctcagcaggtcttccctatgagcctgcaaaggagacaggcaggaatgagttccatgttcgagatagggaaactgagggccagggagaggcagtgactcgcccgagggcacacggcagaatgcaggcagaggcagagtggccctgggcatcctgagtccagttctgggcactctgcacctcacaggcctggactcagtccttgccaccaccactctcagagtccttctcatggaggggcttcaggcagccgggatccccagcctcttgcccagatgccagctgctcagagtcttctgcagggattccattcgggacacctctgccagcctccatcttctccttcaggttccgtttgaagaaaccaacctgtacaaagacaaaatttgaacgagcaaagaattcactgagcactttggccccaagaaaatgtgagaacactttttttttttttgagatggagtctcactgtgttgcccaggctggagtgcagtggtgcgatctcggctcactgcaacctctgcctcccagacttaagcaattctcttgcctcagcctcctcagtagctgggattacaggcatctgccaccacgcccggctaatttttgtatttttagtagagacagggtttcaccatgttggccaggctggtcttgaactcctgacctcaagtgatctgccctccttggcctcccaaagtgctgggattacaggcatgagtccccgagcccagcgagaacactttattttattttatttattttattttatttttgagatggagttttgctcttgttgcccaggctggagtgcaatggcaccatcttggctcaccgcaagctccgcctcccaggttcaagaaattctcctgcctcagcctcctgagcagctgggattacaggcatgcgccaccatgcccagctaattttgtatttctagtagagacagggtttctccatgctggtcaggctggtctcgaactcgcgacctcaggtgatccacctgcctctgcctcccaaagtgctcggattacaggtgtgagccaccgtacccggccttcatctgtaatgtctactcagccttcaaatcccacctcaaatgccacctctcctgggaggcctgccaggccctcacagcctaagtgaggctcctgggttctaggccccaggccacacaggccctttgcagccctcattctgcttgcttctgcctgtgtcctctcttagactgtgagcgccacaatggcagggagcatgtttgtggcatgtgcctctgtgtccctgtgcctgggacagtgcccagcagccaaaaggacctccatatttggcatacttccttttcctctcccaggacgcctcgtcctggctctgccagggatgggctgaatgaccgtggaaaagtctctcttgctgtttgtgtgtgtgtgagacaaggtcttgctctgtcacccaggctggagcgcagtggcatcatcatggctcactgcagccttgacctcctgagctcaagggatcctcccacctcaacctcccgagtagctgggactacagttgggtagcatcacgtccccctaatttttaaaattttttgtagaggcggatgctttccatgttgcccaggcgggtcttgaactcccaggctcacgtgatccacctgcctcggcctccaaagtgctgggattacaggtatgagccactgcacctggcccttgcttgttctttggacctcagtagccttctctgttgaaggagggagtaggctgaggccccctggctctgaggccccctggctcttatgccctctggcttggtattctcctccctggctcccaccagatccccttccccagcctggctgtctcagcaatgcctgtgacccccggaggcacccaccttgtacagcactatgaaaatgagcagcagcagcagcagccccccgatgccgctcagcacgtagaggtagagcatctgcttctcatacaccacgtcaaccttcatgacaacctgggagcagggggaggggagtgccggaaaatgccttttccacccctgaaagtccctgtgaacctggttccattccccatctcctcctatccggactgcatcacccgcctggagtctccagctgcagaccctctccctttaacacgtcacctattgcagtcgctgccatgagttggccaacacacaccttaggcagccctaggccttcaatggcttccccggaatcgcacgcagctcagcattcaaagccgtccagaatccagcttttgcttacctgttagatgcagcttccctcctcccctctgcctgttagccacactgaacttcctgctcttcaaacctgccctgccaacactcaccacagaggcccctggccttgccactgcctctgcttagagcgctctttcttcactgtctgacttggcttggtaactcctttgctaagctgccatcagattgattttttttttttttgagataaggtctcactgtgttgcccaggctggagtgtagtggcataatcatagctcactgcagccttgaactcctgtgctcaaacgatcctcccatctcagcctcccgaggcactgagtacaggcgtgaaccaccacgcctgcctctgacagatccttttgagatgaagtctcactctgtcgcccaggttggagtgcaatggtgggatctcagctcactgccacctctgcctcccaggttcaagtgattctctcacctcagcctcccgaacagctgggattacaggcgcccaccatcatgcccggctaatttttgtatttttgtagagatggggtttcaccatgttggccaggctggtcttgaactcctcacttcatgtgatctgcctaccttgacctcccaaagtgctaggattacaggtgtgagctactgcgcccggcctcgattgaactttactcgacacataagtctactacatctcaggcaactctggggttgtgtgcccaccaaggggagaagaagcttctcccaggctgatggctctggcagtgggaagttctgactcgcacagagcccaggagctctcccacatctaggtctgccctggggctcctgggctccctctgttgcctgttcctggggcttccaaggaggtggagatacctgggccagggaggcgttgctgccatagaggtggaaatgcttgctgctgttgaaggagatggagagggagctgcagaggctgaacatggaagaggcctgtgggagcggggaaaggcgtcagaacccgggagaacgaggacagaacccactggcttttgcccccaccacaacacagtggggaggggcagagaaggggttccaggggggtgcacccatctctacacaactctctattgtggcattcttttctttctattttttttttttttttgagatggagtcttgctctgtcacccaggctggagtgcagtggtgccatcttggctcactgcaacctctgcctcccgggtttaagggattctcatgcctcagcctctcaagtagctgggattacaggcatgtgccaccacgcccggctaaagttttgtatttttagtacagacagggtttcaccatgttggccaggctggtctagaactcccgacctcaagtgatccacccacctaagcctcccgaagtgctaggattataggcttgagccccgccccagcctctactgtggcaccctaatatgtcgctccccattgttgtaaggaaagcttttctataaagaacacacaggaactatccataggcccatggaaacagcattgcaaatatcacagaaatcattgttctctttcacctgtgactgtgtaaatgggatttttcatcaagatgga

SEQ ID NO: 17848 - DNA, 25257 bp, Homo sapiens
gagctgctggcccatgtacaggggatggagagggtgggccagcgcccaccagtcagggctggctgactggggttctttgtgaaccttcagggtctcccaagctggaaacctgggggtcggccttgctcccctcactccatggccagccgctgcatcatcccctgccctgggccacctgccctggacgtgggccacagtgccagagagagggacccttgcaggtacagctcagaatctccctcctacccagacacccccaggttctgtactgccccgggactggtgccctgcccatccgcagcccggatgctccctcctccctcccagcatcccctgtggcagtggccatgcctgcccccagagcagctcaggctcccctttcatctctccaagccttagcccctgcagccctccgcctggagtgtttgcctccccctcgctgctgctcagggtctccctctgcccccaggctccctccccagcccctgagtttctcctctcactgtgcttccccagccctgagtgcttaggggtctgggtggcatgtgtggcatttaaccccatgctctctgctgagccctgagctcccagagttccctccagccctggccctggggagggggtagcatgtgaccaggagggcggaggggcttgtgtgtgtttctgagacgcagtctgagagagacacgggtgacagacagttggggaccccaaacactggggagcagagatagacaggaggggcccgcagtgagacacagaggtgagcaggagaggacacatagccctggagaaaaggagcaggtgtgggcgggcttccctccactgcagtcacagttccctcactcataggcagatcttcctgggtcctccctgcacaaagccccagtggctccctcgtgtcccccagccacagtccaagctccctaatgtgctagataaggccccagtccagcctttcggtcccagcactccctggacttcctgtttgggcctccaagcctttgctcccctttggccttcacccccatctgctccctagacctcagtccatctggcaaacacttcaccatcgccctctccatgaagccttccggcccaccttccaggatgacgtgagctggtgcccttgctgcgaggctgtcttcccccatcagcacaagtgtgagattccctcagggcagacccacatgctacttgggcctggtacaagtgtctgatgtcaggctgggcactgtggcttcacacctataatcccagcactttgggaggccgaggagggcggatcacctgaggtcaggagttcgagaccagcctggccaaatggtgaaaccccacctctactaaaaatacaaaaattagccgggcatggtggtgcatgcctgtaatcccagttactcgggaggctgaggcaggagaatcgcttgaatctgggaggcagaggttgcagtgagccgagattgcaccactgcacagagccagactctttttcaaaaaaaaaaaaaaaaaaagcaggtgtctgatatccccaaccagctctgtccaggaagggcaggaagagaggaggagacaggtgggttgggggagatggcaggggagcactcggggtcatggagaggctttggctagacggagcagaggaaccactcagggtctgtgtcctggctgcggggtccatccccctccctacccaagaggaggctctggtctgcccccagacacctcccagcacccagcagagggcccacccaggcggtgctggttgaggggctgaattggggaaccacaggtagaaagagaggccaggccgggtgcggtggctcacgcctgtaatcctagcactttgggaggccgaggcaggtggatcacgaggtcaggagttcaaaaccagtctgaccaagatggtgaaaccccgtctctactaaaaatacaaaaattagccgggcgtggcagtgggcgcctacaatctcagctactcgggaggctgaggcagagaattgtttgaacccgggaggcagagcttgcagtgagccgagatagcgccattgcactccagcctgggcgacagagcgagactccgtctcaaaaaaaaaaaaagaaaagaaaggggggccccaggcgagctcggtcccacccagcaggcgggggcggggcagggcagagtgctccccccgccccccgcttcctccccgagggccccggagcccagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccgggtaagggggacccacggggcgcgcggcgccggcagctgcggggagaacggggccccgatcgccagggcgcaggcagagccccgacccccgggggcgccgagggctgaaaggaccctgtgggcagggcctggaggggcccgcgatcaccgcgtggccctcaccgccgcctctctccctccccttgtccaccgccccccggctgtccctcccctccccggccagcctcgcccccctccgcccctccccgtccccgctcctccctcccctcggccccctggcctccctccctgtcccctcccgaagcagccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacggtgagttccgtgtgtaggggaaccagtctgagcggggcgcaggggctggggtgtcgggacggtctagggggagatgcatggcccctgagggggagagaagggctttaaggggaaacggagacagagtggaaaagagtttgcgctgaggagctcaggctggggagggagacatagtcctgcccctgagaccctggtcggagccaggaacagctctgccctgacagaccccagtgtgaggaagagacaggttgcaggaagggggccccgtctgagggaggagtctgtcctgccctttgggagtctaacggagcttggttcccccataaatccctgaagagtttgccagactgagccccagctccccaactccctgccctgccagctccccactggccaggcctctggactcagggtcagccaggtgccacccctccccaccctgcattgggcttcatttgacggaggactgcccctccagaggagtcttctaggggagggagggaaggctgtgactgagtacggagcctctaccccctctgcctgcagccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaaccctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcagcctcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgtgttttggttttttttgagacagggtcttgctgtatcacgcaggctggagtgcaacgatgggtccccagctaattgcagcctgggctcaagcaatctttctgcttcagcctcctgagtaggtgggactacaggtgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtagctgggactataggcgcccgccatcacgcccggctaattttttttgtatttttagtagagacggggtgtcaccgtattagccaggatggtctcgatctcctgacctcgtgatccgcccgcctcagcctcccaaagtgctaggattacaggcgtgagccaccgtggctggccttttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatgcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttccacctgggcatttggatactttggtttttgctgttgtggccaagacggcacaggccacatgcgcctgtgcaggagtctctgtttcccagcacagttgttgcgccaaaggccttgactttttttttttttttttgagatggagtttcactcttgttgcccaggctggagtgcaatggtgcaatctcggctcaccgtaggctcctcctcccaggttcaagcgattctcctgcctcagcctcccgagtagctgggattacaggcatgcactaccacactcagctaattttgtacttttagtagagatgaggtttctccatgttggccaggctggtctcaaactcccgacctcaggtgatctgcccgccttggcctcccaaagtgctgggattacaggcatgagccaccgcgcccagccagccttgacctttttgttttgtttttttttttgagacggagtctcgctctgtcgcccaggttggggtgcagtggtgcaatctcggctcactgcaaactctgcctcccgggttcacgccattctcctgcctcagcctcctgagtagctgggactacaggcgcccgccaccacgcctggctaatttttttgtatttttagtagagacagggtttcaccatattagccaggatggtctcgatctcctgacctcatgatccgtccacctcggcctcccaaagtgctgggattacaggcgtgagccatcgtgcccggcccagccttgacctttttaaaggtccctgttggtccaaattttctcctgaaaatctagaccatttcacatccatgaggagggattatatggtccagtttgcagataggaaaagagaggccctgtgaggtaatgggatccggcccaagatacaacaggtgggtggtggagctgggcgaaccctgggctcctgcgcttggcggccatgcctgcccagcagaatgtcattggcccggaccccctccttgggagcggagaactcggggactgatgccaggccccactccctggtttcatcactactcagattttctccccaactgttctctcattttgataagagggatcccagacagactctggaagcgccgttttgcgggtgggaactgaagggaaaagkcctctctctgagcctgtgtttcgggccagcttttcctgaaggagggtctgattcccaccaggtccccagggccctggccggtgggggcaggcctggctgaagtctcgcttcctcctggggcttcctgcaggcccctttcacttcctgcctggtagccagaggctgggggctccaggaggggttgtggaggcccagctggtgaggccagggaggaaggcctgaccccccactttcgtttcagcagggatggctcaacacagcactatccctgcaagctggtagcatctcactgggcctcaactctctgggcccctcttcccatctgcaaaatggggctcttgaggcccacctagctgtccttggagattgaagaggtcctgtggcatgtagggacagagggacccctgctagagccagggaacgcccccagcagggaggtgtgagcaggcctggtcctgccctcatgacccgagggtggggagagaatgggggtgcggtagaaacgactgccccaaatagcggaatagcggggcagagtcggggagcaaccgggaggagagagatgccagagttccccgcccctacgctttcctcccgggactccgaagggcgctcagtggttggcgtgggggacggggggagggacgctactggggtcccgggacccagaggaaccttgggcatctctccactcccctaggctgcggataatctgggatccaggcccgaatccagcgacttcggggcaagcgagtctctgcgcggcttccgccgtcagccccggccaccaccggccccgggagatttggacgtggggcgggggtagggggtgctgccaaggggcggggtcaagaagagaggcggggctgagggacccccaagcctcaaggtggccggaaaggggcggggccagcggcatgcctaaggggtggagtcaaggccaaggggcgaggaaaaagcttgggaccggataaggggcgggaccaaggccaagggcgcctgcttcgggctcccgacctctgcgccctcgggagtccgggtcctcacgcgcatcccgagccctgggggcctggatgcggcccacggccccgactcaagggcgaggctcaggggrgagggcgcaagacgcctccgcacagaactgtgaccgaggagcaggggggctgccggggagggcgcacctgtccccgtgcacgcgctgtggcctccgtggagctctgtcctctcttggttcccgcgctaaggtctcggtgtccgctccggattcgcacgtacactgagggctttggagcctcccagtcccgccgctccctggcgacctcaggagcccgggcgccccctccctcccacgggcagctggagcctgagtcagagttgcctcgcgggagacaaagacagccgtgggccctccctccagaacccctcctggtatcggcatttgcaccagcagggagcccagagtccccaagagcctctgcttcttgggtaactgcatcattgaggaaatggaagtgaaattagcttaggaatgaggccttggaggcttgtgggtggcatccgcggtcacggtcttctcagcctggcttcagtgtctctggggcccactgcttctccctgtaaccctgccgaaatgctggtagcccatcttgcagatgacaaaactgaggcctagaaaggttgaatggccctgaagagcaggaattccaacccggtcagcctggctccaaaataaaggataaaggctgggcgcagtggctcgcacctgtaatcccagcactttgggaagccaaagcgggccgataacttgaagtcaggagttcgagaccagccctgccaacatggtgaaacccccgtctctactaaaaatacaaaaattaggccgggccccgtggctcacgcctgtaatcccagaattttgggaggccgaggcgggcggatcacctgaggtcaggagttcgcgacccgcctgatcaatacggtgaaaccctgtctctactaaaaattacaaaaattagccaggcgtggtggcgtgcacctgtaatctcagcaactccggaggctgaggcaggagaatcgcttgaacctgggaggcggaggttggagtgagccaagatcgcgccactggactccagctgggcgacagtgtgagactccgtctcaaaacaaaacaaaacaaaaattagccaggcatggtggcgggtccttataaatcccagctactcgggaggctgaggcaggagaattggttgaatccaggaggcagaggttgcagtgagccgagatcacaccactgcactccagcctgggcaacacagagagactccgtttcataaataaataaataaaacctagaaactctgggcatgtggggctggaaaggggttccaggaagagagggcagcctgcgtgaccagacagggggcaaatgagcctgggtcaggtgttggcaagggccctgtcgtggggtaggrgtgcctcccgggtgtgctgaactggccagaatgtggattcgggactcatagtgcaggttccaggccagaccctgcccttcctggctgtgtgccagtcacagcaagtcacttcctctctctgagtcttgagtttctctctaggaaatcccaaacctttcccagggctcagcagagctggcagactggtcacccaccacctaaaatggggacactgaggcccagcacaggctgtttgtcatgtccacacctctcagggcccccagccttccccagccagaactgagcaccaggtgagggctggacatggaggaaggccgttcgtgcacaggagcatgtatgctgacaaacacgtgtgcacacacatgcccaccgtgcagggaaggccctcatagtcatgctagccccagacatgcacactcttgctgtcacccaaacacgcgcagacacccgcacactcgagctgccagcattgggagctgggggcggggcgggtgccyttcaggagcagggactcggctcctctgcccgccccgcggggcttgctgcagatgccaggggttattttaagcctggatcaatggatgagttttggtgacacaggcttagtggtagtggaggggggcaggcagaagagataaggggtggctgccctggagccttgatggggtgagagacccyggggtccagggcaaaggggtcactcctcggccgggctgctctatctccagatcccctcacccggcacatggccaggcacctggggcagtgtcagctgaatgggcgatcagatcccaggactcagccagtcagggtcagctgggctctgtgttcacagctgccctctcctgctccactcactccccgcggccaggtgttcccatggagagaagagggtatccagtgcctggcacagacccagtagttatggttacctatggctgctggctgaccactgaatcagattgagacggggaggaaggtgtgtgtgtggtggggggtggggggtggtgttgggggttggacatcagtccctgggaggggctggaatccacttccttcattggacaaatggctgtcactatgtatatgtatgtgaaggcctgatggggtcaacatgaggaaagcacccagtgccaggacggtgggggcaggagggtgtccaggaagggggagcactgggagacttgctctgacccctcactctaacttggaagaggccccagttccaagggggcagagacaagcctctttcaacccagtgcccggcaacgggtgggaaaggtgggagaagaggcccccctcagagctcctgcagcctccagggcagtgggcagagggcggtggggacttcaataccagtgatacgggttgtgccacggattccatttctaggaatggccctaaggaaaggaagcaggaaaggacgctccagaaagtagagctcagaagctctgagaagaatcacaaatgagaaggtttttttttgtttttttttttttktttgtttgtttgtttttttaagacggagtctcaatctgtttcccaggctggagggcaatggtgtgatctcagctcactgcaaactctgcctcccaggttcaagcgattctctggcctcagccttccgagtagctgggattacaggcatatgccaccatgcccagctaatttttgtatttttagtagaggtggggtttcaccatgttggtcagcctagtctccaactcctgaccttgtgatccacctgcctcagcctcccaaagtgttgggattacaggcgtgagccactgcccccagccaaacgaaaagtttaaggatggcaaaaagtaaaccacaaactagttacaatccagcatgtaaatgtggcatattttagtgtggttgtctctggacatgggattaaagcaatttcatttaattcctttgttcatctgtgttttttcttctaaactggtaataaggggtcctttaatgagggtgggttttcggggctggatgggaagtgtgtgtacatgtgtgtgcacatgtgtgtgtgtaggtggagggagcaggctgtctttggccagggcacaaggagaagctctgagtggggaggtcacctcctcttcctgtctgaacccattaatacctgaaattagtctgtcagcccctcatgtcaggcaacagacttgatcctccttaaaatgtaaatccttcctcttcttctcccccaccttctccactttcataagctggtcccagttgctgagagaaggacggatggaaaggggaccaggagggaccctagggagccccaaatgtttcatctcacagaaactaggcgctggagtcctttcattcatttattcattcagcaaatgccgacagaggcctgagctgcacactgggtgaattgcacgcccagtccttgccctcctgctgtttccgtctggacagagggaggttccatatcgacccctatctcctggaaggggcagattatgagtctgccctccaggaagagtctttgatgttaagatgagatactgaggcagggagaagccaagcaccaggaccttctccagttcaactcaaccccgaaaacaccactgggccgtgctgggaccgggtccgggctccttagggcccccacaccctacccctcggtttgtgaaaggacctgcgggtgggcgcagggcggaggtcttccttttccaggctttccttttccagggcaggggcgagcccagtccccctctcctcacacctggggagggagcagatcgcggaagtgcgtcagccaagccgtgcccatcgacgcagggatggggacatccctggaccccagcccagcgttcgaggggttctggaactgggctcgcgccgtggggtaaatccttggccctctgaagcggcgctgccaggggaagtccttcccatttgacaggtgggaaaatcgaggcgccgagaggggaaggggccctccttatgttatgatcagaacggacagaggggacgggaaggaggtgagagggtggccctgcccgtcccggggcaattccgggctgctttgacctccgcgcctgtaaggtacaggtccccgcacctgtaagacagggacgctctagtcgcgggccctagaactgatccccttcgagcgcccagttccgatgaatgtttcggggcagtctttgtggaggggggttccctgtggggcctcccggctccgcggggcctgctgcctcctctcgcccctcgcggcagccgcgctcctcccccggctctgcctcccttccgccctccctcctctctccctcccccgcccgcccgagcccgcgccgagcccgagcgggagccggagccggagccggagccagagcgcgggctgtactgagagcgcggcgggaaggtagcgcagtcgggcggcccgcggccccggcgcggcctccgctagggccaagacccgcacacctgccgggccggggagaagccgggggccgcgcgcaggcgaggacccgccgcccggcccggggaagatctcaggacgcggaccgggcagctcgggtccgaggtgagcccgggcggaggacgcgcccaccggaggtgcggcctcggagctccagacccagcccactcggggctggggtccccagaggaggccgacggccgaggcggcgtgcgccgggagccagcgcgatccctgcgggagcggaggagccgagccggagggagccgcggcgcccggccatgcaccgggcgcagtagcgggaggcgcgggcccgatggcgcgggccggggcgcggggactgctcggcggccgccgtcctcccggcctccggctcgcgctcgcgcttcggctcgcgttgctgctggcgcggccgccgtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccaggtgagcacgcgccgcccagggacccccgcctgctcctcggactgctctccctgcccgctgatccttcccgccgctctmgaagcgctggttctcccagcaggccccttctctgggttttcctgtctccttctccccccgccgcccccccaacacttcatcagggagacacctgacaccgccctgactccctttgaccttctgcccgtgctgggcgccgcaccgcctttccctgctcgagtctcctctggagggcaggggggtgggggcgggctgggagggggacaggtagccttgcacagagggcaccgggtcactgtccagggtaaggggcgccgctggccagggaggtgaccgggcgtcttgggcacgggaaaggaaggggcgcttggttctctgggtgcccatctcctgcttctccccactcctccctcccctcttccacctcctgcctctcccctgcccccacagctgtgactcaaggctgcccttccctccttgggtttcaaaggcctccccccactcaccccatgccacagctcccaggtgaaggtcagggctccctctgcgtagaaaggggactctggaacacagtcgtgtgttgctgaggccaggacaggtgcttgttgcattctgagcttggtgtgaagtgggcactacagggtccaggtccccttcctcggttggaacgaggactctaggactctatgtgtcctgaccctggaactcccacccacatgccacacgtggcactcacatgcccccagcaacccccatgccctggggcctgtgccctcctcatccacccggtcccagcaccctttgggcctgtgggctgctgacaccgaatgtgacaggctggtatttaaaagtgaccatagagaagccttcataccctggcaggccagatgtggacacttccccctcctgggcctcagaggcagggggtgagggcttccttggcacttcagcacccctcgctcccgaaaccacgtagcccactttctcccagggagctctaagggaagcccgggctggcaccctggcctccaccctcagcttctgcactgccttcaggaggtggagcctcctggcctggcttctggatgctgcaggggtaggggctgggctgcccaaatttgggggtcccccatgatgggtgagggtagcttggaagaggcctggatatgtctttgacaggggcggggaaaaaggaacttagggctgcgatggtgaggggtggctgcagcagcccagctgacatgttcatcctgaactccctgcacctgctggggatggggcagcaggtttggtgatgccgcaggaaagccatgcccacccttgctgtgctgtgtggtgtaggccagtcccttctcctttctgggcttcaggctcccatggccccaactcccttttctctgctggggagacctggaatgggacgtaggcttgtgtgtgggtgtgtcctgagtccctgtcctcccctcgagtctcacccttcattctgctgtgttggggttgaaggccagggaaggcttctcagagggcttgggcggggcatctggaaagagtttgtgcaaaggcccagaggcgtggtggttactcagctgtcagggagacaggagcttgaggtgcttgcccagagatgaggccacagaggtgagcctctggggagagggcagggcaggaaggtcagcccaggcaggtactaggatggtttcagaccctgccaccaaacctgaagccaaacctcggccatccctggtgtcctgcctcctgaatgaccttcacgaatcagccatttgaggctctagccccggaaggagggtcaggctgagtgggagaaaatcatgggttccgggttctgaaggcagctgggctgcagacactgtcacatcacagctgggtgggggctgggtgttgggtccaaggaggtggctgtccaaggtcacacagcctgtgggtcctgggctgccaccagggggtctcccaamatccccattccgtcacccatctgtccttcatgcccgtgatggcagctttatcccaggtcccagcagaagccgcggctgcaggggcagttaggcaggcaggtaaataaggcatcctgggccgggcgcggtggctcacacctgtcatctcagcactttgggaggccgagaccggcggagttggagaccagcctggccaacatggtgaaaccccgtctctactaaaaatacaaaaattagctaggtgtggtggcaggcaccttataatcccagctactagggaagctgaggctggagaatcacttgaaccggggaggtggaggttgcagtgagccaagattgygccattgcactccagcctggacaacagagcgagactctgcttcaaaagataaaaaaattaaaaaaaaggattcctggaggaggccgctgatggggtctgaagaatgagtagcagttttttgggagaagaggcaggaaagcagagaaagctcgcattgggaggggaggctcacctggggaaggtccctgagagtgggctccagggaggggaggggagggaaggggagcctcattagagtttcctgacctgctctgggaagcagctgtcttggggccacaggtgaggctggcagatactgcctgggaggggaaactcgtgcgtgatttcgagcaccggagaggacggcctggagaggccgaaagaactgcccagggccacacggtgagacggtggtggccggggctggcttttgatgaggtgggagacagagggccacccctgactgctgtccccgcagggcgctgacagagcttctgaagcagccgggcccccaggagccactgcctcccaccctgggcccacccctgggtggctgtgtccaggtgcagatgggggacggcctcccccggggctccccccacaacagcgcaggtgagtcggtggcgggcggggctgagcggcggcggagcacgcggaggggcstgagaggccgagaggcggtccctcggctggggcatagaggcttccccggtggaaawgagccgcggcctctgcgggtgaggggcccgaccggccagccagctcgccagggtggaaagggaccccccacgggtcctgcggcctcgagtctggggggctgtgatgtgtgaggaaggttccagatgcaggatttgctggccggggctgtgatctgaggctcgggctccagagcctccccctgggtctctcgagaggcaggcaggcttggcagcccccacgccccgtctgggttctgttcctcagacatcccccgtctcggcgggagcaggtcccaggactccgcgcctggctcgagcgtcgcctccgggcgagccgttcatgagggtggcaccccccgggctggctgccgccgccgctgcgcgtgactcggagccaggccctgttccaggcgctggaggctgcggcgaagacaggcttggctcgcagcctcgcccggagaacggtcccccaggttctcaccgaacggcctcggggagaggactacggagaggtgacagcgagggcggagtgaaccggggcatcggaccgagccgcgtctcactcctcgctccagacaagaagcgcctcaacaacgcgccccgggggtcggccgccccggggcccccgcgcggcccgcggctgcagggcggcggcagcctgacgctgcagccagactacgccaagtacgccacgttcaaggccgccgcgctcaaggccgcaggtgagtggcgggtgcgggcagcgtcagggcacctgggcgcacgagctcccggactgcgaagcgcggggccgcagctccaagcgccaaattcccagttccgcgcgcccgccgctcggccaatcggctccctcgccccagcgggccccgcccccggcccgccccggcccggtccccgtcccagtccccggccgggaccccttgtccagtcctgagcttgggtgctcggcgcggcgtcactcttccctgccctgtccccgcagaggccgccccgcgggacttctgtcagcgtttccccgccctcgagccgtccccgcggcaacccccggcgcgggctccgcgaccatccccggacttgcctgcgccgctggacgcctgcccctgggccccgccggtctacgcgccccctgccgcgccgggcccctatgccgcctggacctccagtcgcccggcccggcccgccccgctcagccacccgacggctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtcggagcctcaggccacagggagaggagcgcctgccgtaaggccagctcttctgtctgcctcaacggcagtggtgtcttggagcctgcaggccgcgggttcgtcttgtaaataagcccttttatgtggttcctgcccctgagaataaagaagccccagcgtggctgcgaggcaccattggtcactgactgtacagatggcagtgcaggcagagggcacggcgagtgcaaggttggaggactgctccagtgcaccggccagagccagggggaagtggctggagaggggggccagggttgaatgtcagggttaatgcccacccccgtgggagccctgggagagagggaacagttagacttcagccatagaaaggcccgggcacaggagagagggctgttgggtccaaggcccagtggggggtccatgccctgtactgaaggtgagccccctccagccgccactctgcagcttgagttggctgaacctggctgatgctcactgaccactggctgtgggccagcccctggcctgcaggtcgcttggccagattggccccgggctaccccccttaatgggtgtgggccgtgtggacatctggtgctccggatgggggcgcctcctcccaggagcttctctgaaggaaatgggggaaaagctggagcagggtccctggcagtgtccctccgggagggcttcctgcacctggctgtggtccagagcactgctagcagtctgcgtgcatcttccacagagttcctctccgccaggtaacactggggaggctaggggtcagggctgtggctggttgaggtgtgtgatgtggggaggctaggggccagggctgtggctggttgaggtgtgtgatgtggggaggctaggggccagggctgtggctggttgaggtgtgtgacctcagcaaagccacccaggtgggtctgtttccctcctgagtacctgaagtgtggtgtactgttttaagaacaatggccaccatttgttggcctttctcaggaaatccacaagcgcctcaagtgggtgtgtctttacagaggaggaaatttgggttttgaaacctaagtagcttgcccaaggtcacccagcagactcccaggttaggactctcccgaattgctgtgaatcggctggaatggcaagcaacaggcagtttggctgggagggagggttctgagggttggtagggaggggtccctgttcccagggtatatataaacagtctggagctttccttctgctggttgggctgccctgaggccccagaacccaccaggcccggtctccgctcctgccacaaagggtccacctccctgtccctttaggctgttaaggaaaccaaggcctagaagcaccaggacagagctctgggcccacggtcctgcccctgtcccacagctgtgcagagctggaggagggtgggggctgaggcatggagcctacacagactcacaaaggaatctggttgcttctcaccccacctcccaccccctgctgggctgtgccaagagtgggcaattccccctgctcattctcagttccaagggccctggatctccatcccagtggagccaggctgaggctgtgggcagtggccatccctgaaaatgatggagctgtgcacgggaccagctgcaattgggcctcaccgggctgctctggtctcagggtagcctgctgtgactacccttcagagaaggatgtggctcatagctgagggattcagccacatgctcagtcacatcctgactcctcttgcgacgaggcccagcactcccatcccagtctgtggtcctgtcccctggtgtgtcttacgccaagcctggcctcaccagccacacaaggcactcgctgtaaacttgcatcccatcactcagtcctggcagacaagcctttggagctgcagttcatggctgagcttagcttcccaattctgcacacgtggaagtggagactgaggccaggtcccaccccaggtgacccagctgggaagcacaggacctggacttggatctgacttgtgggccagtgagcctcctggctcagaggatcactgacttcagggagggagaaactaaggagcagtttacccagtgggggagagggtcagcaccccaaatctgtcagccagcctgcattacatccagggaacaagctggaacctggatacagtgacctctgacccccaaagtgccacccacagcccttttatcccaggctggagggtgcgccaggcaccggaaggaaggtggacaagggaggcccattagactgaagccaggggccctctcagcagttggggggctgccctcagtccctggcccattgcctgccaagtcacgcagccccttggctgggcaccacagcagtcgcactacagaccctcacacacctcgtgctgggtggtaccaatctgtgtttattgaatatgtctgggacacagtgactgattgattgaacatcaagaaagctataggtgtaccccccttttcagtgaaaaaccaccccctcccacacccaaacaatagtgagaaaaggcacaggacatacacacaacacgcaggcgggcagggtccataaattacagtgagagtaggggaggggcaggagagaaagaaagcaggtggggtccaagcacaccccagggataacattccagcctgcatcaaggtggccctgctgtgagcaccccccagtctgtgctggggctcctgcccaccctctgctccaaccagcctgaggatgaggcacagggaggcagggcccatcactcaggaggccatgggagaaacagtctccgggaggtgctgcacctggggacccagaaaagtaggactttttctcctaggacccgcatcgaggcaggggacctcattcctagtgcccaccataggcaaccctctgcccactctgaaaagaggggcttgccgctggggagggattaggggttggtccctgccatcctggtttatttattttcagctcaagaattaattaggtttaaatatatacagatatgcctcaacttaccatggggttacttcctgataaacccatcataaatgaaaatatcctaagtcacaaattcatttaataccccaacagaccaattgtaaagttgaaacatggtttaagttgaaccactgttaagttggggacagtctgtactgtggaggtaggagatggggtagggggaggagggaacctagaagccatgctgaaggcccctggtccccagtccccatgggtggcttcatttctcccagccccctgggcctaccctgagcttgggctaacatcctaggaggcggggagtgggaaggaacaggacaattaaataagataccatttattttttaaaaaattaaaaaataatgccaacattatttcatgcatccgcaggcctgccccctgcctcccaccagcctcccagggctgggcccccctcctcccctggctgtcctgtgtaataaagggaaaaacaatgagcaggctcagtcaggcccaggggagggaacgcagacccagggagagaatcaagacgctacagcaactcagcctcgcatcatggcaaacccaagcacactggtagaaaacattcgtataaaaaggggagggcatgctgggcacaggcctgagggcaactgctccctggtgctcagagactgctgtcccccagagaaagcctgataaaaactgaggaagcaaaaaggagagagtagggttcaggagagagaaactcaggaaggctggaggcaggggcttggcagcttgggagctccccctgctgctatcaagtcagggctgcccagtttctgccctgccacctatcctctcacgcccaccaggccctggaccatgggcatctagtgacagcagctttaaggggctctgcccaggggtgcactggcctgagtggcccagaagcctcggcaggtgacagctaagaagacaaggctcttccccaccactctcagcgggaagatgctgagggggagagagagaaatcgagagagaggtggaggggtgggctgagcctggtggtcaggaggcggcaatggcagtgccaccacccagcttaacaatcatctgctggcagtcgttgcaggagcgccggtcgcccaccttctccagggtgcgggcagcttcggccagcagcactgcccgctggcccggggaggagaggaaggagaggggcaggtggcggcaggccagcaggatggcggtggcccgctctcgctggccgggccaggcatccacctctcctgtgggaaggagatgtgtgtcacaaccgagaatctaccatgaagttggtgcagttccttggcgttacctggactcattcactgaacgctcacatccatcctgggaggtggggtctgctgccccacccaatccacggaaaagaagtgaacttgtccagcctctcacggccagcccgtggtggggctgagatgggcccacatgacctggctcgagcttctgcttctatgcctgcacctgtgctgggacgccaccccaaccctccttccctgatcacagcatgacccatgaccaccccaacccctgcaacccaccaagggcggcctcgggcttctttcattctcagagaggcgagaggtgtgctgggcaccaatgccagatgtgggagctgggctggcccctcttctcctctcttcctagggcgcagggcctggcccagcctgtgagctggggaggggtggactcaccgtgcttggtgctctgcgtggtgcgccgccgcaggctgtgttccagcagctggtgggtgcgggtggggctggctcctgccatcaggcgcacggtggcttcatgcaggaacacctggggaggtgccggggtgacatccatcacacccctggtccccacccatctatgcccagggtagctctccctgagccatctcgcctgccacctcatgacatcccttcccacaccaccctgccttgctcacccctgaaaagcaacctctgttgtcccgtactctgaccctgagccaggcaggaaacctggctgaacagcaggagcaggatgagaggagagagaggcaaaaggcctgcttttcccaactggtgacaagaaagccctggacgcacctcgtggggctggtagacaagtgccctgggtgaagccccaaggccctggaggctgcctgcagtttgacaaaaggacaggtgtgacagggacagaggggtgaggagggacagttgggctggtaccagagaggtttggtatcctctttccgtatctttagaaaggaagagagtctagaggtgtgcgggtaaagtctgcagcgcttaggtatgagccactggtgggtgaagggcaaggctgaggtctgtcatttcttaaaatctcaagctctttttgatgcctttatatctcagtcttcagggagggtcttcagtgctgccaagtggattctggtcctggtaggcaatggggagccgctgatgggctctcagcagggagcagcagaatggaaatggtatttaagaggaggcctttggaccaggcgaggtggctcacacctgtaatcccagcactttgggaggccgaggcaggaggacagcttgaggctaggggtttgagaccagcctgggccacatagcaagaccccatctattatgaaaaaaaggccactgatgccagccatgctgtgagcagaccagagagctgaccagagtgggctccaggaggcaggggtgccgctccaggcctggggtacatgccctcttctccacagtaaggaatggctctccgatgatactgtctgttgtgtctgtcttggcttgctgcacacagtggccacagtgcaaccctgggtgggccccgcagcacctcagggtgatgggtgtgggggctgaatcccaagctccacggcagcagcctcgctctgaggccttcttccagcccag

SEQ ID NO: 17849 - DNA, 28397 bp, Homo sapiens
  misc_feature (1)...(28397): n = A,T,C or G, or insertion/deletion polymorphism (see Tables 1-2)
acaggacatggcctggtgtggaagaaatgctatctcaatgtgtaaaaggtcattcagtggcatgatttagagagattagagtatccatcccagaactgaaaatgaggcctggagtctgttttgcctttgttcaaggccgtgcttcagattagtgcacattcatattttcttcctcccacatgtctgtgagtcctgagatgtgcgggggatactggctccttccataggactgtcatcagggtcagcagggctcagtctaggggccttacacctgggagcatggacacaccacctacactaccatggaagtatgcagcttgaaggacactgcctgtcttggacttcagttctttgtcttcagtatggggatgatatgacctgcctttacagcagggctcttaaggtcaaattagatcaacggatctgtaattgctttggaaaaatgagactaaaaattatacagtgaatgaggaagaaatgaaaaaatgtcataaaagaccctacattttccaaaacatctgattctgtggtgtttatactgaatagtttcataaactttcaaagaatattactccttaatttaaagacctataaatgtgatcctgtacgacctcctaatctaataaagaaaatgtaaaagtggcatcatttgtttatataaatgttaaaatgtaaatagaagactagcatgtaaaattcaagagaagaaaataattatgcagtagaaggggccagtataggattgcggggaaaaagctcacgttccctgccatagtcaccaagacagcatggtactggtataaaaataggcacatagacaaagggaacagaatagagaacccagggataaacccaaatacttacagccaactgatcttcgacaaagcgaacaaaaacatatggtggggaaagacacccttttcaacaaatggtgctgggataattggctatccacatgtaggagaatgaaaccgggtcctcatctctcaccttatacaaaaatcaactcaagatggattaaggacttaaacctgagacctgagactataaaagctctagaagatcacattggaaaaacccttctagacattggcttaggcagggatttcatggccaagaacccaaaagcaaattcaataaaaacaaagataaatagttgagacttaattaaactaaagagcttttgcacggcaaaaggaaccatcagcagaataaacagacaacccacagagtagtcacaatctatacatctgacaaaggactaatatccagaatctacaatgaacacaggcaaatcagtaagaaaaaacaaacaaccccatcaaaaagtgggctaaggacatgcatagacaattctcaaaagaagatatacaaatggccaagaaacataagaaaatgctcaacatcactaatgatcagggaaatgcaaatcaaaaccacaatgtgataccaccttactcctgcaagaatggccatgataaaaaaataaaaaaacagtagatattggtgtggatgtggtgatcagggaactcttctaccctgctggtgggaatgtaaactagtacagccactgtggaaaacagtgaggagattccttaaagaactaaaagtggaactataatttgatccaacaatcccactactgggcatctacccagaggaaaataagtcattatatgaaaaagatatttgcacatacgtgtttatagcagcacaattcacaatcacaaatcatggaaccaacccaaatgcccatcaatcaacgagtgggtaaagaaactgtgatatatatatgatggaatactactcagccgtaaaaaggaatgagttaatggcatttgcagcgacctggatgagattggagaccattattctaagtgaactaactcaggaatggaaaactaaacatatattctcactgatatgtgggagctaagctaagaggatgaaaaggcataagaatgatacaatggactttggggacctgagaggaaaggtgggagggggcaagggatactgctcaggtgataggtgcaccaaaatctcacaaatcatcactaaagaacttactcatgtaaccaaatactacctgtaccactataacctacgggggaaaaaagcaacataaccatgaaccaactaataaaaaacaaccttgccttcagtctgcatcctaccctagagacactctctctgtgtcctcacacttggagctaagcttctgacttttgtctccagtacacccctgaggatcctctcatcacggccatcagaaacctctgtagaaggtcaaatccagtgggttcttgtcagtgcctctgacttgagttactgataatatttgcaccataatccacttctttctaatgagctactctgtccttatttttctcctatttactgaatcctccttatcatcctttgaaatctcctcttaattattatgttctctcatcataccctgagatccctgcatttctgatttttggcactcttcctggaaaagctcatctaacctgcacctatgcttgatgactctcagttctctggcttaaactcctctactgagaccacccatcatacaaaaatgtttacatattatttttccttagataacttttagacattctaagtgcaatagccccacactgaactcagtctcttctctcagtcaggctgtcttctctcattaccctttttaatgaatggaatcaagatgtttgcattgggttggggagatgttggtcaaaggatacatccatttcatttcatttaggatacatttcaaaagatacatttcatttagattggaggaataattttaagagttttattgtataacatggactatagttgctaacaatgtattgttgaaaattgctaaaagggtggattttaagtgttctcaccacaaaaaataagtatgtgaggtgagccataagttctttagcttgatgtagccggtccatgatgtacatacatttcaaaacaacatattatacatgataaatataaataatttttgtcaatcaaaataatttagaaaagtgacacacacttacacacacacacacaaaagagatgattgcattggccagtctaggaataagagttatctgggagttttctaagtcggatgccaccgacatcactcaccaataatccctttaatgtcaatcaaattaagtcctcttcttccatcattttactcctatgcccatttcctcactctttgttcaggcactattagtcttgcctcttgaaccaacttctttcactcatgctgcccactgttgccgtagtgatcttcctaaattgcaaatgcgccatcactctcctgcttaaaatccttcaatgattccttatgacttccaggacagagtagccactcctgagctttgcatgtaacatctgtcatgatccagcccctgcctgtctatttttccttttttcttgctgctgttccacatccaaagctggctccattcatactgaagcagctgaagttcttcagatatgtcattgccacactgggcccacacttttgaacctgcttcctcctgtgtgagaagtggcttctgccctgttttcggactgcctacattgaagccatctgttccccaggaaaccttccctgatgccttgacagcagcatcttgtgcctgccccatatctgcacttatccatctgggcctgctgttgtcttgtcacttgtgttctcttctgtgaactgtaaacatcaggaggacaagacctatgtcttacttttatttgaatatttagcatctaacaatgttcgacatatagtaggcttttgatactatttttttactatgacattgtagtatatgttaatatccagtaggacataggatatattctctctgttttcaatttttcattgtttacacacatttataattctatctataaggatttacaattatttacatgaaatgaatgaaataaatagagaatgttagatattaagagacagtgtggaaagccaggctgggactagggatgcacttaccttaggtgcaaaatttaggaggataccaaaagaactcagtaataaaagtcaatcatattttaatgaaatatcttaagaaatctaaattaatggaaaatatataatgaacaaaatgtcaaaagagaactattcaaagaaaatggagaagcagagaggcagaagaattagtagaatatactggcacataagccaaggaggtaaagatttccaggaaggaggaagtagagtggagtcagaagttcaacagaagtcatttcagaaatcttaccttggttttgaaatcctttcagagagcagttttacataatgtgagcaattatttctccttcatccccatcattccagaattgagcttcttctctggcttcagaaatgtggcccttccccttgtcaggatatgttggcgacatgatgcatgcggatgccctcaaagtcagctggggtttgggggtgaaattaattgactttagggaactccttgaatgctaagttctgttcacctggaggaccagagagggcacagagatgaccacctagcttctgcctgggacctaaacagggcagagaaataggaggatcaggtataaagggagcagggaagatgggtctgggcttacagtactgaacccagggatgacagtaactgtgtgtgtctcgaggcaggtgacaaaatatgtgaaaggaagaggacttaggagagatctgaattccagctgttttacaagctatatctcagctttctttctcaattcatgtgctctctaccccaaaggctgatggaattgctgacccttcaagttctcttctcatctgcaccccttccctcctgctgcacactgttcagcgacatcacacacttctccagcctcctctcttcctagtcttaccccttcccagtttccataactgaactgtcctgttgaggagttcttagcagccctctgtgaccacaagtgcaagttgcactcccttctgagacaaagtcccccatttattccctcctgagggcgtgtcccttcccctgaccctcatggactctcccaggtgcaccccctgtggatttgctcctgggcctgagtttcccctacttccctgatggtgtctggagggcaaggggtatctgtctatctactgagtgtcataaactgcccaactcagcacacccaccctctacctcttcctaagtgtagtgacacggtgagggaggtaatggggtggggtctggaatcagacaccaggaggaaaggggtggtggctctctttgcctctcactctgtgtgtatttctctcgggtaccaggaggatttcctaaagatttctttctcctgactgttttctggacccgtcctggtctccaagctcccctcctgattctctgcagtgcccaggtgtccaacagttgagcctggagccaggccaacttgtcagcttcctgtatgaggatcagactggacgacttcaacctgcttagcccgtcttctgaggcctcaccctagtagttggcaagtaagtctatttgctcctctggtctgcctggcccacacttttgtgagaaagtgccctagaacctgtacgctctaaactgtgaaaccctgttccttcttttggccacaacacacctacgcactgcccaaagttcagtcacttctagcccagagtttgggcttagagtgcatccttctctgcaagttgtgttagcctgtaccttgggcaagttacttaaattttttgagcctcagtttctacatcttaggatggacagtaaatagaattggcacaaacaagtgagaaagtgatggcacagtgtttgttgcactgtaagcacttgataaatggcagctattgtgattactgctctcatcgtcattggtttcaactttcatcaacagatctccaaccctgttgacgcccctgcttcagtcagtcacttgaacctctcactccatgaccaggtggcaccttgtggctatggccatgaagggccagtctgtcaccctcattgttgactgcaagatgtgagtcacccggcctctcccctgaagaactagtccagtgttggacacctgtggggtgataattgttggtgcctgtatcccagatgaagaaagtctttgaggttaccacaaaaatcagagaaaggagtgacttctggtcccttattttgtgcccactcctcttctggccccagtatgcaatgttcctatttcctaagccttcattttttttcttgtgaattttgatttgcatttcctatcttcaggactgctgatctctgcagaataactagatgtccacttatgtggcaggactgtccacagccacttattctatccttcagtcttcatctytccatctatccatcccttgaacctatctctctcctcatccaccccatccatycactcattcaccagtccacctaygcacacatccaccacccactcccgcaaccatttacccacctatgcatcacaaacttacccatctactcatgcatgaaggcttatatccactcacctgtccatcctccccctgcttaaygactctccccttctttacacacatctattcgactatgcttttgttcatctgtcctcttcaacttatccatccatctattcactcacccacccactcacacaccccatctacccatgcatacaaggatgcatgcatctgttcagccacccatctatccattatccttcctggaactcaaccactctctccttcaatacactcatgcacccatctcctcacccactcacttcacatccaaccgttcaytcaaccaygtattcaattccacccatctatctattcactcatctgattccatctactctgtacctcccgctcatctacccactaagccttgcatgcataattccctctgcaggagtcccattgtacctgttttgtgcctttcttttcactctgggtcatggtagccatattgttgaaggttcacttcccagatcctcttttcttggctgcttcctgtckgtacagccrcttcctgtttgtccagtttgttttgtggccatcttggccatgtttaattttccttggccctggcatcactcttgcatccaagtgtttgtcattttattttgtgtcccttagttgttctmatatcttccagtattctctgtcagttggactgcttcctgtctactctgctacatcttctgcctgccttgcagttatggctgccttttctaccctgctgctgcatcccacacctcctgctcttggcacccgygagcttctgctgcctttcctttatgctgctgtctgggtctttggggttgatgtgggatmtgggagaattttgaaayggatcattgctgtcaggatgaaggtggagaggggcattctgaagatctttgttttggggagttggggtggtggtgaatgtttcaccttctccccacccttatcttgsctatggcctggatttgggaacaggcatctgaatggaggtgtgcaagggagggaactggttggcttggagtgtacatgagggccagaagaagggcaaagcatcctgctgggagaggaactgtggggtgyattgtagggggctgctctggrgcttggataactgagcccaagaactrtatgttttgcaaaaggcagttatgaggcctgagtttggaatatctctgggaaatgctctccaaatttmcttggagtatggatacttaacctgtgcagggtttttacatttttgaactccttcaaattctaaataaaattttgtgcataagggcatataccttttcttttttggagaaagactgaaagactcaaagtcctctttctgaaagaggctcttcaggatttggagaggttgtgtttgctgaggtgggactgrgaactggggtgcagggaaccctgagatctccttggcaggcatgagagttttgtgaacagaagtatttagaggaagcctgtggggcttgtgggtagggctggtctggtctccagaggacccaaaatcgaggttggagttgagatkggggcaggcctggtgtcctggctgctcatgggccccactggggttacatgtgtgtctccctyaggctgcccatgggccccggggkctgaagggaragaagagagagcctgcagtgctggaacctgtaagtyatgctggtcacagggctgaggtggtggaaagaggagaagcaagtggggtttagtgtgctggccctgtcacctgtgagttttaacctttgactccacagggtatgctcktgraggggmcccctggtttagaaggccctgtggtgagtctagcagtgacctggtggccattgttttcttagagatccctcctatgtgttcatctgtgccttccccacatatgctcaggcctcctcctcagaactccggagggtccttccaataaaagttttttaaaaaatcatttygaaaaattaattcaatagtttttggggagcaggtggtgtttggttatatggataagttctttagtggtgatttctgaggttttggtgcrcccatcacctgasgaatgtacactgtatccagtgtgtagtcttttatcccttacccagctcctactcatacctggaagtcctcaaagtccattatataattcttatgcctttgtgtcttcatagcttagctcccacttataagtgagaacatacaatatttggttttccattcttgagttacttcccttaaaataatggtttctaattccccctaggttgctgcaaatgttatttcattctttcttatggctgagtagtattctaaggtatatagatcacatatatatcatatgtgatctatatatagatcatatatatatatatgtgatctatatatatatatatatatatagatctatatatatatagatcacatatatatatatcacatatatatatatcacattttcttcattcacccattaactgatgggcatttggggtggttccatatttttgcaattgtgaatcatggtgctgtaaacatgtgtgtgcaagtgtctttttcatacaatgrcttttttcctccagtagtgggattgctggatcaaatggtagatctatttctagttctttaaggcatckctgtactgttttccataggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctggatattagtccttttttgtatgtatagcttgcgaatattttctcccactctgtgggctgtttactctgatgattatttcttttcctttgaagaaactttttagtttaattaggtcccatctatttatcttgtttcttttgcatttgcttttgggttcttggtcatgaactctttgcctatgccaatgtctagaagagtttttccaatgttctagaatttttatggtttcaggtcttagatttaagtctttgatctaccttgagttgatttttgtataaggtgagagatgaggatccagtttaattcttctgcatgtggactgccaatttccccagtaccatctgttgaatacgctgtcctttccccactttatgtttttgtttgatcagttggctgtaagtatttggttttatttctgggacttctattctgttcaatttgtctatgtgcctgtttttataccattcccatgctgttttggtgactatagccttgcagtatattttgaagtcaggtaatgtgatgctccagatttattcgttttgcttaatcttrctttggctatgtgggctcttttgtagttccatatgaattttaggattgtttttttctagytctgtaaagaatgatgatggcattttgatggggattgcattgaatttgtagattgcttttggcagtatggtcattttcacaatgttgattctacccttccatgagcatgggacgtggttctacttgttagtgtcatctataatttctttcggcagtgtttttaattttcctcgtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaawctgggcaccttgaaaagaacaggataacagcaattttcagggaacaagggagataaccataaggtctgactgcctgcagggccaggcagaacagagtcatatttctcttcttgcaaaagcaaataggagaaatatcgctgaattcttttgtcagcaaggaatagccctgggaaaagaatgcattcccgggggaggtctctaaaatggccactctgggagtgtctgaattacatggttgaagataagggatgaaatatgccctggtctcctgcagtgccctcaggcttgctaggattaggaaattccagcctggcaaattctagtcatactggttctctgctctcgaaccctgtttcctgttaagatgyttatyaatgacaatgtgtgcccagcgggatgtggmacctcatcagtgattctagttttgccctctgccttgtgatcttttaytgccctctgaagcatgtgatccctgtgacccattccctattcatagaccccyrccccttttgaaatccrtaataaaaacttgctggttttgcggctcaggtgggcatcatggaacctgctgacatgtgatatcacccccggagacccagctgtaaatttctctcttttgtactctttctctttatttctcagactggcccacacttagggaaaatagaaaagaacatactttgaaatattgggggctggttcccccagtaaacctccttggttaggtatattcctaagtattttatttttttgcagctactataaaaggggttgagttcttgatttaattctcagcttggtcactgttagtatatggcagtgctacagatttgtgtacattgattttgtatcctgaaactttactgaattcatttatcagatctaggagctttttggataagtatttatggttttctaggtatacagtcatatcattggtgaacagtgacagtttgacttcctatttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgctgagggttttaataaaaaagcgatgatggattttgtcaaatgctttttctgcatctattgagatcatatgatttttgttttcaaatctgtttatgtgatctatcacatttattgacttgtgtgtattaaatcatccttgcatccctggcatgaaacccaatttatcaccatgtatgatctttttgatatgctgttggattatgttagcttgtattttgttgaggatttttgcatctattttcatcagagatattggtctgtagttttcttttttattatgtcctttcctggttttggtattagggygatcctggcttcataraataatttagggaggattctctcyttctctgttttggaatagtttcagtaggattggtaccaattctcttctttgaatgtctgattgaattcagctgtgagtccatgtgaayctgtgattttttatcrttggcagttttttaaaaattaccatttcaatctttctgctttttattggtctgttcacagtttctatttcttcctgatttattctaggarggttgtatatttccaggaatctgtctyctctargttttctagtttgtgcctgtgaatgtgttcatattagccttgaatgatattttatatttctgtaatatcagtggcattttcttccattttgtttctaattgaggttatttggatcctctcttttcttggttaatctcactaatggtctatcaattttatgtatcgtttcaaagaatcagcttcatgtttcatttatcttttgtatttttttgtttcaatttcatttacttctgctctctttgttatttcttttcttctgctgggtttgggtttggtttgttcttgtttctctagttccttgaggtgtgactttacattttgtatttgtgctctttcagactttttgatrtaggcatttaatgctatgaactttcctcttaggactgtttttactgtgtccgagtggttttcacaagttrtgtcactattatcattcagttcagagaattttgcatcttgatttcactgttgacccaaagatcattcaggagcaaattatttaatttccatgtatttgtatagttttgaaggtttcttttggagttaatttccaattttattccactgtggtctgagaggggacttgatataattttgattaccttaaatttgttgaggcttgttttgtggcctattatgtggtctatcttggaggatgtttcatgtgctgatgagaagaatgtatattctacagttgttgagtagaatgttctgtaaatatctgttaagtttatttcttctagtgtaacttaagtccattgtytcattgttgactttctgtcttgatgactttctagtactgtcagtggagtattgaagtccccactattattgtgttgctgtctatctcatttctcatgtctagtaataattgttttataaatttggaagctcccatgttaggtgcatatatgtttaggattgtgatattttcctgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaagatacttggttgctgaatttttatccttcctgccattctgtatcttttaagtggagagtgttaatattgagatgtgaagtactgttctatttctcatgctagttgttgcctgaattccttatttttttcctttgcattactgttttataggccctgtgagatttatgctttaaggaggttctattttggtgtattttggagttttgtttgaagacttagaactccttttagcattttgtgtagtgctggattggtagyggtgaagtctctcagcatttgtttgtctgaaaaagactttatctctccttcatttatgamgcttagttttgctggrtacaaaattcttgcctggaaattattttgtttgaggaggctaaagataagaccccagtcttttctggcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttktctgactgggttaattcgaaagkcttgttgtttgagctatgaagttctttcttctacytgttggatcctattgttgaaactttccagtgcattttgtatttctctaagtgtgtctttcatttccagaagttggattgtttcttctttatgatatctacgtccctggggcatttttaatccatatcctgtgtttttaaaaaatttatttaagttgtttttcacctttctctggtatctttttgagtagcttaaaatcaaccttctgaattctctatctagcaattcagagatttcttcttagtttggatctattgctggggtccagtgtggaggtggtaggggagtgaagtagactctgtgagaatccttggttgtagatagacttagtgtggtggctttctcaaatgctggttatgctagcagtgcagttgtcatgtgaacagaccgaagaccactggttagtcaagatttttcagccagtggaattagctgttttctcctttcttagagcagttattctgtcgtgaattgttgtaatgtcctgagttggttggcctccagccaggatgtggtgctttcaagagggcaccagctacaatagtagaaggtggatataagcttgccctaagttggccaagataaatattcagtttctcaggcaatgagtggtgtcataaagctcccaagagtttacgtcttttgtgattggctaccaggtgggtagagaaatgccctcaggtgtggacagggttaggcaggtctgagctcagactctcctcgggcggggggcttgcggcagccactgtgagggatggggtggagggtttttctccagccaatggaattatgttccagagggcattatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttgttgcgacggagttctcactctgtcacccagggctggagtgcagtggcgcgatctcggttcactgcaggctccgccttccgggtttatgccattctcctgcctcagccttcctagtagctggcactacaggcgcccgccaccacgcctggctaattgttttgtatttttagtagagacggggtttcatcgtgttagccaggatggtctcaatctcctgaccttgtaatccgcccgcctcggcctcccaaagtgccgggattacaggtgtgagcggcagcgcccggcgtacttttgtatttcatgctaaatctgtttcaggtctaggtaaagttaaatccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgagggatctgtgaagtgagttcctcaagatatttcttgtcaggtgaacagtctgtggtctctgcagggcctgtaccacccctgggcactgtatgccccacagagtgggcctctcctgtgcagggcctgggaagaggttgattataatctggtgtctgaggcctggcagcaccacactctcttcagtgagtcaggctcaagtctgagcacatctgcagagcttatgtttgctgtgttgctcatggaaggcagggaatccaaaattgttttcttagagatggactctcactatgtttcctaggctgctttcaaactcctggcctcaagtgatcctcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtcttatgtgtgtcattagtgtgtttgagatgcmycctctcctctttcctggaagttttctcctgtctsttgtcttttatgaacccrcttcctctctgttttcctaccamtttctagtcctctgcttttcagcctctttcttcatgtctgtgtttgtctggatgcaggagcacacactcagatccctgctatcctgactttgtgtacttttcttgagtgacctgacccaaaattagaacttcacccaccatgagcctccttccagtttatgtcactaacctaatgtagcatgacactcatccatttatttcactgccttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcattacttccyaccagagggcttaaaagtgctactggtcttgccttgagtccmgcctcctccagcccatccttcctacaggtgccccatccaaacacaaatctgaccgtgttactctcctgcttaagatacttcacaacttcctrtgtcctgtgggataaaatgcraacacttgccatcagcacacaaggcaggttacagtgctgcctggcccacatctcccctggcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtracctaagctgaaccaattacakctgtgtagcccagtctatacaccrtgtatttttctttttcctttgggattcatttctgtaggtgagtaatcctctagaccctaaactcagtgrgggaccctcaccatccgtgtgcggcactgaacctgctgtcacactatgcatctaagtagaggactggttctccccrtgctgggctgggaggggaaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctacatgggggtgtgaagattcaatgagtaagtttagcacatagtaagtgcccaataaatattatcttactgtattcagcattaccattatcatagacggatgttaagtcttcagggacaagggaaacaacctatatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcrgagtttgtgcagacgcacagamcctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttgggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgygcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtcttcccttggtgccccagaggtccatgaamtaatccaggtgcctgagaccatggagatgctggtctgtgccctsggcctgctggtgggcctggcgggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctccttccatcgttgaatccctggattgaaatcatattaattttatgctgcataggtttctcacaagtttcctgtgaagccaaaagggaaaataagacagataaagggtccttatttactatatactgtcttccttagcttattatgtgacagctgaaattactacgcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactcagtccagcctctctgcagactccagctgtatttacttatatctgtgccagtgacgcccaagtctgtgccttcagccccacctctcctgaaattggaggaagccggtcccccgatggaagatattatttgcaaggggagatgggcaagaggagcacagtagctttcgggaattgaccagggacaggtgcccagggacacacaaggcccagaagatgcttgtaagaagccagggagactgaaggcatcaactggatgtataagagagctgctgtgcactgattgtgtgtatcaggagtgaagaatccatcctctacacgaaaaagaaagcttacaacaaacatgtcctctaccttgaccaaaaggtgtcaatatgagacgcaaaacacataacaatgttggattgttaagaaaaaaaaaaagaccagtgtttgaaaaagagtgctacatgtattgctttgctctttccccagtggggagtcatttctgtctgtatgaaaattaagacaggaggcctaggctggtggatgaatgcagacttagacgacaaatgacgtctattggatgcattcaaaagtccaagccgtatttggttaaggagtatttgtgatggcacacaaagaaaatggttaaagtgtattagattatatttatgattttaaattctgatgttcatttaacttcttaatggtaatgataaaacatgctctcagtaaggtatatgttgaattagtgctgtgggaatatgggtcctatcaggcagatttgcagtctgctcaccattgaatagttaagaatagtggtctgagacataaatggatgagggcactaaacttgatttgggggcagctcactgaaatacagtcaattcagaagagtgtcatgtgtaacaggccccattatacaatagttaacatatccccattttcatggttctcttctttcctatgtttaaaccaaaatgaacttctttattaactcctactgtctactaaaaccctcagagaaaagtgatgagagatgatttggtgcatatttttaaaggaaaacaaacagtcatgttgggttttgattatttgtggtgctaagaagaagggaacatggttggaggcccagtgagagaaacagtgctttgaatcaaagagcagaatgatagaaactgacttcagagcaacttcttggcagcagtatccaatttggaagttgaaggtctgtcctggagccagatgctaacgaaacacagcaaatgcttttcctaaggcacaatagtcttttcagtgagctcaggaaccctgtgggggtaaaagacaagttatcccaggttgccagcctccttcctgtaagtccaggagagaaaaattatggtgagaggatgcgtctcaggctgataaataacagagttgatctctgcttccttcagcaatggagccaagcaatgctctttccccacttgcctgaaggctgacattgaaagaggggttcatgcctgagattcccttcctggaggagcctcagtgttacaatgcacagaaaggactcatatcctcctgcaacccaccccacaaggaaatcaaagcaggaatattacctgtttatgcagatcctcgttgaactgaaatgaaagacgaaaggttatataatcagccattgaaaccacctcagataattagagaaacatttccatcccaccaaattccattgcccatcactcaatggacgctccgcaggagcctgagtacttgggacctcatgcatctggctgcattaagatcccagcctgggatccctctctcgctataggtcatgtttgttccccgattatctgatatcagtggcctctagagctttctgacatttcttttctgtcaaacccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggaggttggttcttatttatttcatgttacagagcaggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttctgcccgcagagtgatgttcagaacttccaatgctatgttaaacatttccagcaacgaaggacatcctatcttttgcacaatctcaaaggcaatccacctcatttctttgaaatatatatgctatagatttttggttcactacctttaacatgtcatgaaattgattaaattctgtctatgtcttgagctgaattcagtttaaattaatatgaattttgcggagtccactaatgtgttaaccacattatatattttctgacactgaagaatcattgcattcctagaataaatctaaaattggtcaaaacgtattgtttttataatgtactgttggattcagtgacatggctaaaattagtccacaatcctgttctcctgtactattcttagctggctctggaaatataaatgaaccaacctcataaaatgatctcaaaaattctgttccattctatgttctagaatcacacgtgtaagaggcatgatctgctcctggaaatgtgggaggacgccctcatctgcaataagatcaggacagggccctttggaaggcgattctttgcttcccatgacaatttctttgatattctctactctattttagttttctatttcttcctgtagttttgacctttatatctttctagaaacgtatccgttttatctaaattttcaaatttatatgtatagagttggtcgtaagattttgcattttaaaatgtgtataaatgtcatttacccttttcgttctgaatctcctgtattttccttaggagtcttgccagaggtctcattaaagttttcattgcctcaaaatttgattttatcttctctatttttatatttcattgaattcagcttttgtccttattatttacatgtattttctttttgctgtttttctgcttttccatcctcttaattcacataattagctcatttgtttacagtcattttactctaacaaaattgtttaacagtctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttgtctcatttattatgtttcttattccaatctttatcaaagctcaatatttgtgcttgattcagtg

SEQ ID NO: 17850 - DNA, 19527 bp, Homo sapiens
gcatggtcgtagctcactgcagcctcaaattcctgggctcaagctatcctcttatctcagcctcctgagtagctgaggctacaggcatgtgcctctacgctcagttaatttttaaatttttttgtagagactgggtctcgctgtattgcccaggctggtcttgaactcctgggctccagtgatcctcccacctaggcctcccaaagtgctggggatacaggtgtgaaccactgcactctgcctacttttatattattttaaaatttccttcacatgtgttggtactcatagaacagaattgcgtgagtcaaattagtgaccagtagtgacttctacaaaagctttcattacttcaaaaccactgataatgcagccatagaaagtatcaaccaagaataactaaatcacttaggtataaaactcgcagattccccaaagacagaaaaatcttcgaccctataactgtgactacctgagaagtggatacagcttttctggaagtcatagaaaaacatcttaagatcacaaagtctcctgataaaaaccaaaaagcttgcaggtgagcagtctgggtatataagaaaaaacaaaaaaccaaaaagctctactcagacaaaccacctactgtgaagttcacaagaatttgctatttcagagggaataaaggatacagcacagtgtcaagaccaagctaagccaatttccagcccttcagtttcccctctcttttttttttgagaaggagtctcgctctgtctccaggctggaatgcagtggcatgatctcggctcactgcaacctccacctcccaggttcaagtgattctcctgcctcagcctcctgagtagctggaactacaggcgtgcgccaccacacccagctaatttttgtatttttagtagagacagggttttatcacgttggccaggatggtcttgatctcttgacctcgtgatctgcccaccttggcctcccaaagtgctgggattacaggcatgagccaccttgcccggccccctctccaaattcttactcctgttatctacaagatccctttcaaagttaagaaaaatgataaaatacaatactcttgagattatttgctttttgtcaaatcaaaatctttgcccaaagattaaggcaatgtctggtaggtatgtggggaggcagcaagactgtaatcttgaacttgaatgataggggttagttactgtcaccctgcttgccgagtgtcatgcaaggatgagatgagaggaacacaaagaaccgtggatatgttgttgaagccgaggcattttgtgggcttctcaaatgagcaggaataccctcccagagtaaaatgtggtcaatacctttgcttaaagaatgatttggaaaagtgcttcttcccaagacctaaaagatgaccatatttagctttggaacagtttgttccttttactttaaatggaagagcattttctttcccataagcattaaatacagtactatatctccatttttaagtagttttaggctgggcgcactggctcacatgtgtaatcccagcactttgggaggctgaggcaggaggattgcttgagctcaggagttcaagaccagcctagacaatacagtgaaaccccatctctacaaaaaatacaaaaattagtcgggtgtcatggtgcatgcctgtagtcccacaactcaggaggttgaggtaggaggcttgcttgagtccgtaaggcagaggttgcagtgagccgagactgtaccactgcactccagcctgggtgatagggccaggtcttgtctcaaaaaaaatttaaaaagtagttttagggggcaaaaaactgggatcccttttctgaccaggctaaagcttccttcattgacgcatgcaatttttttttttttgagatggagtcgcactctgtcaccaagggtatagtgcaatggcgcaatcttggctcactgcaacctctgcctcccaggctcaagtgattctcctgcttcagcctcccaagtagctgggattacaagcgtctgccaccacgcctggctaacttttgtatttttagtagaaacagggtttcaccatgttggccaggctggtctcaaactcctcaagtgatctgcctgcctcagcctcccaaagtgctgggattacaggcatgagccatcgcacccagccagactcatgcaatttttaatgtatatttagtaatcataataactgtgttggaaggtttaataaaagaaagcatactgaaatacttttcctggggaaaggcaatgaccacacatttcttaaaaaaataaaattggttatttatacacaagttcccctacctccatctctttaatctttgtactgcttgtgcctagcaagaaataggtattctgtcaggcacggtagctcacacctgtaatcctagcactttgggaggatcacttgagcccaggagttcaagattagcctgagcaatacagtgagatctcatctctaccaaaaaatttttcaaaaaattaatgaggtgtggtggcacgtgcctgtggtcccaggtactcaggaggctgaggtaggaggcttgcttgagcccaggaggttgaagctgcagtgagctgtgatcacaccactgcactccagcctcaatgacaaagggagactgtcgaaagaaagaaagaaaaagaaagaaagaaaggaaggaaggaaagaaggaaggaaggaaaaaaatgggtattcaattaaagtttgttaaataaaaacagattttttcttcctaatgcatgttttctcttcatttttcttatctgaagtcttcccttggaatataagtaagtcttcctccttcccatttaatatctcattgcctgattgtttttcagtttaaacaacaggagaatccaataacaaatatttaccaatagctaagagttactgaaagtgccttcttagttataaaaagttaatccatttttaatgtaaggcaagaagttcacaattaaacctaagaggataatttactatagatagacgtgaagtacctaaaaagaaatgaatatccaatctacacctatataatggcaaaaattagaactagagtttcagagtcagaggggacattaatgtcaggtcggcaggtctgggctcacatccaatccaaaccaagctttgctgagtgtcccttccctccactttctcctgaatcattcccccttgggctaggagtttccaagaaggcaaataaactaagataagcaacaagagcaaagaatggcaactcaaatgtgcagttcaaggctttgaatacgaattttttttaacactaatgaaaaaggtagtatcatagctcttaaaatattgaaatacttctctctgtccagtatcagcagataatgcagaaaagcccattgggaacatgttcctctccttcaaatgccacttagaaagcttcatcattattcataaatgatgaatagaagtctgggcatggccgggtgtggtggctcatacctgtaatcccagcgctttgggaggctgaggtgggtggatcgcctaaggtcaggagttcgagaccagcctggccaacatggtgaaacctcgtctctactaaaaatacaaaaattagctgggtgcggtggcacgcacctgtaatcccagctactcaggaggctgaggcaggagaatcgcttgaacctgggaggcggaggttgcagtgagctgagatcgcgccactacactccagcctgggtgacagagcaagactccgtctcaaaaaaaaaaaaaaaaaaaaaagtagtgtttacaatataagggaaattgggatcccatgttctaattcaaagaatttaaggctattaaccattttaaagttctcatgtttaagcttctcactttatccttctttattcaagaaaatccataatacaaagtattggcaaagatgtgaggaactggaactgccatacactgctagtgggagtggaaattggtgtaaccactgtggaaaaccgtttgacggtatctaccaaacctgaacatatcccttccctatgatccaggaattctacttgtgggcataatcctttatactggtgtttatgtccaccatatataaaacaatgttcacagcagtgctatgcataattacacaaaattggaacaacttccatgtgcttcgtgaacataatggataaaataaattataagatctattcataccacggaatggtaccagcaattaaaaaaaaaaacactgctacagagaacaaggttgaatcttattattataatgttgagtaaaagaaggtggacataaaagagcacacgatgatggtttggtttacatgaagttcaaacataggcaaaagcaatccatggcatcagaagtcagaatagtggctacctggggagggggtactgacagagagggtggagctagaattgctctatatctcagtctgatcgtggttatttgggcacgtacatatgtgaaaactaatgaaattgtactcttaagatgtgtgcatatttactgtgtgccaattatacttcatttagaaatatctggagagagagacatagaaatttctgaattctttcctaaatagaaaagaattccatgcagcttaaatatcgttgcaagtattgatgcttatacctttagaaagcccattatgcttctgaaaaatgcacttactacttaatatcatacataatagaaagctaacattttgtattaacggaatctggaaaacatattgtactacacatttgaaattacagatttactaactagtaaagataactatttaagaactaaaatgtctttgtttttcaactcttttcccccgatttccattttttactttttatatttcagaattatttgtaacaaaagctattggatataattcctgcacttctatattgcaagcattttctctatttaccacagagacttcaagtcctagcatttcagagctgaaggggactcggacggactccctcactgcacagatgaggacgcggaggccgggggaggtgagtgtcagtcccaaggttgcagacctaggacagggaccggagctgccgggcacccagaactctgtcgccttcaacccaaattcgattcagtcctctcatctttccaaatagaaagctgacgcgaaccgatgggaagattttttttttcaataacaactatgctacccagcagattctttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctggcgccgagttcgcggccgcagactcccacggacggcccagcacccgagcgcgcgggccgagctgccccagacccggcgcagcgcctcggcgaggccgtctgcgaagtccgggccgccactcgggaccgcggcccgagccagaggagagacttcggagaagagggaagaggacgcggggtgggaaacgccggggccgcaggcaagtagtgggcgagtccggagggcgcgaaagaggggaggggcgcgggaggcaatggaaggagcgagcgcggggaggagcgaggcggctgggccggaggaggcgcgcgcccgggtccacactgcggggtgggggctgagggaccgcgaggggctgcgagcgagcgagcggggccttaccgagcagcggcagctggccgccgtcgcgcgccaacgccggcatggcctccggagcccggggtccccaggccgcgccggcccagccctgcgatgccgcctggagcggcgcgcctcgcgctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaagaaccattccattcttaattgtggactgatttcctttgtctctgcctccatctcctaggatgctcaggacccagtcagcggcgggatcaagaaaaacaggcagggtttcaatgtcaaccaaggcaattagggaggttaacaaacagccttcaaaacaaaacacacagaaaatacatcccagaggatgttgcgaatcatccgctcaatagttcttgttcttcatcgcataatttttcgagttgaaaattattattattttctttgcaataagttgaggattggaaagctctggatgccagttctggttcttcccttacttaactagccgtttgacctccacaaacctctgtttactcatcgtaaaggaaagggatggaccaaatggttcataatgtctctcccaattctaggaattccacgctcttaattattttaattattttctaataaagcatgaaaattgactgtttactcttggccatacagttcttttccttagatgttgtctacagtacaataattctttcccctagggtatggcagaaactttagaagtgtctaccatggtgcagccactatggaaaacactatagaggtttctcaaaaaattaaaaaaaatacggtccaacaattccatttctggccatgtagccaaaagaattgaaagcagggtcttgaagagatgtctgtacacccgtgttgaaagcagcattattcacagtagtcaaaaggcagaagtaacccatgtccacaacagatgaatgataaacaaaaatgcagtatatacatacgactgagtatttttcagctttaaagaggagggaaattctgatacagctaaaatatggatgaatcttgacattatgctaagtgaaataagctagtcccaaaaaatacaatactgtatcccattacaaattcataaagacagaaagttaaatggtggttaccatgggctgggggcagggggaaatggggagccagtgtttaatggatacagagtttcagttttgcaagatgagcagagttctggagactggttgcacaacaatgtgaatgtacttaacgctactaaactgtacacttaaaaatggctaaggctgggtgcggtggctcatgcctgtaatcctagcactttgggaggccgaggtgggcagatcacctgaggtcagcagttcgagaccagcctagccaacatggtgaaaccccatctctacaaaaatgcaacaattagccaggcgtagtggcgcatgcctgtaatcccagctacctgggaggttgaggcaggagaatcactggaacccgggaggcagaggctgcagtgagctgagatcacaccactgcactccagcctgggtgacagagtgagactctgtctcaaaaacaaaaacaaaaacaaaaagttaagatggtaaattttatgtatgtgwattttacctcaattttaaattttttaagtttttgtgtagctgctgggggtttaaaaatttttttaaagagtgttgtgtctaccttaggtcagaaacagaagtgaaggaagatggcctgaaataagtgaaacatgaggagataaagcaatgaaacaggctggttatggggagaaaagcgagcttccaatggccaagacctaacacactaccttctatttaaarctcaattactgtcttaaaggaaactgattggctgggcgctgtggctcatgcctgcaatcccagcgctttgggaggccaaagcgggtggatcatttgaggtcaggagttggagaccagcctgaccaacatggtgaamccccatctctaacaaaaatacaaaaattagctgggcatggtggcactgtagtcgtagctactygggaggctgaggcaggggaattgcttgaacccaggaagcagatgttgcagtgaactgagatcatgccactgcactccagcctgggcaacagagcaagacttggtcttcgccgggcgtagtggctcatgcctgtaatcccagcactttgggaagctaaggcaggtggatcacgaggtcaggagttcaagaccagcctggcaaagatggtgaaacctgtctctactaaaaatacaaaaaattagccaggcgtggtggcatacgcctgtaatcccagctactcaggaggctgaggcagagaattgcttaaacttggggagcggaggttgcagtgagccaagatcgcgccactacactccagcctgggcgacagagggagattccgtctcaaaaaaataaataaataaaatgaaaaactaaaaaaaaaatgaaactgattattacaaatttgcagaacatcagcttgagtgcagcagtattcaggatacaaaatcataaagatactgctgctttgtccaagaatcttggacacaaggcagagatcttcatgaaaaagggggttggtgagagaggagaagttaggaatggtttctttttttgagacagagtcttgctctgtcgcccaggctagagtgcagtggcacgatctaggctcactacaacctccgcctcccgggttcaagcgattctccagcctcagccacctgagtagctgggattacaggcacccgccactgcgcccagctaattttgtatttttagtagagaagggtttcaccatcttggccaggctggtctcaaactcctgacctcgtgatccaccctccttggactcccaaagtgctgggattacaggtgtgagtcaccgcggccagccaggaatggtttctaggaacacttgattttccgtggaaattggtggaaaaaataattctagaaggagcaaatcttatagactgaaatattttggagtatgaggtataggctaacagaaggtgaagtaatgcccatgtttttctgwgatgtgccaagagtcatatctaatatgagaactaatttcttcctcacagcaacacttaaggaaagtagcctgaaattgtctagagtcctggattacacgcccaggtatgcatgcccaagtatgaaattttggtgtcagagttcatgataggaattctgtaataaagaaactcttaaagggtcaaaagcaactagaagaaatkagctgaaacgggaaatcggaaaagagaagagtaagtttgtttctgggttgaatggagtgtctagtgctaactctacgaaaggatgtattttatctagattcttagcaccatgatgcttagccatgagtaagtggtcatctatcttaccagcatcttgataccatgtttccaccccttaagtcacacaaatatctcctctccctttcctctctctctccaaaaattgtgacataktttcgtagcagctcacaggtgaaatactttcatgtcatttttaacttacaaagccttatgttttcctgaaaatcagggacaaacaaaaggaatatttgaatagggttcatgtgagttcagttgagatatcaactttatagtataattttacacatcttttattaataggggctttgaactcaccaattggcaaaatctgacaatacaaagtgttgacaagaattcagagcaatggagaacacccacacactgttggtggacatcycaatgggtgtgagcactttgaaaaataattyggcatmtcttactaaagttgaacatatcctccagccagcagtttcacccccagatataaacctcaaagaaacacatatgtgccaagagacaagtataagaatgttcatagcattattgtttataatatcaaaaaattgggaacaatctaaatgcccaccaacaaaaggataaattgcagtacagtcataataaaatacctatatattaaataacagtgtaaatgaatgagctacagttacctgacacaccatgaatgaatctcaaaaacataatgttgagggggaaaagcaagtcatggaataatagacataaaggcggaagcaaacaatattctccttaggaatacattcataggggtataaggaaagtaaaggaataattaccacaaaagtcaggattgtggttacgtctggtatggggtgggaagaggaggtttaattagagaagacaaactggggatttctgaggtgctaacwtaccctattgttgttttgcgatagggtcttgctacactgcccaagctggagtgtaatggctattcacaggcacgaccatagctcactgcagccttgaactcctgggctcaagcctctgggtagctgggactacaggtgtggaccaccatgtccaaccacaccctattttttttttaacctctgtggtgggtgctggatgttcattttattgttattctttaaactatgtaattatttttacacactgctgtgaatatgatgtatttcacaacaaaagaaaattaaaggccgggtgcggtggctcatgcctgtaatcacagtattttgggaggccgaggcgggcggatcacaggtcaggagtttgagaccagcctggccaacatggtgaaaccccgtctctactaaaagtacaaaaattagccgggcacagtggcacgcacctgtaatcccagctacttgggagggaggctgaggcaggagaatcacttgaacccaggaggcggaggttgcagtgagccgagatggtgccattgcactctagcctgggcgacagagcaagactccaactcaaaaaaaaaaaggaaaattaaagaagtttgaggccagtcacagtggctcacacctataatcccagcacttcgggaggctgagataagaggatcactgagcctagaagttacagaccaccctgggcaataaaatgagaccccacttctagaaaaaaaaaattaaaattagccgggtatgtggctcacacctgtagtcccagctattcaggaggctgagtcaggaggattgtttgaacccagaaasttgaggctgcagtgagctgcgattgtgtcactgcacttcagcttgagcaacagagcaagatcttgtctctaaaaaataataattaaaaataaataaataagtttgacacattttcacctacaagtattcttatacaaacaaatgatatttgaatctgattaagattccagggcctggtggygcacacctgaagatcccagatccaactaccaatttataggaaatacatgggatagtggaatatgggacaacacagggacataattttaaaattccaaaggccaggtgcagtggctcacacctgtaatcccagcactttgggaggctgaggggggcggatcacttgaggtcaggagttcaagaccagcctggccaacatagtgaaaccctgtctctactaaaaatacaaaaataagctgggcatggtggcggccgcctgtaatcccagctactcaggaggctgagacaggaggatcgcttgaacccagaaggtggaggttgcagtgagcccagatggtaccattgcactccagcctgggtgacacagcaagactccatctcaaaaawatataaataaataaataaataaataataaataaaataaaattccagaacctaggaaactgtatggaacaaatatcttggtttcttcaacgaaaatttgtaagaaaataaaaaaagagatggagcctataaattaaaagaaacctaagatatattaaggacattacaatatcaagcaattgtaatgtgcaatgtaaagatgttatttggatgctgattcaagtaacccgaaaaatatacataaaataattgggaaaatgtgatcactggttttaattttgatattattttataaaaaattatatgtgtgtgggaggctgaggtaggagaattgcttgaaccccaggaggcggaggttgcagtgagccgagattgcgccactgcactccagcctgggggacagagagagactctgtctccattaaaaaaaaaaaaaattatgtgtgatgatagcattgttatatattttaaaaatcattcctatctttgcagaggtacacatgaaatagttacagaaaaaatgatatgaaatgggaaggttgagggggaataaggagtgacagttaatgggaacagggtttctttttttcggatgatgaaactattgtaaaattagattatggtgatggttgctcaactctgtaaatacactaaaaaccactgaattgtaggctaaataggtgaactatagacatgtaaattggatctcagtgaagctgtaaaaaatgacataaagccagagattttcttcaaaatcatctgatgtggagggtttgagtggagcaatcaaaattaaccatgtgtcaccagtagttgcacctcagccacagtcatataagttcattatactttttattagacattttctataataaaaggttttgaataaaaaagatttgaagaaaaggccgagccgttgcgtacctaggatgccatgtggaagctgaagctgcacctcccgcgtgacccctctagccagctgggcccctcagatgagagttgcatccaggccagcactagccgctcagccaccagcagcggcacccccatctgcagttggctctcctgctgctgtgccccgtctgatggcccaaatggcaaccactgcagctggcgcggctgtgggctctgccgtggggcacacactgggtcacgccattactggggggtttagtggaggaagtaatgctgagcctgcgaggcctgacatcacttaccaggagcctcagggaacccagctggcacagcagcagcagccttgcttctatgagatcgaacagtttctggagtgtgcccagaaccatggtgacatcaagctctgtgagggtttcaatgaggtgctgaaacagtgccgactggcaaaacgattggcctgatcaagaagttcaacctggagaaatggaaaatcagctctataaccaagttaatttagtataaaaatcaaattgatagtgaaggtataaagtgtaaccatcagttaaacctcttgtgtcattcctagcttccttgcttctgaattgaaatggaagggggtgttcctactctgtagaatttggggctgggcaaatgtttgtgtggcctccttaaaagagctgttatgattttattctttgtgagttaattagaataaagtcattttcttccaagggaaaaaaaaagatttgaaatattggacaagttaacttatcctgaatgtgtggaagatgactacccctgcttagaactcatgagctgctctttactgtgtttttattaacccatctaaatgggatgaacaataacaggaccctggaatctgtttccattatgcaattggtggcacacaggtaaactgcaaaattccaactgcagaatttcataattgatagttcttcctttatgtctaagatgatttcaaaataatcatctccttagaattattcgcaacagataatgtattagtttgctggagctgccataacaaagtaccacagacacagttctggaggccagaagtccaagatcaaggtgttggcagggttggttctaagggctgtcatggagaatctgttccaagccttgtactggcttctggtggtttgcaggcaatatttggtgctccttggcttctgctacatcaccccgacctctgccttcatgttcacgtggcagtctccctgtgtgtgtgtctgtctagcgctgcatttgaatttccccttttcataaggataccggtcatattggattaggacccacccaatgacctcagtgtaacttgattacctctgtaaaaagcctatctccaaataaggtcacattctgaggaatatggggttaggacctcaaaaatacgttttttaggaccacaaaaaaattgtgtcctgttaagggacacaattcagcccttaacggatagatttcaaaatcaatagaaattaattcatttgcttcacctatagattgcttgttaattgatatattaagtagatttcaatttgatattttacttttacaaaaaatattgagcatgggtaacttttagaagtcaacacaaaaatgggagctgttgaaaattttgctttcaaagagtttaaggttaaaaaagggtacaaactacatgacatgacagtcattaaattttcagaaattatgtatatgcctactcaaataactagaagataatacactaaaatgcaaactgattatctctgactcatggccttattagtgagatggaactgatttctccatcagaaatctaaggctcagagctgttaggtgacctacctaaagtctcacagccagtaagaggctgaatgtgattagaattcaaattggctcatatccaaaacccctgctttcagccattatggcttagaataataattgccaccatttgagttcctaaaatgtgccaaacattataccaatcactttacaatctttgcttcacttaatactaataacaatcccataggttaggtatttttcccattccaaagaagtctaatagcagcctaaactttgaagcaggagagatggatgatccagaaagccaaaagagggagttcatggaaagaagacaagttacaaagatggaggtatctgtggtaaggcgagttggcccattttacactgtcaaaaataactaaggacataaggggtttgaacaaagtaattaacaaggaaagagtgaacacatttatgtagaatttatatcctacaagcagacaaaacatcttctttttggacttacatggcattttataaatatagttgtgtgtcacttaataggacaggttctgagaaatggattgctaggcaatttcattgttgcataaacatcagagtgtacttacacaaacctagatattagcctactgcatacccaggctatgtggtatggcctgttgcttctaggctacaaacttatatggcatgtattatactgaatactgtaggcagttgtaacacaatagtaagtatttgtatatctgaacatattgaaatatagaaaaagtacagtagaaaaccagaactataatcttttggatcattgtccatcttgaccaaaatgttgttatgcagcacatgactgtactacactctctgatcacactaggctttttccaaatatgctttttcttcccttgagctgggacatggatgtcacagtaatcccattttgacaatacgtacatgaacaacagcctagggtatggtggaacaacaatatagaaggcattagatttgcatgagcaactccaaaacctgtactacctacatccctctagactgctgcttaagagaaataaacttcggtctcatttaatccatggtgcttgggggctgtctgtaacaatagcttactttgtaccctgtttgcatagccaccactcctccacataaacccaagttagagtcacagtgaaccagaactccaaattcattatgttcttcttgtttccatgtcttgatacctgtgttggtatctgcaatgacccatgcccctttctcactatttcccttgccccttccagtctatgtgaccaactctgattcaccttctagattcattcctgactactctatcgctatccccccagccacatgtgactcaggtacatcctcttgtttctctcctctgtctgtcccactgtactacagttcttagcctctatgtttgtccaactgttgcctgaacctcatcccccaactgttactcacacttgcattcctagaccttaacacaacgactagtacccagcatgctctcataaatcaatgaatattcattgcatgactggtgaatttattgacgagtttcttcttttaattttatcttatttattttatttttgttttgttgttgttgttggtttttccaccagaggatattgacaagtttctaaaaaaaaattttgtttttttgagatagggtctcacattatccaacatgccgaagtggagaggtatgatcatagctcactgcagccttgaactcccgggctcaagcgatcctcctgcctcagcctcctgagtagctgggatgacaaacccacaccaccacacctggcatatttatttatttatttttatttttatttttttgagacagaatttcactcttattgcccaggctggaatgcaatggcatgatctcggttaatggcaacctctacctcccggattcaagtgattcttctgcctcagcctccctagtagctgggactaaaggcatgcaccaccacacccggctaattttgtatttttagtagagacagggtttctccatcttggtcaggctagtctcgaactcctgacctcaggtgatcctcccacataggcctcccaaagtgctgggattacaggcgtgagccactgcgcctggcccctatttatttatgtgttttgtagagatgaagtctcactgtgttgtccaggctgatctcaaactcccagcctcaagtggtcctcccaccttgacctcccaaagtgcagagattacaggcatgagccactgtgcttgaccaaaaaaaaaaaaaaaaaaaaaaaactgtttaatatggaaattttcaaacatacacaaaagttgaaagaataatataatgatacatgtatccatcactctgtttcaacaatgaccatcattttgtcattcctgagaatgagtagagctccagagtgcagtttttggagacaacgttttaactaaaaaggactacttcaattgggaatttttttttttgagacggagtcttgctctgttgcccaggctggagtgcagtggtgcgatctcggctcacttcaagctctgtctcctgggttcacgccattctgctggcttagcctcctgagcagctgggaccacaggcgcccaccaccatgcctggctaattttttgtatttttgtagagacggggtttcaccacgctagccaggatgatcttgatctcctgacctcatgatccgcgcccctcagcctcccaaagtgctgggattacaggcgtgagccaccgcgcccagcctcaattgggatatttttaatcactgtggcaatctggtaaggaggtattttcaggatttttattttaggggataagggtcttcaaatcaggatctgcactttaaaaaaacagtgtaggccgggcgtggtgactcacacctgtaatcccagcactttgggaggccgaggcaggcggatcacaaggtcaggagttcaagaccagcctggccaaaatggtgagaccccatctctattaaaaatacaaaaattagctggatgtggtggcatgtgcctgtaacctcagctacttggagggctgagacaggagaatcacttgaacccgggaggcagaggttgcagtgagccgagatagcgccattgtactccagcatggcaacagagcgagactccgtctctaaataaataagtaaaaaataacagtgtagaggcaataagagaaatagttattctttattcccaaaggtatataatataatattgcttgacagtcacataaacaaatatttgcaccaaagtgttacagaggttttgataaaagcatgtgccaggcatactagggtcacagtgaaaaatgtgctccataaaacattcccttcactatggcccttagaaaccttggtttaacccaaggaaactgcttcctttgtagctctttcaaatgctacagaggaagcagttggggaaaattcttgtttccccctgttccatatatgatgaagcctggaatattggcattcttttagttctccattgctacttacagatcattacctattttttttctattaaaaataatactcttggcggggcatggtggctcatgcctgtaatctttgggaagtccaggcggacagatcacttgaggtcaggagttcaagactagcctggccaacatagtgaaaccccctctctattacaaatacaaaaatgggccaggcgtggtggctcatgcctgtaatcccagcactttgggaggccgaggtgggcagatcacctgaggttgggagtttgagaccaccctgaccaacatagtcaaaccctgtctctactaaaaatacaaaattagccagatgtggtggcaggcacctgtaatcccagctacttgggaggctgaggcaggagaatcacttgaacccgggagacggaggttgcagtgagctgagatcacacgattgcactccagcctggccgacaacagtgaaactacgtctcaaaaaaaaaaaaaaaaaaggtggtgcacatctgtagtcccagctacttgggaggctgaggcatgagagtcgcttgaacctgggagcccgaggctgcagtaagccaagatggcgccactgcactccagcctgggtgacagagtgagactctgtctcaaaaaaaaaaaaaaaaaagaaaagggagtattctttttctagcataagtgtacatgttaaatgcaaaaaaggaaaaaagttggaaagtatccatacgcacactcacactacctgtaccaactgataaccatttacacttcgatgccagtctatccagttttttctctatgagtatatttatacatagatctaaacatatattttatgaataggattatcatacacatgctccttctttgcttacttaaaaaaaaaattgggctgggcgcggtgactcacgcctgtaatcccagcactttgggaggctgaggcaggcggatcacgaggtcaggagatcgagaccatcctggctagcacagtgaaaccccgtcactactaaatatacaaaaaaaaaaaaaaaaaaaattagccgggtatggtggcggacgcctgtagtcccagctactccagaggctgaggcaggagaatggcgtgaacccgggaggcagagcttgcagtgagccaagattgcgccactgcactccagcctggggaacagagcgagattctgtctcaaaaaaaataaataaataaagtaaaataaaataaaatcggccgggcgtgatggcttatgcctgtaatcccagcactttgggaggccgaggtggacagatcacttgaggtgaggagttcgagaccagcctggctaacatggtgaaaccctgtctcta

SEQ ID NO: 17851 - DNA, 12762 bp, Homo sapiens
ccaccccaacgcccctgaagggagttgatggtgaatgcagtggtgtcttacttacttcagaagtgtaactatgaaagagagaagctcctcctgaagctgaatgaggctaaagaaaaactagtaattccagtctcattcaaaagtcatgatctataacctcaagcagttccttaatgccagctagcaactgaatttccagagtctattctcaatttcattcacctagttaacaccaggcagtccttgctttgccacaccagtaagtgccagtcataaaactgaccatgcaagctgaaactatgcaaaatgatcttaataatcaatggggaaaaaattacaactgttctgtgacctttaaaatctttcgtcaaaaccctaaaactcacttaccattggttattaatgtataggggaacaaaaaaaaacatttatttagtacattgttacttaaaacattgggattttaaaagaattagtgttttatttcttcgcaaactgaattttatatatcacgaattaaaaatataaattccttttgaaagcttgaaacttagggtaaaaaaaatttccaaatatttccaaagcaacaaaacagtatttatatatgcttcaaattctgtcagcacaaaactctcccaatagaaagggtcaagcatgcaatttttcccatatactttcaaaatttctaaaagatgctgttttccttggacaccacattaactataaaaatggacaatgacattttccctctaaaattactaacaatataatcctcatttctagaaaaagcctttgttcaactaatgaataagccctcattgagatgctaaatcataggatgcactgtagttcccctgaaaaggccaaacagcatattctttcacaaacaatgagtcatgggtgtagaatattcggcctatttaaaacaaagatcagctttagatctattgcctttcttccagttcctctgccagcctcttgcttttgttttgttgttcaagacacaaatataaatagtacatatattgtgactctaactcaagcaggaaatagctctagttaactctcaatcatccactctttcaaggaggaatatttacagttcagattctctgtcaacagaactaggcataaaatactcactttttgcaccctcactacctccaacagggtacccctcagccttatgtgactagcagctcagaaacttaactgcaaacatccaaggccttggctatgagatgaccctctaatagtcaaaactggatggtaatccctccaataatatgccatgaatcaccaaagccaatttttaaaaatctgcattaattgaatttaaaatagaatgacttctatagaataatattattatgcataaaaattatttttgttagtatccagagtatcatgaggtgggggccttgtccatgaaaatcgtcatttattcccaaagttgcctacatcaacaaggattcactgatggagagtagaagaaaggataggcttttttttttttcttttgagaagaaatgaaaagtttggagacaggaaagaactccaaatgttcttcctcctaattccagtggatgggaggccgtttctcccgggtaccaattctcatgtcttcccaatccccatgtctaatttctgttttgggagggtaagtgggcataagaaaagcacagagtgattgtccctagaaagaggaggaagttgaaaatgaccccactttccacaagcactcacaacactgatctctctggaaacagagatgaggaagagggccagacatgtcccttctcaccccatgggttttagaaagaaagggttactattggcagccaaaggataatgggagtcaggtcaaccagagaaatgttgctttattattctgatcaatgacaaacagaattactagactctaaagtgtttaaggcagaacctttgccctattcattattgtatggatagtttctaaaagtgtcttgtacagattaggcactcaaaaaatgtttattaacaaattaatcagttgttaaacctgtaaaacttacaactgacacttggaatgaaaacttgtaacatactaactttaagtgaccattatttacgtgtatttgacttgggactatacagctatacacaggggtgaatgggtgactaggccaaagaacatgcgaatctcttttcctttctttagttcccaagctgtgacaactgaaaagaaatattgttgcagccagagtaatagggctgaggcttctcctgtgatcacagattctctcctctagcaatcaaaagtctaccccttatcttcaaggttcaagtcaaattccacctccccagggaagtcttcctaaatctccctaaagctccctcactgaggtagtatgcactaccccagggctttgataacatttttgttatagcatttaccacattttgactctctattactgaaaattcccctgaaggtttttaatcttcaggggaaattttaaaattctctttcctgtatattcacaaaccaataaatacttgttgaatttaatttttcagccagtatgtggtttctatgcctcttttcaaaggtcatccattaaccaaagacctataaactgctggctcccataacctccttttagccttcattccacctacaataaagaggaattgtctaacactttaaattgtttctacggcaaagtgtgttctaaattcctaactgctttacagattgactataacatacagaacattcaaaattaacagctgtgtacacataaatctcctaatcatatgtcaatgttatttttaactgcattaatttattaagcaaacaattaagaaaaattattatataccaaacaaagggatacaaaaataaatgacatagaacatgcactctcaagagctgtcagtctagctgaggtgtctgacatgtaaacaagcatggcatttaagtaccaacttcccaagtgttaaggtctcccggcaatcatccacagtttattaaacactggttgaatttaatttactcatccagtcaacagctggtttccttccatgcctctcaaaggtcagtcatatgatcaatgaccagtaaaccactggattcaaaagatagggaagacttatcaacacataaacagcagtaaagagaggatacccagaactgtgaggtcaggaaaaaattctaggagattacacctaagttgtattatcagcttggaggagagagaatgtacatgctgtatatgctactagcttaaattaaaattctttgggtattttgcttgtcttgtttccaaatgccccctctctagagctcaggcaacagagcaagattttttggtccttagtagttatttcatccccttgcctcttcaaaatttatcttctctttaatcgaccaatacttgatgagttaatattaaaaaccttaattttgtctgtaataacccaaccaaaatgtccattaacaggcaaatgtattaacaaatcatggtatccacacaacagactactatttatcaacaaaaagttattaacttttaatacatacaacatggacgaatcccaaactatttatgctgagttaaagccagactttcttaaagagtacataatgtataattgtgcttatataacatttcagaaagtgcaaactaacctagagattagtgcaagagggtagcggggagtagaggagagaagaattacactgaaagcttttgggggtgatgggcatgtttattatcttaaatgctatgatagtttcacagacataaacatatgtcaaaagttatcaatattataaactttatatataagcagtttattgctatcaatttttcctcaattaagctgttaaaagagtaatactgactacagagatgtgacactcaaaggcaatgtgtagaccctgattaaatcctgtattaaaaaaaaaaaaataggagacatttttgtgaagtaattggggaagtgtgtccacagactatacatgaaggtattattaagtcaatatttaatttataggtgtaagagtataaatctgtgtaacctttttaaagagatatctggcaatatgtatcaaaatgcaaatgtctgacaatgctacttctaggaaattaatcttaaggaaataaccataaaaatattgaggggagaaaatatgtgcaagaatgttacctgttgcaatttttaacagtaaaaaagaggaaacaatctatacatccattagttggcaggctggtaaataatacatttatcaaggaaacagcagaattttatgtagccatttaaaggaaaaatgtagagctatgtttattgacacagaaagagatctaagatataactgtacatgaaatttaaaatggtatatgagatctgaagggctattcataaaaatgttaatggtggtggacacatttcatcttaatatacttaatttacatacaagaatacttaatttacttaagaaaaatacttaatttacatacaagaatagccattttatatagtcatttcccaatcagcacaaaaatatttttatttttactttttatttgtcagccatgatcaatcaagatatttccaactttaaaggaaaagtagtttagaaccattaacttttagaagagataagagatattagcaccatgatctaacaccctcattttatacctgaagaaaatgagaccaagaaaaagtacattacctgtataaggttataaagctattctaacatatcaccttgatttcatttctaactcttttcatatatatgccatgcctcagttctttgacatattacctcttgtgccttctccctaccatgtaccaagaccactaacttgtatgatcttgagcaaacaaattaaaccaaaaaacagttttaactagtagatctacaagcttgcctataaaaaatgattctaagaagtctctagaagctaaaaccagtaaaatccacatctataaattctagacttttatgttcaaatataaatacaagatagcaagactgcttatggagattatctaatcccccaatttataaatcatgaacagaatataacatgtctttaataaaccagatctcacaatgcctctttagaagcagctttttagagggccagagtcctggaccaatgtcctcaggcactcttataaggtcactggtacaaacataaatctatgaattatgctatcagagatgtgaaaggctgaggtttagctccgagtatctctaggacatacacgcacacatactcctaaatgctatttcttctagtttttctgtaactcatcacttataagagttgagccttggccaggcatggtggctcacacctgtcatcttagcactttaggagtccgcggcaggaggatgacttgagctcaagagctcgagaccagcctggcaacacagtgagacctcgtctctattaataaatatatatattttttaaagtgagcctaaaatataaatttgctttttcagtagtaaatatggctcaccttcaaaatcaatgataccaaaaataactttttttttttaatccttactgtcattgtctctattgtcattaagttcttggccttttagcagcctttaaactctcctaactcagaatgtaacagaaataaagcactggagtggcagccaaaagacatggatccatgtcatactgcacaagttttataactctagacttcagtttccgtcatctttagagtgttgaatctagtgccttttacaatactaaaattataaaattccttactcaatttatttgtaaaacaaaataaaagatagttctcaaaagaaaaaacaaaaatttcaaatataattttacttgttagggtgactttcaaagttgctttacaacatgaaagctttttttattttcatataatcatgtatttctgatagccattacagtacattgacctccatggagacagtgctggggcaaatggcagccagatgtgcactaggtgactctgtgcttctctgaggaaaaataactaaacttggtaaaagaagatcctaagaagccaagaggcaaaaggtcatcatatgcattctttgtgcaaacttccaggaggagaacaagaagcagcactcatgcttcagttaacttctcggaattttctaaaaaatgctcagagaggtggaaagccgtatctgctaaagagaaaggaaaatctgaagacatggcaaagggggacaaggatggctattaaagagaaacttacatccctcctaaagaagaaacaaaaaagtttagggatcccaatgtacccaagagggctccttcagtcttttcattttgccctgagtactgcccaaaaatctaaggagaatatccaaacctatccattcgtgatgtttcaaagaaactgggaaagatgtggatatggtgcatatgacaagcagccttatgaaaaggctgtgaagctgaagaaaaactaagaaatggatattgctgcatactgagctaaaggaaggcctcatgcagcaaaaaaaaaaaaaaaaaaaaaaaagggagatgtcaatgctgaaaaaaaaagaagaggaaggtgaggaagttgaaaataagaaggaaaaggaggaagatgaaraggatgaggaagagaagaaagatgaagatgatcataatgaataagttggttctagtgcagtgtttgtccttgtttataaattatttagcacccctgtacacaactcactccttttaaagaaaaacctttaaaggtaaggctttgtttttaaactgtacagttaacacactaacagttaaccacactatcaaatgtgtctctagatagcccatccttgacagtcagttgatgagagagcataaagaaaaaaaaatacagatggatggaaggacagacagacggacagacagcccatcctggtggtattttcaataaccactaactttgcctgaaacagtatgagagctgtaagccagcatgaaaatctaaagcaggttcttattggtgcacagcacaaatgagttatatatggagatggtagtttttcaccttcatttctctctgatgcagcttatacaaaataagtattactcttaactgaataccactctgtaattgccaaaaaaaaaaaaaaaagctgcagctgtttttttgacactgtaaatgcttctaataacaattttttattttaaaaatcttatatttctgaaataattcattgtatttcattatagctaaaatattttatattgatgttttaagataaatatatatgaatatacatgtatacatatacatacatatatataactaatcagaaaagaacttgatctaaaattttcaactgttatcctatttatataacgttacgtaatatgaaatgcataatatgcataatatgaaaagtctaagcatattttttccagattctgctaaaaagaattaagcccctcactgtctctttctctctctttttttttttctgagacagagtctcactctgtcgcccaggctggagtgcagtggcatgatctcggctcactgcaagctccgactcccgggttcacgccattctcctgcctcagcctctcgagtagctgggactacaggcgcctgccaccacgcccggctaactttttgtatttttagtagagacggggtttcactgtttagccaggatggtcttgatctcctgacctcgtgatccgcctgcctcagcctcccaaagtgctgggattacaggcgtgagccaccatacccagccactgcctctttttttgtgatttttttttaactttccaatttagtatcctacatttctaattaaatattattcttaaaataactcccatatctgtggccttctcaacttttcggcttctgtgcctgtgagttgtttagaaaaattaatttatacttcccaagagattaactcagaaaaaaggaaaagacagagtcaacaataccactaaatttttatatttctttcaaatactatcactgtgcttaaataagttcagtatctaacatcaatgcttagtaaagcatacaaattcaaaacatatagtagagagattaaccaatacacttgtatgcactgtgggagttcagaagtcaaacaatcagagcactccacatctcaacttttccagttggctacatagtttgtcacaactcaatatgcttatgcagatttccaatctccagactggacctaagtatagccagaatgctttctaaaacagttttcctgttatatgtgaatgatacaaacaatgctagctattatcaatacttaccaattcaattattcttccctcttgtattccttccttttgtctctccctgtcactaacagtgacagaaaacaacttcaaaaacacaatatggaactaattgacattttaaaagttttagatgcaacatcctgacatttccacaaatgaggaagcttctacatgaatgaagaggcctccatcttgaaatggtaaaataaagtttaacaatcttaatttttcagaacaagaaataggaggtcttcccattgaagcacaagagaaagaagaaataagtataggtatggctaacacacattctaaagtaggggtgccctactactataaggtatagacaaattcaggccgggcacagtggctcacgcctgtaatcccaacactttgggaggccgaggcgggcggatcacgaggtcaagagatcaagagatcgagaccatcctggccaacatggtgaaaccccgtctctactaaaaatacaaaaattagctgggcgtgatggcacatgcctgtagtcccagctattcacaggaggctgaggcaggagaatcacctgaacccagaaggcggaggttgcagtgagctgagatggcaccactgcactccagcctgggcgacggaggtataggcaaattcaacctctctgggcttttctataccccacaaaggaaaataaataataaatttgaaatgaaagcaataaacccaaataaattattctgcagctcttcatatacaattaaaatatattttttaatttggagattaagtatttctctataagtatagaataaaaaaattactcagacctttagctcttggataggtagtacacaaaaaaggtgtaagggaattattgcaagcagtcatatagtcagatattcctaaaacctgttcatgttaataacaatactattctagtttatggaacaatgtttttctcagtttctttaaaataaactgtgctaaggggcagaggactaagtggtattcttaccttgtcattaactgttcacactaccatgtcctaggagagagtgttttttactaagtacagaattaaataagtatgcattttaagctgataacaatatatatttatcactatcacatctagagaaattattaagtattttcagtgaaaactatccctgtgttctggtacagtctcagaagccattccccaaggttctggagaatagcagtatcatttttcatgatggttctatacatttatgccttcagttgcaaaaacagtattaagaagagggtagccaaattctcatcaaaaggtatatccaaggttagtatgcctcccctaccatttgcttctttttggtaaggataacatatacaacgataccaaatccaattaagaacattcacagtgatacaataatgcagtactttacttctgaaaataaattattagtacttaaaccaattatataaaaataataatacacattaaagggcatcctttgccatttagttataaaataaacactgctaaatatattaaggagagagtttggcttaaaacagcaatagatgcaaatgtatgattttagagaggcttacagatttcagaaaagccccagaaatccttgaagtaaaggcagtgagaatttacagctttcttccatgagtgaagcagaagagcacagggtaaagaacaggaggtccacaatcaagtgacataagttttctaagcctcagtttaagccttcacctataaagtgggaataataggtgtgccagtatctcataacgttattttgagaattcaattcaataatgcaagtaaagatttttatacactgtcaggtatatattaagccataataattattcttactactgctgctactactactacttctagaacctgtcatattctacacagagaatttaaagaaccaattaaagtaattattaaatttagtgagccctcccatctgtttttgtttgacatgaaaactaagggtagcttccacatttttaaatggttaaagaaaaaatcaaaagaatgatattttatgtcatatgaaatatatatgaaattaatatttaagtgtctatgaagttttattaaaaacagccatgctagctgggagcagtggcttatacctggagtcccagctactcacagagctgaggtaggaggttcacttgagcccaggaggttgaggctgtagtgaggtatgatcacaccactgaactccagactgggcaacagggcaaggctctgtctccaaaaaaatagataaataaataataatttctttaaaaaaagcacccatgcttatttatttatgtgtttctttggctgttctcgtgctacaatggcagagctgagtagctgcaataaaacatacagctctcaaagccaaaaatatttactctctgtccctctgcagagaatttgcgaaccacggtctagaatataaatatagcaactatttagaataaaagactaatacatgaatgttttcttgtcttaaaccatggttcacttgacagatttttaggtagtttttcacaagtaattgtctaaatttgcaaacattaaaaactctgtttaagggaactccttccgtactcccatcctcatatcctacaatttcaattacctgagaagctacaaataaaatcaccttaaagattgctgcttttaaattctaaccccactactgatatgtaataataaaaagaatgttaaaaagttctccttaccacaaacatatatttacttaaacaagtataaaataaaagctgatatcaatgataaagcatttaaatgccaaaaagaacaaaaaatcaagtaacatccagtgtcattcatcctccaagctaactcatcatctttggggaaaaaaaaagattgacacctattaagatatttggaaattactgttggatgcaatatgcaaaaaatacaattatattacaagaaagaaagaaaagtgggaaaaaagaatattcttaaactacacacaagtagataacagaagaaggaaaacatgagagaggcacaataacagaagtcaaaacaggcagaacaaatacagtagagggcactgatagcaagtagaaagcaatggagaaagtataattacaatatgatagaaaggaaaaaataatctggcagattacgcttttcctctccttcattcctcaaaaggttttctttgattttgataaaacattctagaaaaatattccagtatttcattaagtatttatgaaaagcctgctgcacagacaaatgatacttgcaatattacaggagcaaaagaaacagaaactatacctgaagaacttacataccctgataggggaggtaaccctgcaaaaaaaggttaaattactaagaaagctacaaagcaagacacaaaccaggtaaataataattttgtcagcagaaagaaacgaaagcaaaggaattcatattcctacttatgaaggaggatgatagcttagagcttgaaaagaaaggtagagtttgaaataccaggagttaaaactggaaaaggaatcaaatagtggtgaatgaaaatacagggaagtagcattaatgagcttatgatttaacaagtagctaaaaatcataaatgcatcctacctagtatacatatgttattttctatagcaatctagcagcagagataacaagcagttggacagatgaagtacaaaaactgtcagagctgatggagcaaaaagtcaaaatggttaatgcttgtcagtgtattactaggggtaagaataaaatcattgacaataaatttctgtctatacaaaggaaaacgtatgtaggaagaagctgccaagttaggaaagcaggcaaaaattgagagactagtctaattacagtcaaaaaataataaatgggtattcaagagctatataaattagagaaatttatttctgtggtacttcaaagaagcattcccaataactggataactgtggatatacggacaatagaattaaaaggtaaagtctaaatacattttctattcttagaaaaatatcatcatataaagatggtagagaacaaaatccatgataaacgtggactcttgaagtcaagtcattaccttaagattctaaaaagaaatactcaatggacttaaaaattacaaaaatacctaaaatattccttaaacactacacaaatatccacactgaaatttatgtaagtagtaatgatgctcttctaccttcaataggtcatacacacaaaggtattagcattacacagactggctgatgtcaaaatatacgatttccagttccgtcagatttggttgactcacacagttcaaacagaattagttatgtcatatcagcaaagtagtactggcaatggactgacaaggaaattgcctcattacatatatctactattccttaaatagcaattgctagtaaaaactatgttctagcctga

SEQ ID NO: 17852 - DNA, 17775 bp, Homo sapiens
catttgggcatggagggtgatgctttggttttgatgcttctgaatgaaaatgaggagtggggttaccagctgctctaggggatggtgaagttccatgagaggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggttgtcactctagcttcttttaaaaagctaaaccaagactgtcaaggtctgaactcatagacctacctacccatgagtgtggagggttgaattcggctgtgctggaagaacttctgactgcatggccaagccccttctgtttttctctcatgctttagcgagttcctttcacattcggttttcatgggacaatactgaaaaaaactttaagacccagaagtatgaaaattggctcagcttaatccataaaagtcaagttgctttggatcctgggcattgtcccttttggccagtgatcacaagcccaatttcccttccatgctaccatgtagtcttgttgccagttttccttatatatcctcaaggttctttgtaagcttattcctttaatcaccaggcatttcttccctcaaatctcaaataaatggatttctcttctacccttgtctgtcagtagcctgagaaaggtctggttgttaatatccaggcctgaattttctctgatgagaggcaaaagaccctatgatcactgactcttgttccccagaagtggaaggagagagagaggaggagggagaaaattgggtctcttaccatgatcaataaatacttaagtacaacatttaggaaatactaggaatgaatcctaagacatatgagacatataagatataggacatgtattgttcctaaaaggcctaaaaggttgaagaaacctataaacttgttagaaaacagaaataaaacaagtagcatataacaaatataatgaaaagcaatagcaggtaccatgtactaatgccagatataacattagcagaatgttccaaaaagagtgagatctctgtgggaaacatttcacagggacaggaactaggcaagggatggtatcaatctaacatgtttggttagaatacattaaggttcaagaaaaatcagcaaacgctgagtccctattatgtggaaggtatcattcagctgacaaagaaatataagacatgatgcatgaatcaagggatgtacaatcatggcactttccacctgctattccttctgtggaactctccccactgcttgccaacttccaattttcttgttttttttttttttgagacggagtcttgctctgtagcccagactggagtgcagtggcacgatctcagcttactgcaacctccacctctcgggttcaagcgactctcctgcctcagcctcctgagtagctgggactccaggcacacgccaacacgcatggctaacttttgtaattttagtagagacagggtttcaccatattggtaaggctggtctcgaacccctgacctcaggtgattcacccatctcagcctcccaaagtgctgggattacaggcgtgagccactgtgcctggccaaccttcttaactcttacactatgcccatgtgagatcaaataaatccccttaaaagctagagcacttaccacagctgcatttgtatattatttgtcaatttatttgactaatgtctgtgtagcttactagacttcaagtgtcacatgaatgggattcatgtcaagtgtttggtcacgagtacagcccagcacctcatatagtgcccgacatgtatgatgtttgataaattagcaggagggaaagaaagcaaagagagaaagaaatggcctaaagtatgcagtggagcttgtatatcttgttaaataactataaaagagttagataacgagcatgacataattactattaaaaaagagaacagacaataaacatcactgttttgaggagggagagactatttcacttgttaaggtctaggaagaggagttgagagttgggttcaacattgaaaaaccaaatagcatttaagtaagtaaagagaaacaggtctctttgtaggaagtacagcatgaagaaagtgtcatgagaagaaagcacaaggcatattttgggaacagtaaacctaaaacagaggcattataggtgaataggatggaaagctaaggtaaagccagaaaatagggggactgaatatcaggctaaagtgttcattatttttttctttaggcagtcaggaaccactgaagatgtttgatggaggaaagaatctaagtaaagtactattaattaatatcaatctggtagtagaattgagacataagacattaaatcagttaagagatttttaaagcttgagggaaaggcaattgtcacagatcctggtatagtatagtataggtgttcgctacgtattatttgagttgttgaaggtctgaactaaggtgcaggatgctgggcatggaaagaattagaaatagattccaaagaaatgacaaagcaagacatatgaacaaaatctagtgaaaaagaaagtgattaaagtagtcaaggttctagcaggaaacagatggtatactcaaagggccagtggacatgttttaatgaagaaattatttgcaaaggtatgggcaagtttaataaatcaacaagatatggtgatgtacccaggcactcgcaaagtaggacgcctttaccagccttaaacctgaagggacagttactggaaccatgagacttgtacccaaaggagagagctatagcttcaacaggagccatggctttaggtgaggaattccagacactgccaaagatctgctagtgcctcccactggtctattctaatgggaagccagagaacaagggagattgagtgatgctacccatacagcctaacctcttggaacacagaacagggcaaaaaagatgaatagtggatatggaagggtaatgagagtatatgcagcatagtgaacaaggacaaggttcctgctagggaaactaaagttgagcgatccatgtttgtgctttccttagtcattggctctaaaaggatagaaatctaggagcagatagtgaaagggggaattaagaaggattgtaagtaacagtccgagaggtaatgaacagttgagcatttgaaaaaaatgtaactctttcagaaagaggtgagaaaatacaatccctaaacccaatgcaaaaagttcaatatggggtcctcggaccctgtgatgtatctcttccacccagaaatagtaactaaagttggacctctctgtccaatttgttttacagattccagtctcttcttcgttcccacaactgctatctacatctcactcctttgacttcagtgacatgcttagttttttttttattttatttttttattagttgtttccttatctgcctaaatttggtgcctcccatctctctactaggacagccatgtagggacagattgactgaaacctttctgctatactactgaaaccaatccagccacaaggacccttacttagttaatcctcagacacctacctcccatattttctatcttagggaactaagcctcacttatctattatttgcagaagaaaagaataaatcagaggtagaaagagtcacagtgagagagaatatccagaatatccagatgagagatcaataagagaaaacataggaaaattagaatttgtgatcaacattttattggcaagtcagccacataatgattaagatattctaggtcagacagactgggttttgagttctagcactgccactagttagctatgtgacttgggaaaattacttaatctccataagccttggttttcttcatttgtaaaggtgggaatatctaccttacatgaaaagtacttagcataatgcctggtacattgcaaatgagtcctcaacaaatccagctattataaataatagtaatcatcatcatcataatcatcattatatgagtggtgatgtgctgccactatatatatggctaatatactgcaaaaaaatggttagaattatcaatctaaggcatgtaatgataccaaggcatataaaaggacatagagctatcacaatatgaatatggaatatataagattaacacagttcatctccaagggataaatgtgaagtgtaggatggatgagcagcaggtagttctgggagctgcatgttcagactgcatgaagtcacctccttttccttattctagtctagaagacttcccctaggaagcaggcttattctataaaatccaattagtcagtatttactaagcatttaccatgtgcctaagactacaataaattacacataattgaaaaaaattaaggataagatataatttctacccccaagaaccctataatctcttgtgagggctatgaatacaatctaaaataaagtatcaaattctacaatgcggactatgtaagtgcactaagtaaccacggaaagggaagagctaatgggttacagtccttggcaagaaattcatggaagtagggttggagtggggtggggggagcaggggaccttgacatacataaaggatatttaaaagggaaaataactgggagttgggagcaatccaaagatgccactctagaaatattctggtaggaggaacctctaaaatcaattcaactttactgaatggctactagtactgtgttagatgttgaggtagagaaaagaacaagataatctctgataccgaagaattgaaagtgtcctgatggaaaactaggagagcaaaacaaacaaaaacagttattacaaagcagtgtgacaaatgctgtaacaaaggaatgaccagggagttctggagcactgggagaacttttagtagcatggcagggtcttctgtgtgagtgattttctggaacttagatcccgtccgccccagtctacctatcctcggacaggggaggggactggcatctaagtcattcattctgcgtgatgaggaagtgagtgggagctgggagctaacacttgcactgatgcctgaagggttgagtaggtatttgccagagtgattggagagcggatggcaactttgacagaagaaatagcaaatacagagatactgaggcataaggggctgacaagttaaggaattttgtgacgctttcctgtcttctttcccatcaccttcacctagggttgccggataaaatacaagctgcccacttaaatctgaatctctgattaccaactagtaatttaaaaatataagtatgcctccaatattgcatggaacatacacactcagcccccttcaactcatcctgtcctgtccggggcccacaaatccccggtgaataccggcgagctagtggagtaaagcatgagaaggcttatcttcctttcactcctacatttttcactctcggatctccagcccaggactgaaggatgtagcgcgcagcccgcagctcgctgctcgtcggagggttttcctctgaggactggaaatggggcgcgggaagagggcggggggcggcgggctgtcacttacaaagaaatctcactccactccataaaatcctcaagccagtgccggatttcccggcaagcggacgtctcccctcccacggaccggaaatcccgcctccgctggaagaagaagcggaagcgagaccgtccatccagaggaaggcaagtttttggctcgggcggctgagaagaccgcgcggggctggagacaggtagcagtacgggggcggggcttcatgccggatgtgrtagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctkcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggttwatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacattttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttstgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataagactttggcttatttcctatataattctttttttcttataccacctcttaagattgatatgttcatttgcaggtaagcattaattattagataaagaggkatgattctcaagattgtgtgtgttctgaacagagggaactacatgacattttcttctgtaattgcctttgtaacgtctttagaatgtggttcctaaatattcctggataaattctcttgataggcccattggaaaggctaatactcccacccagtgctttgttccttcctggcaaaagaattcctaaaaccactgattttagttactgacttctcaccatctggactcttacaagatgtttcagaagttgtgtagaacttgtctttcagttgacttgtggctgaatttactgttacttctctaatatcagttgttttctgcattaccaccctctcccctaaccatctgtactatgaatrgaaaaggaaaaagatggaaaaattatacctaggattgtccctaaatgcaacctcttggttccccccacccctcatgttttattataaacgattttaagagctgggcatggtggttcatgcctataatcccaatgctttgggaagctgaggcaggaggatcacttgaggacaggagtttgagaccagcctggacaacatagtgagacccccatctgtacaaaaaaaaaagtgctacttgggaagctgaagtgggaggaccacttgagcccaggaattcgaggaggttatagtgaactatgattgtgccactgcactccagcctgggtgacagagcaacaccttgcctctaaaacaaacagctccaactattttatttttttatttttctgagacaagatgttgctttgtcacccaggctggagtgcagtagtataaacatggctcactgcagccgaactcccaggctcaagtgatccttcctcctcagcctcccaagtagctgggaccacaggtatttgccaccatgcctggctaatctttattttttgtagagacgaggtcttgctatgttgcaagagggagatcacttaagtgatcttccctcattggcttcccaaagtgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttacaaaaccataattctgctatctattatgatttaacattctgtcattttcaaatttcttcaggtgttttttgttacatcttaaagaacagacrttcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccctaaaaacatgggggtggtaatctctttgttttatctggtaggttttccagataaaagattatacaggtttggaatcttaatatccaacccccaactccaagccctgccccaacaacaacagctaattattttacatcttgatgatggtaaatttttcatgattaaccaattttgggcacctattccgccatatatggttttatttaattttcacagcaacacttcaaagttgatattcatattctaaatttatagatgaacgaagaggctcaaagattaaacaacttgctaataagtgatttttacccatgctttttccattatattatgttttggatttttccagagtacccaaacccagcagatgcatactgctccaaaataaatggaactcaatactggctctgtcaagtgtctcttgccaatcaattgtccttctaatcttttgaggggcagttctctcagttgtaccaagtcactgtcatccccaaacttttcaatgattccaggcctttaacaactcccctccacctccaaaccctctctcaccaaattgtgtaatttctttgtttactgctggcttcatcatgcacttttccttcatagcctattttaagaagttgatttgctgaactgctttttagccaagctatttgtaaatcaagctacacaaagtatgtggccataatttccaaaaggcaaatgatcattgttcaattgctgttgctctgcagtgtgcattcatgcagttaaaaattgtactgcattgatagtacggcatcagagaatagatcacttaggttcaaatcccagtgcatgatcctgagcaagattatcatatctagatacattagtttttatctgtgaaatgggaatgatagcacaatcttcatagaattgttggtaaggattaagtgagttgatatgctcaaagtgtgcatgctggcatagaacaagtcactgtttacaagcctttaaagaaggagctgttctggcactgtaaacttgaaccttttttccccaaatctaatggatataggcaaggaaattatatttatataaaataaatgtttgactacctttgatcataaactttattctcatcttgacctgttcctttgaaaagataataaatactgatatgtgaaaaatgtatggacagattattcagatgtctggttgaggctttacagttttgtatatttctgtcagacattaagctgactctaagcagtggaggtttggtttatgcccctaaattacacagcacttcttttctccattgtatcgaggggtcattcaggggttgctgttctggagatggaagcacatgtctcctgcctgggtcagaagcgtcacaatagcacaagcatttattcagcactggcctaggagaaccattcatttagtcaaaacaagcatttatattcattatcctgaacaaaaaccagactaaatgagaacatttatagctgctcaggcactctgctaattgctatgtctgctagacaaagtgaaatgacacttacagtgactatttaaaaataatttggagcatgaatatttgaagctcagttctttttacaaaggaaatgtataacctttgctcttcattttttttggcagttatttatagatccaggccctgtgtcaagttctgtaatagatgaatagacagtttatgctcttggagagttaacagtaaaaacagaaacagaaacataccccactgataaagtgttatataacaccccattaagttccacaatgatgtgatttgtgaaatggaggggcagtagggcaaggtagaggatatttttatttgtatgttacagataagaaaactgaactcagaaacaagtgactttccaaggccaaatagctggttaatggcaggattggggtgggaccccagatcttctgattctaatcttttttttttgcaagtcctttttagtgctatacaatgacaggtgattacagtggaaaacctcacttatttagcaaatgtcattcacttagcaaactacttagcaaaatgccatgagtatcttctgtgtgccagtcattgttctaggcatcgtagatgcagtgagtgagagagggaggcaaagaccctatctttatggatcttacattttcatggggaggcaaagaataagcaagtacaggattgtgatgatgatatatcataaagaaaaataagacaagctaaggaagtagagagtgatggcagtgcggagagtggagtaggtgcttctttagatgaactggttaggaagatactgtgatgagagggcacttgaacaaagacctgggaagtgaatgcatgaccttcatgcaaccatggtgcagggaggtaagggaagagcatttcactcagcatccctccctgctgagtgaaagcagtgcggagatcctgagttaggaatgagcttggcaggtttaaagaacagtaaggcaagtattactagttggagtgagcaaggagcaaccagaatctaattcacattatccagcagaacgacatgaatgctagttgaaaaatacagttaacattagcatttttactggcttataatgcaataactttgagcccaacctatttttttcctctggcttctgagcacatgttaatatgtaaggaagatgaaacatatatgtaaacaacttatattttagtaatgatacaaaatactttcacaaattttgtgatgtgggaattttttaaaattccattttcacagatgagacccctaaagctcagagtatatgcactttgcccaaggtcagagttagtatgtgaggcaggaatagaccctagatcttctggagctaaatgtactactcatttctctgtactacccttatcatttagctatggtgaacagaagatgaaccactggattctagaaagcagggagttcaggaacaacgttgtccaaccaatgattcattcatctagtaaatacttaggagcctactttgtgccaagcactcagctagcctgggggtataaggatggttaagactagagtcctgcctttaaggaactcaccagtgccataggagactggtggaaagaggattataactcagttataaatcagtagctagagtaaaatacacctaaagtagttcactaatacattaattggacaaaactagtgcagaacctgatatatactaggtactgagatgtttgttatcttacctgtttttctttaacattggtaagtactgggggctttctttgaaactttcctgcttaaaatcagtcagtgattgacaggctcctttgcacagtgtgaatggcaggggctgtgaaaaagaagagaaaacagtttctcagtgcctgtcatttctaaatgccatcagtatccacctaattttctaagctagaatcttataatcacctcctattccttcttctccttcacttgttacccgccccacatctaatcagtcactaaattctgtcagttctaccttttaatgaccctggagcctgctggcatcttgccattgtcatttccagtactacatttcaggccctcattatctcccatctggaatcgatagctcctgactggtcttgttgcttttcatctctctcgcccttcattccacctctcatttatcctccccagtgctgcgagagtgtgctttccaaagcagatctgatcctgccaccattctgaaaaaaagcatcctgggggactatgtgacctgcagaaagacgtccaaattccttagcatcctccatcttgcaccaatttcccctactcagcctcactctagcctactggataatgcagtttcctgaagttaccacactattaagcctttgcccatgctgggttttgtgtgtgtgtgtgtgtgtgtgtgtgttttgagacagagtctcactctgtcgcccaggatggagtgcagtggcatacactcggctcactacaacctctgcctcccaggctcaagttgattctcatgcctcagcctcctaagtagctgagattacaggcacgcggcaccatgcccagctaatttttttgtatttttagtagagatgggggtttcgcgatgttggccaggctggtcttgaactcctgacctcaagtgatctgcctgccttggcatcccaaaatgctgggattacaggcatgagccactgcgcccagcctgcctatgctgttttttctgcctagtgtgcatatttctctcctggccttcagatgacctgtcactcgtttttcaggacccaactcataggacacttcctctttcaagaggaatgccagatgagcttttggagagagaaggttagccattaagggggaaaaaaagaaagatagggccagagttgtaacatttggtaaactctgttaatggacttgatatgttatggttatttgtgcatttgtctctttctctcagatttactgttttgtgtttatatccttagtatacagcataagtgctcaataaatgtttgttaaataagtgaagtaggtatggggagggaacaactgtttattgagcacctattgtaagcctatatgcttttcacacatcatctcatttaaacctcaaaacaatttttttgatttaagtattatttgctaataagaaacagtcgcagaggacataaatacttacctctctccccacccacaaaggttatgggtttgtgaggaatggaactaaagttggaacctaggtctgtctgactccaaaactttcctctcttgtgtgattctcagacagggacaattttgtcccccctttctggggacatttggcaatgtctggagatattcttggttattataatggggatgttactggcgtctagtgggtacaggtcaggtgtgctgctaggcatcttccaatgcacagaaaagccccacaacaaagaattatctggccctgaatgccagtagtgccaaggttcagtgtcttcatctgtttgagctgctgtaataaaatagcatagactggatagtttataaataacagaaattcatttctcacagttctggaggccaggaagtccgagatcaaggtgccagcagatttgatgtctggtgagggatacttcctggttcatagatagccatcttctgtttttgtcttcacatgatggaacgggtaagaaaactcaccagtctcttttgtaagggcgctaatccccttcaggaagactctaccctcatgacctagtcacttcccaaagtctccaccttctaataccactaccttgggggttagttttatttcctttccttccctttccctttccttttctctttaaagcagttgttaacatttaatgaacctcctgttatgtgacttcaagccaccaggagaaagctccccccactgaatcttctcctgagctcttctgctgaagaatttggccttcacgatgacaggctggtttgggaacttttcccttcccagaactctatagtagcccgatggcaccacatcagtgatgggagctgttccaggcttgtttttagcagcattcacctgtgtctgcttcctgaccaaagcccacaatttgtcaaggttgacagctgggtagaagctcaggttcctctttaggtggtaatgcctcataccaactttcctaaagtaacctgggtgacatttgctgaagtcgatcctgtggtgatgcatgccgccagcattgccacggccacctgggtgctttcagtgcttgctgatgcggcagaggctgtggctcacctggctccaaaatttctgggtcctgtggtgactacatttcctcagtctggatggctgtgtggaaaaagaagcttagtggtaaggcctaaggaagaaggagcaggggcgatgcttgccagcctgagatgggcc

SEQ ID NO: 17853 - DNA, 12815 bp, Homo sapiens
gccattctcatcactgtggttttaatttgtattttcctactggataatgatgttgagcacctattcatctgcttattagcccagtatttatcctcttcagtgaaatgtctgttcatgtcttgctcattgcctgttttgtatttggatttcatttttattgttgtttaaaatttcttcatatattctgaatacagtctttacagaatatgttgcctgcaaatatcttctctcattctgtagcttgtctttttatgctcttcataggtctctcacagaacaacagtttttagtgttgataagatccaatttattaacttttatggatcatacttttggtgttatgtctaagaactctttgtccagtcttagctctgatgactttttcttaaaaggtttgtaatttaaaaatttaaatttattatttattttagaaaaaaaattcttgcctaggctggccttgaactcctgggctcaagggatcctcccacctcagcttcctgagtagctgagagtacaggcctgtgataccacacctggctcaatgtttgccattttaactctgtgctttacatgaaagcttgtgactcattttgagttatttttgtatgaagcatgaggttttggctcaggttattttttttccactgtggttgtccagttgttccatcaccatttgatgggaaagctctccttccttcattgaattgcttttgtgcttttgtaaaagtcagttgagcatgttttgctcatttttagttgagttgctcatcttcttacattgagtttaagaacttttcacatattctggatacatgttcttcatcacagatgtaatttgtgataaattgtgaaatattttctctcaatctacggcttgtcttctcattttctcaatattgtcttttggagtacttaagttttaaattttaactaagcccaatttgtctctcacttttttttcatctgtagatcatgttttttgtattttatgtaagaatcttttgcctaactactcaatgtcacaaaaattttctcctatattttcttttagaaattttatggttttaacttacaaattttagctgtttaggtctctaatttgtttgagcttatattttatatggcgataagtgtcacatcatattacctatgcaacttcattgaagatcaattgacaaaaaaatgtaagaatgtctttctagattctcacttctgttcattaatctctgtgtctctcgctttcacactgtctggattattgtagttttatatgacattccattttttttcaaatttgcgttggcttttctgcatcctctgcattttcacatacatttttaggattaaattgtcaattttccataaaatgcctgctggggttttgatagagattgtacagaacctatagatctcttggtggagaattgtcatcttaacaatattattgagctttccaaccgcatctctccatgaatttagacctttaatttctctcagtaatgttttgtagttttcaacaaactctgctgtcttcctaaatttattcctatttctctctttttgtaactactgtgataggaaagtttagattttaattgcttgtatagagaaatatgttaataatttttaatttgattttatatcctatgggagcttctggattcattttttagtgctagcaggcttttatctgcttgtgaattctacagacaaggtcatgttatctgtgaatagagttttatgttttcctttttatctggatgcctttaacttttaattatttgccttattgcaccagctgcaatctccagtacaatgttaagtagaagtgttggattggacatccttgcattgatctccatcttaggagaaaagcattcagtctttcttcagcaagcatgattttagttgtgggttttttatagatgccctttatcagggtgaggaaggtcccctccattcctattttgttgaaacttatgaacatgagtggtgttaacatttttgtcaactgtttcttctgtatcttttgagataattatgtcttttattcccttactacagtgcattccattaattgatttctaattgttaatccagccatatattcctgggatgaatcccattggtcatggaatgtaatccttttttacgtggctttctattgtctgccaatgtttgttaaggatgttttcatttatgtttattggtgacactggtctatggtattcttttcttgtcagtcttgctctgactttgatattagggtaatgtcagttctgtaaatgagctagaaagtcttgcctcctctcttcttgtctgaaagagcttttgaaatatttgatagaattcaccagtgaagatatctgggctttggcatttctttgtgagaaggttttaaaattactgtcttagtgtacagttctcttcagattttctatttatttttgagtcagtttcagcaatttctatctttgtataaatctgtccattttatctaagtggtctaactgattggcttcaggtttttcagagtattaacttataatgttttttaacttctaaagggtcattagtgatactctctcttgtgttcacaattttggtaatttatctcatttctcatactgtctgttttgacttttggtcaagaaaacagacagaggcagctctgtgacagattctgtagtgggaagctttgatcattcatagctggcaagccagactaatgccagcaaccccaaaggagctgccaatggatcttgacagggaagtcactgactctggattgggctatgatcaaccaggggtagatgtcaatgcttcaaaggctatacaagaaccagaaaaatggagattacaccaatttggactgttgagtcacatttctttacacaagaaaacacactttacagccttaaaaagccaacagtgcacagggaaatgtactattcaggggaaactttgatagaatattgaaatggctgaccaggcgcggtggctcatgcctgtaatcccagcacttttggtggccgaggcgggcggatcacctgagtttaggagtttgagactatcctggccaatatggtgaaaccccgtctctactgaaaatacaaaaattagctgcgtgtggtggtgggcgcctgtattaccagctactcgggaggctgagacagtagaattgcttgaacctgggaggcagaggttgcatgagccgagatcatactactgcactccagcctgggcgacagagtgagactccatctcaaaaaaaaaaaaaaaaagaaatagtcagttgaaacattggttgtctaattgtctaaaaactgccaatataattgttgggcaatataaacatgaaggactggcttttatatcttcatgaatgtgcttactgtcaacatgggtggagctgcgaaactgactccactaggtagcttcctctctttttcctgatggatcagggtgatgctgttatgactgtacatacaattcttcttaaggggaggatgctggaataatgactacacttcatttcttatttctttttttacacagggtgcagtggtaccaggaacagggatgcaaatcgaactgccagaaacaggaattatccctaaggaaaaaaccataactatatttttatacctttatgtaagaattcccaagcaaatcaaggattgcgctgtgccttcatttcatctggcaaagtcgggattaactgtaagtagagctacgtagactggtggtcagatagcctgcactagttcctaacctatgtaacctactgtctatgatcaagagtagattaagagaagacatggtagaatactattgctgcatgcagtctaggccagcacagcagccaaacctaatgtcacttctagaactggaaaagactgatataaagggacagaaggaggaatagtggctgagggtaggtgaataaatcaaagggttatgtaatgaggaaaattcaatattagcttatctcctcaaaagtggtgtgagcaagagatgttgtctcttaggtcaactatactggatgcctaaaagggtgaagctgtatgtccctgagaccattcttgtttttggaacctgataagattgaatggtgtctgcaaagctgagtgatgtcattctgggagacatattcatacaagaggatgataaactggcctaattttgaatgaccgaatgagacttggataatatgccaatgcttctttactgttataatccttttcgtatgaaaaatatgtggtcaaagaaaagggggtaatatgagttatcacaaaaacatttagttttgtccctggtttctcctaaaaaccttagaatctcttgagtgattagagtgtctttagaatactgaggaaaggactcttggctgagtggatcctggataccttgagaatgggggctggctgccacagacacatacctatgatgagagggttgtcttattccgttttgtgttgctataaagaaatgtctgagactgactaatttatataaacaaggttcatttggctcaggattctgatgtctggaaatgtttgagcatttagcgagggcctcaggctgcttccactcatggcagaaggcaaaggggagctggtatgtgcagaagtcacgtggtaagagaggaacagagggagtaggaaggtgcgagactcttttaacaactagctcttttggaaactaatagggcaacaattcattgactcccgagagagggcagtatctctctgttcataaaagattggcccccaagacccaaacgccacccattaggccctaagtccaacattggggatcagattttaacatgaggtatctggggataaatatttatatcattgcatcctgtccctagccagccaaagctcacattcttctcacattgcaaaagacaataatcttctcccaattgtccaaaatgtgttgggttgatccagcatcaactctaaattccaaagtctcatctgagactcaaggtaagttcttatagctgtgcacctgtaaaattaaaaaaagttatttacttctaaaatattaatacaacagtggtagagacatttcctatacatttccattccaaaagaaataaatggaccaaaagaaatgaatgcagtgtcctcacaaggttgaaactcatcatggcagacattaaaacttaaagctctaaaataatctcctttgactctatatcttgaaccctgagcacactggctgctgcaagcaatggactcacaatgccatcttcagcctcatatccgtggctttggtgaacataatccatatagctgctctcatgggtgaacattgaatgcttatggcttttccaggctgagcttgcatattgccagtggctctatgatttagtagtcttggcaggggtcctgttcctgcagctccactaggaattgtcctggatattaaatttcccctttaaatatcagttccagtttcaggtcatgtctttgctcacacatatgtgcataggctattacaagcaggcaggccaaatctggaatgctatgctgcttagaaatttcttccaccagatacccttatacatcactctcaagttcaaagttctacagatccctagggagggggaacaatgcctccaagttctttgccaatgcataacaaaagtgacctttcctctaggtcccaataagttcctcatctccatgtgagaccttatcagcctggactctattgtccatatcactatcagcattttggtcacaacagcttaacaaatctctaggaagttgcaaattttcccccattttcttgtcttctgaactctccaaactcttccaacctctgcctgttacccagttccaaagctgtttccacattttcaagaatttttatagtaatacccaactcctggtaccgattttctgaattagttcattctcacacttttataaagaaatacctgagactgggtaatttataaacaaaataggtttctttctttctcctcccaccatccaagatgccaaaaggaaagaaggccaaggagaagaaggtggctccagcccctgctgtcgtgaagaagcaggaggccaagaaagtggtaaatcccttgtttgagaaaaggcctaagaathttggcactggacaggatatccagcccaaaagasacctcacccactttgtgaaatggccctgctatatcaggttgcagcagcagagaaccatcctctataagtggctgaaagtgcctcctgagattaaccagttcacccaggcaccagacagccaaacagctactctgctgcttaagctggcccacaatacagaccagagacaaaccaagagaagaagcagaggctgttggccbgggccaagaagaaagctgctggcaaaggggacattccccactaagagtccacctgtccttcgagcaggagttaacaccatcrccaccttggtggagaacaagaaagctcagctggtggtgatwgcacatgatgtagatcccatcaagctggttgtcttcttgcctgtcctgtgtcataaaatggggtcccttactgcattatcaaagggaaggcaagactgggacatctagtccataggaagacctgcaccactgtcaccttcacacaggttaactcggaagacaaaggtgctttggctaagctggtggragttctcaggaccaattacaatgacagatabgatgagatccgccrtcactggggagacagtgtcctgggtctcaagtatgtggtttgcattgccaagctcaaaaaggcaaagggtaaagaacatgccactraattgggtgaaatgtatgctgttgagttttctgtatgtaaaaataattaaaataatataaattttccttcaaaaaacaaaaacaaaacaaaaacagaaaagaggtttaaattgggtcatggttctgcaggctatacagaaagtatgattctggcatctgctcatcttatgagagggcctcagggaactttcgattatgctggaaggctaaggggaagcagacattacttacatgcctggagcaggagggagagagagcagggaggtgacacagatttttaaacaccagatcttatgagaattatcacaagaatagcaccaaagagatggttctaaaccgttcatgaaggatccatcctcatgagccgatcacctgccaccagacaccacctccaaaattagggattacaattgaacatgagatttgggtggggacacagatccaaacaatatcaggggtcatggtggacatgaggatgggctggtctcccatttcttacctgttactgtagacatagacacattcagacgctttggcagaaagagaagccagaggcccttaatgtcacaaagaggaggcatgaacaaatcttgcatctcagtccctcacaaggcaatcttagaaaaaacatagtcataaactaatccaggtcagtcacagtaagttgtgacactgaacagcccaccacaccttgaaaaattccaaatcaaagaatctccagagcttagttgtgtcccctctgcccaactcctctttcacttcaggccctctaaggtgtcacttttacaagccgtgagagacacatcagagccctgggtactgttcctgtttggggtggaacaaaaacaaaatctggtcagagcccacaggtgatgtgactaaaggaggaattttggggtggctgagctcccccatgggctcctgtctacactatcccaaggatctcagggatcactcttcccacccctaccacacttacatgaagcctgagcataactgcctccttttccatctgtggaaagaaaacaaactgtgagaggccagggaggaggcagggcatgagatcctagagaagtttccagaactgtgactacagacccaggtcaggatcagaaaacccaagggaagaggatgtgttgaggctggaccagttgtcctcctgaggtctgtcctcagcagggaccttcccctgacctgtgactgctgggagtcaggttcccatgaccacaatcaaggtgataaatttgtccttcattttcacaggtgctttacaaaagagtaagtgttgatagacagggcctctgaacagggtaaatgtgtgtggagatggtgcctcacaactaggcaagatatgagcctactcctacctggggcttgaaatccaccaatggaagaaggaaactcagagctcacccctttcctacctgggatcttattcctccacatcacagcagcgaccacagctacagtgattacagcaactagaagaaccaggccagcaatgatgcccacaacggggatgatgggctgggaagacagctctaagaaaggaggtgaacgtgaggggccctgacccccaggcctcagccctgaccctgcttaaaggctccagaaggacttctgctttgcctgagaagagacatgacccctcattcgtctccttaccccatcttagtgtgaggggctcaggcaacccctcgtgctgcacatggcatgtgtacctctgcttctctccagaagacaccactgcagctgcccacttctggaaggttctgtaccctgcaagtctggtctccacaaactctgcatcctgaatttggtcctccccatcccgctcctgggtcagtgtgatctccagagggtagaagcccagggcccagcacctcagcgtggcctcatagttggagatggggtggagggttacctgtgccttcaggggatctgagggcaagaggtagaaaattcaggcactttgcattcctcatgagacacagcacccatgtgaccatcctgagaatggatgggacatctggggtggggaagggagcacagaacccagacaacattctggacacaggcacctgggataatctcttattccttggaaagttctagtgtctgaggcggaaacagagatttctggtcctgacctgagtggaggccgagggactcagaagagctggaatcagacccccacacacattgagtatgaggcagagaacaaggcctgagaggaaaattcctggtgcccaaggctgctggggggtcaaaggggaccgcgtatcagtattccagggattgtcttcccctcctttcccgcagagacttcatccgttaattgtcccagagtgcagggcgggccctcagtcactctctggtataggatttagaaacccaggaggactcttctgcctcaggacaagagggagagggatattttagcgttggtcccattttcctccccttcttttggaaggtggctcagggatatctgcaggagatcagggaggcgacccgtggcctctggtacctgcgcattgcagcctctccttctcattcttaaggcctttgctgagccactccgcccaccttcccggcaggtaggttttgagcagctctgcatgttcctcctccaaaacatctgagccgccttttccgctgcggtccaagagagcagttcctggtttaggacgaggtaactggcgccatcgtagggtatgttcatccccgcgcgaagaggctccggtccgggtccaggtcgcagctgtgtatccactggaggtgggagaccctgtccccaagcccgcggtcagcctcagccactgagctcctcctctgccccgatcaatcccccggggatttgggcctgaactgaaaatggaatcgggtataggcacctggggttcttgtgtcgagggtctccacgagtcccgcagcctcggcgtgggtctccgattgtgctacagtgggtagcacaatcttggtagcccctgaatggtcacgaatctaatttgtaaaagagatgatttttggccccattatatataaatatgtctaaacgcattgcaattagactcacaaagtgaagttttactttcccagactgtgtatctgtgactctggtctgttgtatttttacagtatctttatttcatagctctgagtttgtgtgtgcgagtccaggacatctcaatacaaagcacaatgtattaccgtatattgcaaccaggagcctgtacagaatttaattacctcagaattgcaagtgcttaatgcagccaaagtgcccttcgccagtgctcatgcactccctttattattaatttttttattttttatttatttacagacagggcgtcactctgttaccctggctaaagtgcagtggcacgctcatgactcactgaagcctcgacctccttggctcatgtgatcaatgctcctccctcagcctcccaagtagctggcaccacaggcttgtgccaccactcctggctaatttttctaaaaataatatttgtagagatgaggtctccctaaattgctctggctggtcttgaactcctgggctcaagcaatcctcccgcctcagcctcccaaaatgctggtattacaggcatgagctataatggccggcccatgcacttgcctattattatgaattattcacatctaagctatgtgtatattttattgagacatttggtattcttttttaacctttttttttttttttgagacggagtctcgctctgtcgcccaggctggagtgcagtggtgcaatctcgctcactgcaagcaccgcctcccgggttcacgccgttctcctgcctcagcctcccaagtagctgggactacaggcgaccgccaccacgcccggctaatttttttgtaattttttattagagacggggtttcaccatgttagctaggatggtctcgatctcctgaccttgtgatccacgcgcctcggcctcccaaagtgctgggattacaggcgtgagccaccgcgcccggccttttttaacctttttatcttagagaggcaattaggttttagacagccccacagaatgcattaaagaccaaggtgcaagtaacactgtgccaggctttgcggataaatgcattaaaaatctataaaacactgtatttaagtctgagaattccattgctttagaattctttctctctgttcctttacctcacctcctgcttctccagcccttctctctgtccctgtcatccttcaggccctcctctccccttagtctctactactctgtcactactgaattgtgtccctagctctgtcccttgcctgctgcccatgactgttctccccacaaaggtcagcaatcctgctaatgtgagtcagattgtttcatttcttcacttaaaagcctctaatggctccatcttactctcaagaagcctctagaatggaaggcacaagcacaggggctttgggttgttttgatcaaagttgtatctacagaatataaaagtatatctgccacatagtaggcactaagttaatttttgttgaatgaatgaatgaaatataattgtgttcaaaattgtatcacacaaaaatcatgaaatggaaaatgcaaagcaagttaggaaatatttggttttatgcaactactatgcatatcagttcatgaattcattccggtggagaaaatgtcatatacttatcctttgaatctgtttatttatttcctggcagtacataaccaattaccacaaacttagtggctgaaaacagcacccatttatttgtctacatttccttcatcagaaatccaggcctaatgtgatagactctttgttcagagtttcgcaaagctgtatcctcatcttaagattggggttctcccccaagcttgtgtagagtttgttggcagaattcggtttctggcaattgtaggattaaggtccctgtttccttcgggctatcagagtagacagtggggagggcttctaattcctattggccaccagtgttctttccccatgatccctccattttcaaagcccaaagtggaggaagcccctcacgctgaatccctctcacactgtgagtctctattctcaggaagaacccagtccttttcagagcttacctgattaggaccgtctaagcaggataatcctcatcttaaagtcaactgactggggactttaaatatatctgcaaaacctcttcacagcagcacctgctttagtgtcaactgagtaactggggtaacctgagtaaccaagggtggttattggggtgtcatcatagaatcagcctagcatagcctggatcttcctttcatgtttaaatagaacatacaagttgaagatcaaaaaatagatcattgttaatgataataaaatatatcttatatagccatggaaatttttattaaatattaaaagcaaatgacatgtttaatatcttataatgaatttagagcaaatgaaaaagttcagtgattcatcctctcttgtgaagctgtattagttatctactgctgcataacaagtcacctacaacttagcagctcaaatcaacaaatatttatcatctcccacagttatccatggtcaggaatccaggagaagtttctctgaatgcttctggctcagggcctctcacaacgttgcagtctagttgtcttccagggctgaatcacctgagggctcaaatggggccagggattcacaagacacaagaatctctcacatggcttttggaagaggctttagcttcttattgtctggtcccaggaggactcacttcctagtcacatggaccacaggcctccttatgacacaacagccagcttcccccagggctcatgattccagagaaagaaagaaccaaagtagaaacttcagtgagtcttatgttctacacccagaatcacaaactattatgtcagcattactctatcagttagaagtgagtcattaagtccaggccacacgaacagggagggaatgaagctgc

SEQ ID NO: 17854 - DNA, 13765 bp, Homo sapiens
atttgagtctgagcttatttttgtcagtaaatattaaaaatactattacaaatttaatatctttatatagttatatttaaattttcctctttcaccttgatccagtgttaataattttacatttctaagaaataattagtattgttcacaacattcttgtgatttaaaaaatctctgaataaaaatatttatatccctctttgcattcttaatattatttacttgggaattctttctttcttaattttataaatgtcttgtccattttatgaatattttcaaagcaccagcttttggtttaattcatcttccctcttgagttttttttttttttttttggtcttccttttcattaatttctgctcatttaaaaaatcttcatttctgagagaggtatatttaaatctcccactctgtgaatgtgtccagacattttcagtgacttgctttatgaattaagcttatcaattttacatctagagacttttcttttgaggaaaaattgtaaaatgctgtcagtattgaaagcttttttggtaaccttctaggaaccaaacaagttttagcccataatgtctaatctttaatgcttttttgttttgtttcggattttcagaaatcctttaattaggagctgggctaaagcttagttctagatgaatctataattagatttaaaagttacatctggattctgccatttatcactttatatattttgagacaattttgctagcatatacagtttcaaaattcttttactacctttctaagttgctccttttatcattacagaattactccctttatgcctattaatgtcatttttgccttaaggtctagcttctctgatgttaccactacagcagctttttttttgttttgttttgcttttttttttattaagatttgtctacaatatcttttcccattccttttcttagttctcacaaccattttatattttgggtgtgaatcctgtaaaaatgatgtagctggattttattttaaattctaagcagattatgttttcatttttacaaagagattccatctatttacatataatgagattaatatgttgactcatttttatcttgctattttatgtttttctactctttaaatagttatacttaaaattgcaggacacactcttatcaaaatctaaagttaatcagcgtgtctattattctccagtacaatacaaattcttaaaccattttaaatctattagctcatctggttttaaaccatccaaatttggtcactgttgcaacagtcattttaagaagcttatttaaatttattcacatgcattattttgtttactagtgcctctgacttcctgtccttgctgctggtgatcagtttccttcctactgagctattctttgttagttaccctttggtagataccttcgttggaatctgagggtagtaatttctctcatctttgtatgaaaatgtctatttcatttttattcttacaaaataattaatgaatataggattgagactgacaataattttcccttagctctcaagttttaattgcatagttactaatgaaaagtttattgttggtttagttgtcattattttgtacaaatctctcttttgcctcaagtggttttaagagttcatccttggtgttctgcattttcatcataagctgtcctggagtatgtttagtttagttattccaagttatccacctccttggtggattttcctcaagactcatgtctttcctcaattcagggacaggctcgtcacactctgattaaacacggcttgtttcctgtgtgtgtttttaaattttatgtattttcattgtggaatttctattagacccattctgttctctttaattttttttctctgatttttccattatctcttatgttctcagaagtcctaattcttgtttctcttgtctgctgatgcttgcgtacaacggctttttgcattgtgtggcttgtaattttgatttggggctcatctttaatatttttattactttttcttccatgagggcatctcatgttatctgggttatagaaatattcctacagaactattttgggttggcttatgtctgggcccatgggagtttcactgatgtgggaccagttttgaggtcaatatcttgactgggaattccattcctacgctggtattaaaaatttggacacaggcccagactattcccaacatccacacatgagactaactggggtttcaatgtcttcattttttatgaagtcttttttcaatccaagacacctggcaaacaattcttcctcccagcccccatccctggattggaagagttctttttgtctctttttcacagaggaaagcagctctcctggggatctggcttttgtgggattctcagttgcaggcggttacttctctttttccaaacccaagcaccaggccctctttctgggtcttgaatagccctttgggtctttgaatagtcctttggggagccccaactcaccagccagtgctcaggaataacatcccctctttgtttctgcctcttggggattttgctgactctcttttgagcttgaccaggcattagcaaaaattcttaaatgtttatattttatcctggatttccatgtgttttctttgggctgggagagctacagcagctcattccaccacgttcctggaaggctgcaggtatcagcttgcaagtgccaagtgtcaaacaagtgataaagaaaagtgttggtgtcatgcagagaagggaggaatcactgcagacagtaatggctacttgacaaccttcagtgataagggagaagcataaagcctgcctcaagctcatcctttttaaaatacccacagctctttaaaacaagtaaccttcctccttcccagagggcagcgactctgtcctattctctctgaatccccatattcacatgtgggacagatcatggagagtacacagtaaacatttgttaaagcaacaaatgaagtgagcattttgtccaggacacagctaaaagttcaaataccagaaacactgcctgagaggggataaatgtcatgttacagtaacacccacgatatagaatcgtatccacattgtggatacattcagaataggttaagcagaatcagttttcttttaaagttctttaaggcacctcagagtttaatgtagccaagttcagttcaggcaaggctgccttccaagccatctctaactggctaggttttctaaaaaggatttgcccaaatgaggatccatagtccttggaaggtggtttcaaggttcagctctgccataaagccattccctcaggggctgtctgtgcacatacctggccaaggctgctgttttggatttataatagaacgcctaccactaagggacacaccagcgcttcttgggggggcctaagttaagaatctgggcatgtgattttgctccgaataaaatggctacaaaggttaagcacagatccagtggtgtaagattatggtgatcccaacgtgccagaattaccgtgtaatttcgagcgagggagacatcagtaccgtcttgcagatagtgggtttccgtgaaactgctggcaatgagacctctgcggaaaaacaaaaacaccataaaaagatgagtgcagaattgcattgatacattgttgtgaatgtctaggctatagggtagcaagattgtgacctcctttttttttttttaacagataatccaaggaagctcccattagggccttcccagtttaggttctccggggagaattcagaggagactcagacaacagagtcagatatgcatcctcggaacaatagcccacacactcaatgtggaaccctccctctctcccttcctcccacctcattccttcattcgcacactgggtgcacacacttgcaaacgcacacatttgtcacacacatatactcttccatgaatagtacaggcagatttccaatttgggaaaatctcctgcttggaagtcacagtctccaccaactggaatcaatggttgaaccacctgctgggaaaatcattctgatccgcagcagtgcccctgctggctccccggcaggtgagagaactggctgaaaatattgaaatgtcacagaagagaatagaacagcaatgaaatgctaaaagcagcgatgtatgtatgaggtgaggaaaaatgattttgcacatcctgaaatattgaatttctaagataaattgaaagggggaggaaaccccgtttatgctaactattaataaaactgtatgcagtctaccagaacttcattaaagattgcaaagcatgggttacttagattttaaattattttccaatgtcttacataacatgcactattttatcctgttcaacacaaccacaggaagtatttcctgtgtaactaccgctgccaggtgctagctgctgggatacaaagacaagtaggaacagcccccatcttgatgacaccacgaactggtagggtgatgggtgacacagaatccagtgtgaagggagcgatcacagagtagaaacagagtccttctgaggcaggagagtaaggtctggaggcagggaacaaaggtcgattcatgctgactttctagaactaagtcaaacggaaacacttcagctatgacaggaaatatcctctccatttacatagggcgtacagcgattaaatgactttgtaactttacctcatccccttcatttacatagggcgcacacgaagtaaccaatggaaacctctagagggtatttaaatcccagaaaattctgtaacggggatcttgagcacctatgcttgggccccctcacaccctgaggagcgtaatttcattttcaataaatctctgcttctgttgcttcattctttccttgttttgtttgtgcattttgtccaattctttgttcaaaacaccaagaacctggacatcctccagcagtaacacttctgggtgcgtggatgtgctttgggtggagcatcctgcaagggaaaggctttgcgtagggatccgacaactactgggccctaacgatggagcaggagtcggccaggcccaggacagggtggaaggagaggggaaatcctggcagataatgtcaaggtcagggcctgaaaggcctggagtctggggagctgggctggtggaagacagagaaaggctctaaacagaacctgggttttctgtgtctggacaacagggagtcaagagttgctttaaatactgaactttgtggatggtgaaggtgctgcctgccctttcctgtcttcagaggaagacactctccactcttcacaccgtttggttttgtgtgtgtgtgtgtgggggggtgctcctccactcttgatccagagatgaacatgtgacccaagctaagcccatcacaaatcttccctacagcatgttgagctgggatgtctggggatgacgtctttcttctctgttctcaaggctctgagaatgtggccaccacctccatcctggtcccttacttcaggagaaagctagtcagagagaacaaagctgtcaccctcaggcagggacaaaaggcagggagagggagatggacctgttgcccatggggcctgctccgcctctcctcctcctcataagtccctctcttctgcctacgctggctggagctgggttttgcaaccagagtcctgatcagtatggcagggaaggaaaagcagcgggaatatgcaaatgtcagagatgagaagcacttccttacacagtcagagttcttagacctgctcccagccaagttcagaactgagagtcagctccttgttttacatggattgcaatatgttgaggatatgcctggcttaaatcagttagaccccaatggcaggtctccgctgcagtctacttaacagcgagtgtttgagagagggtgcggaaaacataaaacacagacgggccctcacactcactggcaaaggcacgtgggcctcccaagtgctgcccctcactctcctcagcagtgcacatgtcgtgccagagaaagttgccctccttggcagcgttgagctctgaaacccctgtcttctaagctcacctcctctgagctgccagaggggctgcctgggcaggctcattcayagggcaccctggccctgtcacgcagtcaygagcaaaggagaggaagaggggaaggagagcaggcaaggcagtgggaaggtgacagggccctgaagagaagagtgtgaagaaggggtagtccttagtcayaggyagagagctccaggakggtggaggagtctggtgaccttgacaatggagatgcagcaggtgagcccaggtcaaggtgacaggcgaggtgaacgaatkttccacagcacagttccaaagggaagcagagaggcgggatgtgaaaaccagagayggggacttgaggggaataactggagggatggggytgagaggggacatgggygaagctgcagaggaacaggcagaaggatgcagagcacagagggatacacacaacacaggacaatgtgcagagcacggggtaatgcacacagcacgggagaaagcacagagcacagggagagratgcacagrgcaccgggagaggaggcacagagcacagggggaggcacagagcatggaggggaggatgcacagagcacggggagaggatgcacagagcacagggaggatgcacagagcacagggagaggcacagagcatggaggggaggatgcacagagcatgagggatgcacagagcatgggaagatgcacagagcatggggagaggatgcacagagcacggagagaggatgcacggagcacggggaggatgcaagagcacggggagagaatgcacagagcatggggagaggatgcacagagcacggagagaggatgcacagagcacggggaggatgcacagagcatggagagaggatgcacagagcatggggcagggatgcacagagcccggggtggggatgcagagagcagaggcggggaggatgcagagagcatggggcggggatgcacagagcatggattgggggatgcacagagcacagggagaggatgcacagagcacagggagaggatgcacagagcatggtggggaggattcgcagagcatgggggtggggatgcacagagcacgggtgggaggatgagcagagcatggagtggggatgcacacagcacggtggggaggawgcgcagagcacggggagtagatgcacagagcacggtggggagggtgcgcagagcatggggagaggatgcacagagcatggtggggaggatgcacagagcatggaggggggatgcacagagcatggaagatgcagctaaggatgcacacagcctattctctactgagccagaacccatagtggcctcaatagtcttaaaaaagagcacacrgctgggcacagtggctcacgcctgtaatcccagcactttgggaggccaaggcgggcagatcacgaggtcaggagatcgagaccatyctggctaatacggtgaaaccccgtctctactaaaaatacaaaaaaattagccgggcayggtggtgggtgcctgtggtcccaactactcaggaggctgaggcaggagaatggcgtgaacctgggaggcagagcttgcagtgagccgagatcatgccactgcactccagcctgggcaacagagcgagactccatcaaaaaaaaaaaaaaaaaaaaaaaaaaaaaaggagcacacttgaccagcttaaatattacagagaaaggaaaggaagaatttaatgtatattaagttatattaattattacgtatattatttactatgtacttgtacttctatcacatcctttattaatattttagcaattcaggtcttaacaatgttgaaatcttatttgaatgaacaaggtatatagatacctaatattaaggggagtgatgggtgcagacatttgtagaacaaagatacatcattcgaaggcttctgaccaggcttaactgaaagctggtttggacagatggccaaggagaaaagtcattttacgtatgagggagagaaaagtccaccaggaaagctggggattagagaaaacgagcttttgatagacaactgtcagcaaactggaggacagagtaattttagggttaaacagcagtaaaattaattagaaggttttgaaatgtgactcagaacagcaatacaaagccctaaaactacccactgctcctcatcatcatccaagtgtcattggagctaagcagaaatacaaccacagtcatgcttggagctctggagagttcttaagcactgtgttatgtcttctcttgtctaaggagagtggaacaggggcttgtgcttacagccctgaccatgtcccactgctgctgaggcactaaatgatatgttccttttcgagtttttcttatgcagtctggaaaagaaatgttgatttacagataagatgcagtcataccacttgtgtacattgtatcttctcaagatattttgaagacaagagaggggaaggggaaggggaagacaggaacaggaggaaagccagcaaaaattcatgctcagcatacaacagagtcttgcaaaatgcaggcggtgaatgttacgtgcgctcaccacaaaaatggtaactgggaggtaatacatttgtttattagctagattcaactatctccttcaaaacaacatggtgtgcccaacaaaaacacgcaatgatatgtccatttaaatagctaaatacctaaataaataccaactcccccctctccaaaaaaaagccccaaactgaagatgggctttctgttgatcagccccagtgctatgagctggaaaaacaggcagcttccttggttttctttcaggggtttgaatgagagatggagagaagcaatatgacctgatatcggaactccttcccagctctcccttccaggaatctgtgcttctgcagccaagactccaggtgtcatgcgctccacacccttgggaatgaacccaccatgcagggctttgtgtgcccctgctccctgctctgacttcctcaggtcctgcttggagatcatgctgctgtccctgctaaaactctttagtgtcttcttgttggccctggggtgaaatcccaacgcctcccgatggcctccgaggtgcttgcaacctcatgctgcccaccctgccaccacactgtgctcactttttcctctagctcatgctactctagccaacactggcctctggttggttctagaacattccagatcctctccctctgagggccattgcacctgctgtgcccatgtctggaacattctttacatggcttttcatgtagccagcaccttttcatccttctgctcttggtttcagtgttgtctccccagagggtcctttcctgatctcttatctaaagcagccccatcaccactattagcccccatcgcagtcctcctttggttttctgcctggtattcctattttgtttatgcgtctccttacttatttatctctaccttcaagaatgtgagccacaggagggctcctatgtcatcgctgtattccctcacttccagccctgcagagagcctgcacctcctcctggctgtaagcattaatagctgctaaacacaccctggtccaggtactgtgctgagcccctgatatctcatttaatccatatattatctggcccatggatattatttttttaatccctatttaaaagaggaaaccaagacacagcagggtcaaatgacctgcccaaggtcatgccatccatgacagtgtccgggtggttttgctttagaatttgtgctcttaaccactgcgtggcgctaccagaccttacaggatggtcaagcaatattgacggagtgtctgctgcaggtgctgtgctaagtgctgaatacattacatgttgagcagatgaatacgtgaaagaataagtgaatttgaggagcatgcggcaggcactgccccttttgcttcgggctttctgctccttcctgggtgatacacgtcccacatctttctccagcaccatgacttgccagggagcatggatgaaactgagaaggcgctggatggaggttttctaagatgtgtgcctaatttaaaaggggccgggagtcaaagtcccctggagagaactaaggggggtggatggacaatggcagtattggaaatgtgacagcaatggccttggagcctgcagatttccccaaagagaaaatccaattagatggactatcttacgtcagcaaatgaaaacagaaggtgaatgcataatttcatgagaacattctttttctctgcttattagattaggtgatctaacaaggcactctgcttctctcaataccaggaagtaaaatgcattttaactgtgccaggagttgattttgctatttgccgtttgttgtgggatgacacgtgacacctaaatattctctcatttaaacaatatctagcatgctgcacaatgggaataagatgctccaggaggccccactgctgaaggacacagacccagagtggtcagggctccatgacagggacacgcccaaagcactgctggagccccaggaaaggcttccaacccagaagtcagcctggggagggggtgcccaagggagctgggaaagatggggaagaatgagctgggctggtggggaaaaggtgaggagaggaatgggaaatggggaggagagcattccagcgagaggggactgcatcctcaaaggcatgggggtgcagaaacagcatgctagcgggcaacgcgcagaggggaggggaaatgacacggatgccaggtggtcagggcgcagggcctgaggcagggagacccgctgctgctgagacaggcaggctggggacagaacctacatgctgcccaatgctgctgactttatcctgtgccatgcagagccgccaaacacggaagggacctgagcagacacaagcttcagagccacaggtggttctgacagccacacagatgagacttggaggggaaagagaaaaatacaggctccaggaaggttagcaaggaggctggtgtgagcgtccatacagagcaccaggccaggacacaactggatgggaaattcaggggggcccagaatcaggaactgcgtaacagactgaggactcttgcgtgatgtcaacagagatgggtcactcataaaggagagaagagacatgagttcagtcttagccatggatgtagtttagatacttgtccccactcaaatctcacattgaattgtaatccccaaagctggaggtggggtctggtaggaggtgtttggattgtgggggcggatccttgatggcttggtgctgtcttcgtgagaatgagtttttgcaagatctggtcaattaaaagcatgtggcacctcctcctcccaccccttcctctcactttctcccgctttcatcatacgaggtacatgtttccactgcaccttccaccatgactgcaagctttctgaggcttccccagaagctgagcagatgccgatgctatgcttcctgtaaagcctgcagaaccgtgagccaatgaaaccttttttctttataaattaccaagtctcaggtatttcttcatagcaacgcaagaatgtcctaatccagccatgctcagtgctgagagctgttctctttcttggacacgtcatgggagcaggtgactcctacggtttggagacacatggtgtccaccctcatttagagaggacaagtagactcccatcctttttggccgagtactgtattttctgatttcaaaatctttggacatactggctgaaaacgagtatttagaatttgcatgaaaatattaccatgtaggtaaagttcttcctgataaaatgtcctgcatttctgaaatgatttgagtattgactcaaaacatgaatgacctccaaattgctttcagatcaatattgaaattatccaactttaactttacccttatataatttagttacacagtttgaatgagatggatttcattaagataacatatgttacactccaaagcatgggagagctgaaagaaaccccccggccccagaagtgaatcagcctttctcttgtgttctgccaggattctgtaacaagactttccctattcggccttatttcttgtttacttgtcttcctcccacactgggttgagctaaaaagcagaaacaacacctctaaacctagcacaatgcctagcatagaagaagtgcttcgtaaataaacgaatgagaaactgaatcattatcatagaaacgcaacccaatctggatagaatgtgtcagaactagttggatcaattaaaaataaaagaaatatgcttcaaattgcttacactgatcatacagggggtatggggtggggacaatctcattcattccttcattatttcaagaattctgaatgttctccggtcatccagttcaatgctgacaacatgttatcaatttcaaactgcttaaatgagggaaacagggaaagaaaagtaagagattggcatcaattacttagaatacgaaaaaactcattgatgacatgtcaactttttcctattatttctttgaagaccatacgtattgttggagggtttaattattctgtacagcatattcatgccatgccaaagtgtcacaagacagttcttgtttgtcaattaacaccagcaggcagtatagatactctttgcaattaaatcatgccaggcaatgtaggcttcagtgatttcttcttcctggtggatccatttggtattcgaacaaagcatccaaccgagttttttgctgaagatttactttatcatgtcatcattccacaaattacaaaatcattcatatgtaaatttgggtaatggatttcttttattagaatgtggaaatacagctacaaatactttcatatgtgggactaagggccaagagctttaacaaaacatagcaccgaataaagatcataattaaaaatcatgatcaggattttccaagttactaaaatgatatcctttaatgaaaactgtccattccacaatcacaggtaaataaatatagagaaaagatctggaaggcaaacggtatgcacccagaccggaccctgcatcctctgaaaacactcactctggttttcagcagaaactctagactagctggaatcatgaagatcttcatgctgctatcattggcttttctggactattttatgaaaagatcagacagttgaaagattctctgtaaaaccagtatactgaggtataaaataagaggagaaaaatgaaaaagaagtatcgaagacatctggtatttctcacatctcaactttgctcaaacttctttcagaaccttgtctttgcaaatatttatgcttcttttttatggcacaagttatcacagcctggtaaagaactcatggtctgggttctcatcttaaagaatgaaagcaaagcatcgcggccaccaccctcaatgccttgccctcatcatcttgccatcttcctcctgcccctgttcattgtttgctcacagggtgtcaggccttggggcattcacttttttttttgagactgagtctctctctgtcacccaggctggagtgcagtggtgcgatcccggctcactgcgacatctacctcccaagctcaggcaattctcctgcctcagcctcctgagtagctgggattacaggcacacaccattacgcctggttaattttccgtagttttagtacagatgg

SEQ ID NO: 17855 - DNA, 12591 bp, Homo sapiens
  misc_feature (1)...(12591): n = A,T,C or G, or insertion/deletion polymorphism (see Tables 1-2)
ttgctgaaagatattagagacagcataaagaagtgaaaatatatcctgtgttcatgaattggaagacaatattattaagatgatagtactacccaaagtgatctacagatttaatacaatctgcatcaaaatcccaatggccattttttttttggcagaaatggaaaagccaatcttaaaattcatgtgtaattgtgcaagacctcaaatagccaaaataatcctaaaaaataacaaagctggataactcacatttcccaaattcaaaacttcgtataaagctacagttatcaatgctttgtggtactggcataaggacagacatatatataaatggaatagaattaagaagcaagaaataaacccataaatatattcatgggtatgtacctcaaatatggatggttcccagcttataatggttggacttacaatattttgactttatgatggtatgaaagcaacatgcattcagtagaatccatatgcataaaagtacttaaagtacacatacaaccattctgcctttcactttcagtgcaatattgaataaattacgtgagatagtcaacacttcattataaatttggctttacgttatatgattttgcccaactgtagcctaattgtaagtgttctgagcatgtttaaggtaggcctggctaaattatgatgattggtaggttagccgctgatatggtttggctctgtatccccacccaaatctcacatcgaattgtaatccccgtgtgtcagaggagaggcctggtgggaggtgattggatcatgggggtggatttccccttgctgttcttgagacagtgagtgagttctcatgagatctgatggtttaaaagtgtatgacatttccgtccttcactctctgtctctcctgctccaccatggtaaggcgtgcttgcttcccctttacctgctgctgggactgtaagtttcctgaggcctcacagtcatgcttcctgttaagcctgcagaactgtgagtccattaaacctcttttcttcataaattaccaagtctcaggtagttctttatagcagtgtgagaatggactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatcgtactcaaagttctagtcagggcaattagtcaagaaaaagaaataaaaggcatccagattggaagggaacaagtaaaaccatctctattcatagatgcatagatggcatgttcttatatagaggacactaaagagtccaacaaaagaaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggyyctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtccyggagctggcgggcaacgaggcccagaacagcggagagcggaacatcactcccctgctgctggacatggtggttcacaacgacaggctactgagcaccctttkcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtccagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggatttttttttttttttttttttccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttatttttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaa

SEQ ID NO: 17856 - DNA, 24475 bp, Homo sapiens
  misc_feature (1)...(24475): n = A,T,C or G, or insertion/deletion polymorphism (see Tables 1-2)
gtgagggaagtgaagttgggtgggagcctgaagagaatgagcgtggtctatgataggtggtgctggtgctagtggatgtggtggtgatggtggagttgatggtgatgatggaggtggtagtgatggtggagttgatggtggtgatggaggcagtggtgatgatggtggtgatggtgatgataaggtggtggtgaaggtggagttgatggtgatgatggaggtggtggtgatggtggagttgatggtggtgatagaggtggtggtgatggtggagttgatggtggtgatagaggtggtggtgatggtggagttgatggtcataaggtggtggcccatggtggagttgatggtgatgatggaggtggtagtgatggagctgatgatggtgatggaggtagtggtgatggtagagttgatggtaatgatggaggtggtggtgatggtggaattgatggtggtgataaggtgatggtgatggtggagttgatggtgatgatgaaggtggtggtgatggtggagttgatgatggtgatggaggtggtgatgatggtggagtcaatggcaatgatgaggcgatggtggtgatgatattggaggtactggtgatgatggagggaatgtggtaggaagtagcattcacaacagagggaacaatatattcaaagaatcagtagtggtggaacctctgcatgtctgagaagctgaaggactagtgtggctggcatgtggttggtgagagagaaggagcagagaccaaaaggaaagcagaatccacaccacagaccctagagggccttgtagaatatgttaagcatttggatcctagtcctaagaacaactagatgccacagaaaagcttaaacatggggcgaggtgaggtgatcagatttgcattgtgaaaagatcattctaattctttatggtccaataatggtagctactagctacacatggctactgaacactgaaatattgctagttttagtagagatgtaaaatagacactggatttcaaagacttagtataaaaaatgtaaaatatctcattaatttaaaaatattaattatatcttgaaaaagtatttcagattaaatgtaattaaaatcaattttaaaattatttttaaaaacaattactaggccaggcatgatggctcatgcctctaatcctagcactttgggaggatgaggtggtaggattgcttgagcccaggagttcgagaccagactgggaaacatagggagaccctgtctccaataaaacaaaaaagtttgctgggtgtggttgcacacacctatggtcccagctacttgggaggttaaggcaggaggatcactggagcccaggaggtcaagactgcagtgagccatgatcatgccattgtactccagtctggatggcagagcaagaccctgtctcaaaaacagacaaaacccatttcccccactccccaaaaaaccaattacctgtttcttgttaacattttaaaatacagctattaaaaattaaaaattgggggcagccatggtggctcacacctataatcccagcactttggaaggccgaggtgggtggatcacttgaggtcaggagtttgagaccagcctggccaacatggtaaaaccctgtctctactaaaaacacaaaaattagccaggtgtgttggtgggtgcctgtaatcccagctactctggaggctgagacaggagaattgcttgaactcaggacgtggaggttgcagtgagccaaaatcacaccactgcactccagcctgggtgacagagtgagactccatctcaaaataataataaaaaaattaaaaattgcatatgtggctcccattgtatttgaactagatggtgctactctaagtgcagtatggagaaggtgctacggagaaggcacagtagaggagaacatttaggaagttgtctttgtactccaggaaagagaggaggaggtagcttgaactaggatgacggcggtgggaataaaaagagttggatgaattcaaggtaaaatgagcacaactaagagctgcagcagatgcatctggatggatggtggagcttcatgttgaaataacaccagaaaaaaatcagccttggtgatatggtttggctctgtgtcctcacccaaatctcatcttgaattgtacttccataattcccatgtgttgtgggagggacctggtgggagataatttgaatcatgggggcagtttcccccatactgttctcgtggtagtgaataagtctcatgagatctgatggttttataaggggtttctgcttttggatcttcctcattttctcttgccgccaccatgtaagaagtgccttttgcctcctgccatgattctgaggcctccccagccatgtggaactgtaagtccaattaaacctcttttttttttttttccagtcttgggtgtgtctttatcagcagtgtgaaaatagactaatatagtaaattggtaccagtagagtggggtgctgctgaaaagacacccaaaaatgtggaagcaactttggaactgggtaacaggcagaggttggaacagtttggagggctcagaagaagacaggaaaatgtaggaaagtttggaacttcctagagacttgttgaatggctttgaccaaaagcatgatagcaatatgtacaataaagtctaggctgaggtgatctcagatggagatgaggaacttgttgggaactggagcaaaggtgactcttgttatgttttagcaaagagactggtggcattttgtccctgccttagagatttgtagaactttgaacttgacagagatgatttagggtatctggcagaagaaatttctaagcagcaaagcatttaagaggtgacttgggtgctgctaaaggcattccattttataagggaagcagagcagaaaatttgcagcctgacaatatgacagaaaagaaaaacctgttttctgaggagaaatacaagccactgcagaaatttgcataaataatgaggagctgaatattaatccccaagacaatagggaaaatgtctccagaggtcttcacagcagcccctcccatcacaggcccagaggcctaaaagaaaatggttttgtgggccaggcccagggtccccatgctgtgtgcagtctaaggatttggtgccctgtgttccagacactccagccatgactaaaaggagccaaggtacagcttgggctgttgcttcagagggtggaagccccaagctttggcagcttccacatggtgttgagtctgcgggtacaccaaagtcaagaactgaggtttgaggaacctccacctacatttcagaagatgtatggaaatgcctggatgtccaggcaaaagtttgctgcaggggcagggcccagatggagaacctctgctagggcagtgcggaagggaaatgtggggttggagccgtcacagagagtctctactggggcactgcctagtggagctgtgagaagagggccattgtcctccagaccctagaatggtagatctgccgacagcttgcattatgcaactggaaaagccacagacactcaacaccagcccatgaaaacagccaggaggggagccataccctgcaaagccacaggggcagagtggcctgaggccatgggaacccacctcttgcatcagcgtgacccagatgtgagacatggtgtcaaaggagatcattttggagctttaagatttgactgccctgctggatttcagacttgtaaggggccagtagcccttttcttttggccaatttctcccatttggaatggctgtatttacccaatgcctgtatccccattgtatctaggaagtaactaacttgcttctgattttacaggctcataggtggaagggacttgccttgtttcagataagactttggactgtggacttttgagttaatgatgaaatgagttaagactttgggggaactgttcgttttgaaatgtgaggacatgagatttggagaggccaggggcagaatgatatggtttggctctgtgtccccactgaaatctcatcttgaattgtactctcataattcccacatgttgtgggagggacctggtgggagataatttgaatcatgagggcagtttcccccatactgttctcatggtagtgaataagtctcatgagatctgatggttttatcaggggtttctgcttttgcatcttcctcattttttcttgctgccaccatgtaagaagtgccttttgcctccggccatgattctgaggcctccccagccatgtgaaattttaagtccaattaaacctcttttcttttccagtctcaggtatgtctttattagcagtgtgaaaatggactaatacacctggcaaaaatattttgagctcagattgggacatattgaatgtgcatgctctgagacaaatgtctcaagtaggcagttgcctatctaggtctggagctcaggtgagatatttgggcaagagatttaaattggaaagttattgggttatggacagcataaatgagattcattaagaagaaagcagccagtgagaagtggcctcggacctagacttgggaaatggggcagggaaggagataacattgaaaaagagggtttaaaggaaagactaagtatgtggtcattcaaggaaaaggagagaacgtttaagaaaggagaggccagctgggtgcgatggctcatgcctgtaatctcagcactttgggagtccaaggcggtgaatcacctgaggtcaggagttccagaccagcctggccaacatggtgaaaccccgtctctactgaaaatacaaaaattagccaggtgtggtggtgcgtacttgtaatcccaactacttgggagctgaggtaggagaatcgcttgaacctgggaggtggaggttgcaatgagccgatgagccgagactgtgccactacactccagcctgggcgacacagtaagactttgtctcaaaaaaaaaaaaaaaaagaaaaagaaaggagtggtcagtcacatctgctctgagaggttaagcaacatgaggaccaaaaaatgtctgggggagtgagaaatgcagtggtccctgataacctttgcaagtgctgtttggatggagtgatgaggtggaagccagactggaatagagggaagactgggtaaaaggagaggagatagagacagtaggtacagaaaactctttaaaggtgttgcgctgtgaagtggagagagagagaaagagagaagtttgaaggagaccaaaaagattttttgctgttgttcattttaaaaataaatatggaaaacttgagcatgtgtgaatattggtaggaatggtctggataagatggaatagtagaacacaaaagaaaagagagggataataagcagagcatctagataacatctacataggacaagtgggtacccagcatccttggaggtcccctcttctactgtggtaggaaggtggagggggtgtttgggtataagttcaggtgtgggaagttagaatttctctagatggttttaattttctctgtgaaataagagataaagtcattcctggaaaggatgtgaggaggcagaagctgctggtggctggacaagagtggagtaagcttgagacagtgttgcaggaattgcaagagagctggctcaagaaatgcaataaagtacctggtctcctctaagaaggcatgtcatagggttcttttaggtttggggttttgtcacataggggcataaggagaagagacagtgatggctccagaatttctgtttagtagagctttagaagaagcaatctgatttggggataggagggcttgaagcatcttgtacagtattttacattaggtatattaagaaaacatcaattgttcatatagaagaacagggaagacataggaaaattgagaatgatgtaaagccctctcctgcaaccttgcgttcaccaacaccaccggaaagagtttctggttttggcaagggtgatatggagattctgaagtctgggagctcttccaaaagccagtaagaagggctgtgcactatctgaacttccctgaagtagttcattccagcactcctgggcagctggcattcatgttcagaccatctggtggccacactcaggatggattttttcccctataaaaaggggtcaggtctctctgttttgcaattagcaatttggggggccaagtatgactccccatagtatgctatgagaatgggaagcccagggatctgctgattcttctgctgtgaggtccaacttgaaccaagtatttgtctgagaagaatggaggtaacaaatggattggaaagaggagggatcagtggactctgatcaagatgcaggaggtttgaatgagtcgttctgaaggctgggtaactgtaggtgatgacaaagtccagggcgtggctgaaggggcatagaggagaagatccctgcagaggaggaggtaaaggaactgagcagccagggtgttgggtaggtcatctgtgggaacactgaaggcattgggtctcctggaagatcttgagaagaagaagactctgagcaggtcccaaagtcttcaaaaagtaagaggagtaactaggaggtcagcagatggtgacagaagttgaagggcatgaggacaatgtggtccagtggcatgagactagagcctcacgggaactggttttcttacaccatgttgcccaggctggtctcaaactcttggcctcaggtgatcccagaggggcctcccaaagtgctaggattacaggtctaagccaccatgccgggcctgtttttagttaatttttttttttctaagacagagtctggctctgtaacccaggctggagtgcagtggcatgatctttgctcactgcaacctccatctcccaggttcaagcaattctcctgcctcagcctcctgagtagctgggattacaggtacctgccaccatggctggctaatttttgtattttcagtagagatggggtttcaccatgttggccaggctgatctggaactcctgacctcaggtgatccaccctccttggcctcccaaagtgctgtgattacaggtgtgagccaccgtgcccagctatttttagtttttaaaggaacctccatactgttttccatagtggttttattaatttacattcctaccaacagtgtacaatggtaaggatgtggagaacatccttaccagctctgatattctgtctttttgataaaagccattctaactgtgtgagatggtatctcattgtggttttgatgtgcatttttctgatgattcgtgatattgaacattttttcctataccccttggccatttatatattttctttcaggaaatgtcacctcatatctttttccccatattttaatcagatttttttttttttgctgtggagttgtttgagctccttatatattctggttattaatcccttgtcaaatggatagtttgcaaatattttctttcactctgtgagttgtctcttggttgttttccttgctgtgtgtaagctttttagcttgataaaattctatttgtttatttttgctttggttgcctgtacttttgagatcttatgtaaaaattctttgcccagaccagtgttctagagcggtccctaaaggtttcttctagaactttcatagcttcaggtcttagacataagtctttaatccatttttatttgattgttgtatatggtaagagataggagtttagtttcattcttctgcatatagatatccagttgtctcagcaccacttattgaagagactgcgctctccccattgcatgctctggtacctttgtaaaaaattagttggctgtaaatgtgtggatttacagctgggttctccatgctgttccattggtctatgtgtcttttttttatgccaatatcatgctgattttgttactatggctttgtagtatattttgaagccagatagagtgatgcctctggcttcattctttttgctcaggactgctttggctattcagagtctttcgtgattccatataaattttaggattgtttttctatttttrtgaagaatgtcattagtcttttcatgaggattgcactgaatctataaattgctttggwtagtactgtcattttaaaaatattaattctgtcaatccttgagcatgaaatatctttccattttttggtgtgtgttctcttcaacttctttttccagtgtgttataattttccttgtatggataaatgaaattgctttcttgatttctttttcagattgttcactgttagtgtatataaatgttactaattttttttttttttgatacagggccyggctctgttgcctagaatggagggcagtggtgcgatctcagctcactgcaacctccacatctggggcttgtgatcctctcacttcagcatcccaagtaggtgcaggtgcacgccaccatcgccaggtaatttttgtatttttttttggtatagacaggctgcccaggctggttttgaactcctgagctcaagccattttcctgcctctgcctcccaaagtgctgggattacaaagtcagctaccgcacccagcactactgattttttgattttgtatcctgcaattttactgaatttgttcattagttctaatagctttttttgtgtgtgtgaagtatttaggttttcctaaatataagatcatgtcatctgtgtacaagcctgatttgatttcttcctttccaacttgggtgcccttgatttctttctcttgtctaattgctctcaccagtacttccagtattatgttgaataaaagcagtcaaagtgggtatccatgtcttgttccaggtcttagagagaaactttccatttttccccattcagcatgatattggctgtggtttgccatatacagtgaggtatattccttctacacctagttcattgagggtttttatcatgaaatgatgttgaattttatcaaatgctttttcatcatctattaaaaagatcatatggtttttgttcttggttctgttaatgcaacgaatcacatatattgatttgcttatgttgaaccattcttgcatcccttggacaaatcccacttgatcatagtgaatgatctttttaatgtgctgttggattcagtttgctagtattttgttgaggatttttgtgtctatgttcatcagtgatattggcctgtagttttctttttgttgttgttgtgtccttatctggtttgggcctcaggacaatgctggttttgtagaatgagtttggaagaattccctccttgtcaattgtttttgaggagtttgactagaattggtatcagttatttaaatatttggtagaatttagcagtgaagccatcgggtcatggggttttctttgagagaaattttttattatgactttgatctcattacttgttattggtttattgaggtattctatgtatgcacagttcagtcttggtaggttgcatgtgtctaggaatttatccatttcttctaggtttttcaatttgttggtgtataattgttcatcctagtctttaatgattctttgtattctgtgatatcagttgtaatgccccccttttcatttctaattttatttatttcttctctcttttttcttagtctagctaaaggtttgttgattttatcttttcaaaaagccaactttttgttttgttggtcttctgtatggtttagtctcaatatcatttatttctgctatgatctttattatttctttcctcctattaatttttggttggtgtaggctgggcgcagtggctcacgcctgtaatcccagcactttgggaggccgaggcaggcggatcacaaggtcaggagatcgagaccatcctggctaacatgatgaaactctgtctctactaaaaatacaaaaaattagccgggcgtggtggcgggcacctgtagtcccagctactagggaggctgaggcaggagaatggcgtgaacctgggaggtggagcttgcagtgagccgagatcgtgccactgcacttcagcctgggtgacagagcgagactgtctcaaaaaaaagaaaaaaatttttggttggtgtgatggttaatactgagtgtcaacttgattggattgaaggatgcaaaatattgatcctgggtgtgtcatgagggtgttgtgaaaagagatgaacatttgagttagtggactgggaaaggcagacccatgcttaatctgagtgggcacaatctaatcagctgccagtgggctagaatataagcaggcagaaaaatatgaaaaagagagactggcctagcctcccagcctacatctttctcctgtgctggatgtctcctgccctctaacactggactccaggttcttcagttttggaactcagactggctctccttgctcctcaccctgcagacagcctattgtgggaccttgtgatcatgtgagttaaaacttaataaacttccctttctttatatataaagggaatatatatatatggaatatatatatgtggaatgtatatatgtggaatgtatatatgtggaatgtatatatgtggaatgtatatatgtggaatgtatatatgtggaatgtatatatatgtggaatgtatatatgtggaatgtatatatgtggaatgtatatatgtggaatatatatatatgtggaatatatatatggaatacatatatataaaaaaggaatatatatatatatataaagggtatatatatatatatatatgtaaagggaagtttatatatatgttatatatatattccattacttctgtccctccagagaaccctaatacagttcttgcttttctagttccttgaagtgtatcattaggtaagtttatttgatgtatttttactttcttgatgtagacatttattgctataaacctccttcttagtattgcttttgctgtatcttatagatttgggtatgttatatttccatttctatttgtttcaagaaattttaattttttcttcttaatttcttcattgacccattggtcattcaggagcatgttgtttcatttttatgtgtatgtgtagtttccaagattcctcttgttattgacttctagctttattccattgtggtcaaaaacaatatttgatatgatttctcctttttgagtttgttgagacttgttttgtgggctaaaatatggcagactctggagaatgttccatgtgctgattcaaaagaatgtgtattctgcagcagttgggtgaaatgctctgcaaatgtcagttaggtctatttggtctagtgtgtagtttaattctgatgtttccttgttgatttgctgtctgcatgacttgtccattgaagtcccttactattactgtactgcagtctacgtctcccttgagctccattatgtttgccttatatacttcggtgctctgctgttgggtgcatagatatttataattgttatagcctcttgcaaatcgacccctttattctcatatagtgaccttctttggctctttttatagttttttactttattttatctgacataagtatagctactcctgtttttttgtttgtttttacttgcatggaatatcatttttcatcacttcactttcaatttatgtgggtttttatagatgaggtgggtttcttatagctggatcttgtttcattatccattcagccattttatgtcttttaattgaagaattaaatccatttacatttagtgttattattgataagggcttactactgctattttgttgcttgtgttctcctttttaaactcctttcttactgtcttcctttgtggttaagtgattgttttggtagtatgttttaatttattgctttttatttttagtgtatctattataggtttttgcattgtggtcaccatgaagcttacaaaaaatgtcttatagatataacaagttgttttaaagagatgataatttatcttagatcagaaaaaagaatagaaacaaagaacaaacttaaaaaacaaaaaaccctctatacattgactccaataccccccacattttgacttttcttttctcagtttacatacttttatattgtctgtctgttaataagttgctatagctattattgttttgcatatacttgccttataggtttcctactagagttttgagtggattgcataccataattacagcactggagtattcttgggttgtcttcatactagtgggttttataccttcaaatgttttctttttgcatgttagtgtttttttttctttcaaattgaagaactccctttagcatttcttgtaagacaggtctggtggttgtgacttctcttagcttttgtttgtctgggaagagttaatttctctttcatatatgaagaatagcctttccaaatatagtattcttgggtggcagggttttttcagaacattgaaaatgttgttgcgtaccctcctggcctgtatggttttcgttgataagtctgttgccagatgaattggagtttctttgtatgttacttgcttcttttctcttgctgcttttaggatcctctctttatccttgacatttgggagtttgattattttatgccttgatgtagtcttatttgggatgaatctgtttggtattctctgaccttcctctacatggacatttatatctttttcaatttttggaaagctttctgttactatttatttgaataagctttccatcccttgctcttgctcaactacctcttgaacaacaataaattttagacttggtcatttccatgtattttaggtaaactttcttcctgttcaatcttttttctcttttgactgtgtgatattgaataggctatcttcaagccaactgattccttcctttgcttgatctattctgctgttgagaccctctaataaatttttcatttcagcaaatgttttttcagttccaagatttgtttgatttttaaaattattatttcaatctctttgttaaatttctctgataaatttctgaattgcttttctgtgttatcctgaaggccactgagtttccttaaaattgctattttgaattatttgtcagagagctcatgtatcgccatcttcttagggcctgtcatgggtatcttgctttgtccagttagggaggttttggttccctatttgctgttgtttcttgtggatatacctctatgtctttgcattgaaggatttgttatttattccagtcttttctggcttgttttggtttttatttggtatatttgcctagagattctttgtaatttacttgttaatttcttatttcccccaccactaagttgccacctcctttttggtgctagatgatgccttaagcacaggtttgcctcagctctagcaaagaatcagagtgctgcaagtcccaaatggaagaagtcccagtggggatatcttgccaatttgggaaggctggctagaggttcatgcccaagggacctgtggaaggtaattcctaaagctagtgctgctaaacagtcactctgatttggcatctcctttggcttaattacagagcagagtttccagggctgggcaaggtagtcccacctctcaccttgacttttgctgtttgcagggatatttctttcttcaggcacttgtgatgctttctgtgggttgaggcaggtacagttcccctgcyrgggagccgaaggtgatggggaagctgcttgtcgacctctatctcactttttccagggtagaaactatgagtggggaggaattttccccatgcttcatgacaggcagattgtggggaggggcatcgtggatgtggaaatctgattctcttagtctattccaggctttttcacttgtctgtggccccaggaactgactcatcctcatctttgagttctgggatattgctggtgataatatctgcactgtctatttgttttgagttttctgtggacagggaaatgaagccagtatgccaccattttggaactgaaattctccaaagtatacactttaagtcgctatgataagcgactctcataggccaaattcttttaaacatgacaagtcttaaaaaatcaagtatccaccaattctttaacacaaaatattaatataaatactaattatacatcttccagaggttgcacctagaaactttttggagtaagtaagactgtccatctaagtgcccaataggacaaaaaccttgcaggctttgaaagattcttacacacccataggaaacgattacatcattgtatgtaatttggggaattccttcttagatacttggccagcaatattggctgagaagctgacagtagtcttgtctgtgaccctgaccagtacacactgagctctagttatacttaataatagaaactgaatgaaaagaaaacagtggttacacagcttatattcctgactttgaatcatatcatgactcattgtttttccaactacatggaagttggcaacccctacacagactggcataccacaaagttggactcagcagttatttggctaagatatatatatagatatatagatatatatctatattatatatatakagagagagagattgagagagatggagtctcaactctgtcttgcccaggctggagtgcagtggcatgatctcagctcactgcagcctccgcctcttaggttcaagtgattatcctgtctcagcctcccaagtagctgggaatacaggcgggtactgccacacccagctaattttgtatttttagtagagatggggtttcaccatgttggccaggctggtttcaaactcctgacctcaggtggtccacctgccttggcttcccaaagtgttgggattacaggcgtgaaccaggctaagatattttagtacatttttcaaggtgctccaaataagttagaacttgataaaattctaccttcttttcatattcttctctgaagtggtctgaaaggccatataacccttatatatattaaaatgatatcagtcactcatggttttgcttgactatgtgggtgaaaatagtgcactatatttcttcattcccatctttaaatgaagtcagctcttgtgtggtggaggcaagatgtcagtcaagacaaggggcctggtctaggcttctttcccctgaagtcttgtctctgcaatggccacttcagatgtttatactccattcctccaggtctagcccatattctgaaaaggcaaggcaatccaccactcaacaagtattcattgagtgccagccatgctattggggatgagaatagttcagtgcataaaagaaaacaaaatccctgccccatgggatttacatccagtcatacttagcagatgtgtgtgaatctggaagcaccttttctatagcctgacagaattcttacaacaggtgaaaactacttgccttgtcttcgggagccttgtgcatttggatctatcctttaacaactaaccttgtctatcatcctcacagtctgactctttacttctgggatagtccaacagagacttgaggaaatgtttccttctctctttttccattttcccaaatttaaattcatgaaatatatataagttctctaaattaaaaacaacaggatattttaccaactttctgttctgarctaatttaaaatttatgtttccaatccccagagatatgaactaaaaagcctgaaataaatgtagatcagtcacttgagctgacatatgaagcagtcaactttactctgagacgttttgtttgatctttcaagtttctaaaagtatttggaagcgggaaacactgttcttcatatgagataaaaggaagaaaaaaggaccttatagtcaggctcattgtgaaaaaactaatattaagataagctgaagcaatcaaatgagagcatttgcaaatcacttgttggaggtaaagctggaagcctatgtagttcaggaaaatggaagatgagatggctgagatcccacgaaaagaccacgtccaatagaaactgtaataaaacagagctcagctacaggaattttcaatgatgacaaaattttaaagacatgcttctacttttgtattgactaaagatcttcaggttgaaagtgtcaagatctgcttaatagcatatcctctgttgcaacattcaaaatcatcaggattcttagatctcagtgaaaaattgatgtttgaagaataattgaagtattcagtccataaggaagcctgaagctccctatacaccttgaatttcatgctaaataatctgcaagttctggaaaatgctgcttaactctagaaaaactgactaaccttgatcttggtcagcatatacttggttctttacatatcacttatcaatggtcagaaagggaagaatacttgaacttatctaacacaaaaattcacaatttaaccaattgtttcccagacacgaggcttactagaagtgagccttgtaaacttttatttagctgcaatttaaataactttacattttcagatatgtgttgaagaccctaccagatgctttcttcccctttgagaagaagcaggaaaagaaaactttctctaaagggcaacttgactcttttcacacactgaagactttggaagctggtggcaacaacttcatttgctcctgtgaattcctctccttcactcaggagcagcaagcactggccaaagttcttatcggttggccagcaaactacctgtgtgactctccatcccacgtgtgtggccaacaggttcaggacgtctgccttttggtgtcggagtgccacagggtggcactggtgtctggcatgtgctgtgccctgttbctgcccatgggggttctgtgccactgtttccacagcccgtggtacatgaaaatgatgtgggcctggctctaggccaaaaggaagcacaggaaagcttgcagcagggacatctgctatgacgcatttgtttcttatagtgagcaggatgcctactgggtggagaaccttatggtccaggagctggagaacttcaatcccctcttcaagttgtgtcttcataagtgggacttcattcctggcaagtggatcattgacaatatcattgactccattgaaaagagacacaaaactgtctttgtgctttctgaaaactttgtgaagagtgagtggtgcaagaaggaactggacttctcccatttccgtctttttgatgagaacagtgatgctgccattctcattcttctggagcccattaagaagccatttgccttagtcaatctgggctgctatagcaaaaatgccaatagactgggtagtttatagataagagaaattcatttctcacagatctagaggctgggaagtccaagatcaaggtgttggcagatttggtatctggtgaggaactcttccaggctcaaagatagctgtcttctcactgtgttcttggtggtggaaggggtgagggaactctctgaagtttcttttggaagggaactaatcccattcatgaagcttctgcccccatgacctaatcactcatcaaagggcccacctccagtacctcacattgggggttaggatttcaacagatgaatttcaggaggacacaggccttcagtctatggctaggatcattccccagcatttctgttaagctgcagaagataattaacacctagacctgcctggagtggccactaatgaagctnagcgggaagggttttagttaaagaaaactcctagtttttagttcgaccattgtggaagacagtgtggtgattcctcaaggatctagaactagaaataccatttgacccagccatcccattactgggtatatacccaaaggattataaatcatgctactataaagacacatgcacacgtatgtttattgcggtactattcacaataacaaagacttggaaccaacccaaacgtccatcaatgatagactggattaagaaaatgtggcacatatacaccatggaatactatgcagccataaaaaaggatgagttcatgtcctttgtagggacatggatgaagctggaaaccatcattatgagcaaactatcacaaggacaaaaaaccaaacaccgcatgttctcactcataggtgggaattgaacaattcccacctggacacagggtggggaacatcacacaccagggcctaacgtggggtggggggctgggggaggggtagcattaggagaaatacctaatgtgaatgacgagttaatgggtgcagcacaccaacatggcacatgtatacatatgtaactaacctgcacgttgtgcacatgtaccctagaacttaaagtataataataataaataaaacatatcaaaaaaaagaaaaatgagcttgggagtcatcatgcctcctgctcccttcccctgcccccagcccccagccccacttctggctgggacctttgaagagtgcagttccctcttccccataattcattctgtccatctactcattccaacacactttttgatctgatttctatggctcagctccaaggtgcttgcctcagtcccctggcccgcaggagcccacaaaaaaaaaaaaaaaaaaaaactcctagtttttaaaagggaaatatatacaacatgaaatattctgttttcagaacttggttctatgttaacttagaagtttactactattattttgcataggcaatatttttgaaatgtcttaaaaaattacggacatacggacatctgtgcagagtaaaaaaattttgaagaatgtatgttcatgtataaagatctgtaaaataatgcaggatttatggcatattttcattaagtggttttcggtggatgagtttcttattatttcatctgacaattacaatatactttatgtgaaaaagacatagactgtgtgttttgttttgttttttcgaaacagagtctcactcttatctcccagcctcaacacactggactcaaacgatcctccaacctcagcctcctgagtagctggggttacagctacaaaccatcatgcctggctaatttttgaatttttgtagagatgggggtctccctgttttgcccaggctggtctcaaactcctggactcaagatcctcctgtcttgggctcccaaagtgccgggattacaggtgtgaaccaccacgctggccttgtgttttcggataactttcagataacagcttaggatttcagttagatgctcaaaactatgaatatatacaatgaaagttaccctttccccaaatattagtacatttcatatgccgtgttgattttctaactttaatcaacatttttttttttttggtagagagttataggaggtcttatatctagatacagaaggagacttggagtctaacctgggatttgccacatgttaactgtgagccatgcgactctgggcaagttccctaatcactttaaccaaaggaatagtaatatcagaattatttattgcatgtgttattgtaagattcagatgaaattctagatgtgaaggtgcttcaaaaatgtcaagaactaggccgggtgctgtggctcacacctgtaatcccagcactttgggaggcctaggctggtggatcacttggtgccaggagttcgagaccagcctggtcaacatagcaaaaccctgtctctaccaaaaatacaaaaattagccaggcgtggtggcacgcacctgtaatcccacctacttgggaggctgaggcagagaattgcttgaatctgggaggtggagactgcagtgagatgagattgcaccactgcactccagcctgggtgacaaaacgagactccatctcagaaaaaaaaaaaaaaaaaaagaaaatgtcaagaactgaacaagtataaggactgtgtctgaattggacgtgctaatagctttgtggacagtgtacaactaccttcaatatatgcagaggacactgatttgtggctaaataaatgatttctatctgactttgccagacaattctaattgactttgggattatagagcaatagcatcaaaatccaccttaggcagttcaactagggaagagaaatagagaaaaaacaagtttttagtttcaggagaaataatttgaaggaagttttcttttgtcagaaatcacaaggtagagagctggagatttggaattaataagaaagcattttcagccagctggacaacctgatggtcaggataaagaaaaatagtaagatagtgacctgtatacaaaaacctctcaatttcatatttaggtctattgattaagtttccctgatgttccaaccatcagagaggattagggatgtggaacagggtaggagaaacagccctggatttaaggtaaaattctggtttcaaatctcagttctgtcatatgttatacaattcacatgacattttcttgtgtaagggaggaacaaggatgcttgctctgcttcatatctcactttgtgaaaatcaaatgtaattatgaacataaaaggtagattattaacattaaggcagttgaattttaaaagcttgttttcttcccttatacatattcctaaccgtggagacagctaggttctgtggcaatgaagaaaattgatcaatgactgtttttggtattactttgggaagtagggatggaataggggcaagggaagggcttagcttcaaactgtagacagaagtgggaagcccaaatctttgcatggtgagaagtgggatggaatgtaggtgctagagatggtgcaccagtagggactgtcactggattggggaaaaaaatccggggctgtccttatctgctcccttaggcaaaatcgttctgtgttagtctggagggtgaacctattttaatgcaggagggcatagacttttgggtggaagcggaccctggagatgtactggcaggtgaatagagtgtggaaaagtggggaaaggagaagcacgattcatgagcctgagttcgggcttccatggatggagaagcatcaggagtggagtttaaagacggtgtgtttcaggtgatgtgaggtcctggatgcccgaagcttcaagaaaatactggttgggcacttagctttccctgtggttgccaatcccacgcaggccgcctctagcgtctcgattcgcttttctctgacctggaacctccgccaagcccccagctctcttcttcgacccagccttgcacggggcagctgtcggggcaggacccgcctctggcctgtcgcagcctagctcacggtcaagggcgggagcctgctgggaagcacggccgcgggggctcgctcggggccacctgcctggaactcagcgcgaggtccagagttccctccggctgcgcagcggcgcacgtgccccgtggaaggggcggttcccgcaccccagaaggagggggcgcccggccgcgcggactttcccttttgcttacttcctagtcccgggcaggccggctcggaggcagcgagaaagcgcagccaggcggctgctcggcgttctctcaggtgactgctcggagttctcccaggtacgtcgtgcgctccccactcgtgtggtctctctgcaccccttcctggggtcgggtcgggcaggggcggaggggagccgcagcccggtcacgggctctggggaacccgggctcccgttcggctgcacctgggcccctagctcctgtccgggcggggatagcgggaagcgcaccaggcccccgggacgccggtgcttctttgcacggcccagcgcgggaatgtggacaccagcgaagccggctcaggtcggccctcgggagaagcaggggctacacggaaagggagcccgagggtcctgcagagcccgaggtcgggaccccgcgcgtgcagtgccaatgggctgcggctgggctgagcgcccttccaaccttgcaggccccgggggggttgccgcggagagcttccgctggggctccgggcctctggccgccacctccctcgggaggccgaggggggcggtggccccggcccggccctcccgcttccctcacggcctggccctcccgcttccctgattcccggtagggtcgccctccccgcctcctggcccctcttggctcggatgacaaagattgggtaaaggctttcaacgagctagcgtctggcagggggtgtgtcctcgctcactggttactgctaggacggagcttggattttggtcaccgtggctcagaggtgggaaaggttccgtgctctgggtctgtccaggaccctggctccctaacccaagtctgacctctgctccctggcaggcttcgccccacctctgcgttccttcattcttaggatgtgtgagttaggtctctgattagaaaacaacttacagcgtttaagcaaagtcgagtccttcaagtaagaatgctttgaagtgccctttacaacttcttcaacttctataaatatgaacttgtgtttagaacttaaatgcaagccaggaaagtctttttcctgtttgaaagagagagaaagagagagaaagaggtgattggaagtggtgggtgggggcggagaaagagaaggagagtaatctgggtgtagacaactcaaagtttgctgagatgactttaatcttttgactctgttattaagatttttaccaaagagcaactgtagctatggtggcctgacttgaagggacagaccaaacaaacaacaaaacacaaaacaaaacaaacaaacaacaaaagcaagagcagaaactattggaaaatgatttattcaccaatattttaaaggttcttcctgttctaagcaaggaacatctttaagttctttataatgtacccattttacatttacaaaaactgccagaagttgacagcatgttttgggggtttctaagctatcagttaattttttggggtacagttttattgataaactaacagagtagaaaaaatctaatggaatacccccaaatttaaaagagggcaagaaaagagagacaatagaacataaaacaaatgggacaagaataaagtacatagttgtcacagtcccttgggtgctgctgtaacaaaatacctgagactgggtaatttacaaagaacagaaatttatccattcatggttctggagtctgggaagtccaagattgaagggctgcatctggtgagggtcatctggctacattataacatgatggaaagcatcacatggtgagagagagcaagagaggacagaacttacttttataacaaactcattctcacaataaactgctcccttggtgataacattaatccatttatgagggtacagccttcataacctaatcacctcttaaaaggttccacctctcagctcgcagtgagccgagatcatgccactgcactccagcctgggtgacagagcgagactctgtctcaaaacaaacaaacaaacaaaaattccacctctcaacactgttgcattgaagatgaaatttccaatacatgagctttggggcacacattcaaaccatagcaatagttcaattactttaaagcccaaaatgtcagtaattatattaaatgcaatttaatacatcagtaactaaatgagatagactaaattttatgataatcagactaatattatcagactagacttcaaaacaacccaacaatcatatgctgtttacaagagacacatttatggatactaaaaggtataaagtgaacagatgcaaccatttatcaaaagaaagctgttgtggcaatattactattagacaaaatagaattaggaaaaaaatcataactgtagataaacgtttcactaagttaaaggtttcactgagaagaaataaaaattttgaatttataagtacttataacaacattaagaaactagaaaatagaaaaagaatagagccaaattgactgaactagaaaaatagaaaattcatagaaaaatccacaatcatagtgggagattttatcatacatctctcagtaactgatagaaaaaccagacaaaaatcaataaggataaagaaaatgcgaacacaatgtagttcacataaggaacctatactacttccaacagcagctgaaatcacagagcatacttaaaatctgaccatatactggctcatagagtaaattgcaatacattttaaagaatttaaatcatacagaatatgtcttctgaccataatgcaattaaagtagaaaagaacagaaaaacttatagaaaattctcatatatttggaaattagtaaatttctaaataacccatgggtcaaaaaataatcagaatgaaaatcagaaaatatttttaatgacttatgaaaaaaattacatataaaaacttgtcagatgcacctaaactattgcttaaaggaaacttacaaccttaagtgcatatattagaaatgaagagtgacgaaaaatgaatgagcaagcaaataccttaaaaactgg

SEQ ID NO: 17857 - DNA, 16326 bp, Homo sapiens
tgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcatgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagcgtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccttctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgtgactctgagggcctcacaggtatttgcagcccaggtgctgtcggagcccagccgatgcgaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagacgcctcagatagaaaactggttatttttgtttcttagcactgccaccatagataacagctgtcacgatggacagtgtggacctggattagtccttcttgggaaaggagagtttgggttttgtaccgtggtggttctgggttctgggggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccggtttggaccccctcccgtgtgtcttggctgcaggtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttytgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagargaaggtgtccaggcagcaccatctctgtgcgaatccccagggtaaaggcgtgggkcattgggtttgctccccttgctgctgctccatcccygcaggaggctcgcgctgaggcaggacygtgcggccatggctgctgcattcattgagcacaaaggtgcagctgcagcagcagctggagagcaagagtcacccagcctgtgcgccagaatgcagaggctcctgacctcacagccagtccctgatagaacacacgcaggarcagagtcccctccccctccaggctgccctctcaacttctccctcacctccttccctaggggtagacagagatgtaccaaaccttccggctggaaagcccagtggccggcgccgaggctcgtggcrtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagacygtgttcgtggccgacctggcctctcctggcctgtttcttaagatgcggagtcacatttcaatggtasgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagcygaatggcttgccagtggctctgtggcaagatcacactgagatcgatgggtgagaaggctaggatgcttgtctagtgttcttagctgtcacgttggctccttccaggktggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgaytgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgcatttctgtctctggtttggttttgtccctcctggaagcatcactacactttggtggcagggaagctgagctatgtggggcacgtgtgttcacgcatgttgcctggaagcgttctccagaaaagcattgcctcttctctgacagctgagctttctcagcatgcaaattgccagtaaagacgacagggaagctatctgtttctccctccattaaatcatctggaaagaaatttgaatacataaattacgaaactctgtactgcagttccgactgatttgtagacttttttcctataccttccactaacaacagtcaggccaaggcaagtctgatctgcatgaccccaaggcagaggacttcagttcttcacatttcccatgtgctttttggtctttcacagctgacatgcccacctcggggggatgctggtgagaacccagtgggcctcacgcagaatgtgggtcactggaggagctccaaagtcctagttactttctagctgctgctcagtgatctctgtctgcccctagggaccctacaatgtaaacattatttttgtcaggggaaatggcatgtatggcaaggtgtgttctagaatcagactaaggattcagacacatcaggcagagaagctggtcatttccttcaactttatcatgggaaattatgctccaatagcaaaatcgggccagtagaagaagagctgtccagcaatgtataggtagaagtaaaccgaagaccatggttacttcagacctgttgagcctcagaagtgtttgcacctaaaagcaaaggcctttctgaaaggggactctcagctggggtgcggtggctcacgcatgtaatcccagcactttgggaggctgaggtgggtggatcacatgaggtcaggagttcaagaccagcctggctaacatggtaaaaccccatctctactaaaaatacaaaaaattagtgggacatggtggcgggtgcctgtaatcccagctacttgggagggtgaggcaggagaatctcttgaactcaggaggcagaagctgcagtgagccaagattgtgccactgtactgcagcctgggtgacagagtaggactctgtctcaaaaagggtactcaagcttggcattgcttcagggttactgctcagtgttgtcaccgagtgcctggcactcaggggatcttcattaggtgactgatgatgaggaggtctcaattctgaggctggaaagcccaacagggcctcctccttccctggtcaggtagatgctgcccttccaggttgccacagtgcagtctgcacttggcctgcccagccagaaggagcagcaatatctaaggatgaaggtgctgggtcttcagaagcattagaacctttcccctccaggccatttcttaagactgcaagccctcaagagctatttctgcatttaccccccaagtccaggtatgagtccatactcactcagatgtgtgatttttgtagtgttctaatgttgctaaaaagaccttcacatccattctctcaccagatgttcacaatcaccctgcaaaggaaggattttaattactcttacagatgagcaaacatacaggcatgctcaagacccctcccccgcccccccacctccccaccagctaccaactcaggactcagcctctcagccttttctgctgtggttctcaatctggcttcagcactgccagaactaagcaggctctgtgcatactgacaagggatgctgggtgaagtacacagcccaggtgtgaatgagacttctggggttctccctggagaacttcaggggccacagcggggggaaatgatggggaagttcttgaagagggagctctgggcctcccaactggataatatctaaaaatttaaaaaatgttatggcatgctgccaggcagtctgaaatataacactggagcccagtcctgggggccccttgcttgccagtgtcctgggacagaattgcccatagcacagacagatctccacattagcaaccatgcagccagacctgtgcacaccgcccagcaccacctccccccatcccccaatatgtgggctttgatctgttttctagcaaatgatccaggtgtacttgcaaagggagtcccctaaaggctactccaaatgcaaaaagcgtgctggcggccttgactgcttcctttggttttcttgtgggtttttgtttgtttttttttttttttttttttgagacacagttttgttcttattgaccaggctggagtgcaatagtgcaatctcggctcactgcaacctccgcctcctgggttcaagcgattcccctgcctcggcctcccaagtagctgggattataggcacccaccaccacacccggctaatgtttttgtaattgtagtagagactgggtttcacatgttggtcaggctggtcttgaactcctggcctcaagtgatccgcccacctcagcctcccaaagtgctgggattataggtgtgagccactgcgcctggcctggttcctttgttaggaagctgcaaatgcttttcttaatagtgaatgaatccaaacactaactgatgaattttttaaatgtagtcaagtgaaaaatggtagttgtaagcacaccaacgtaacaagaaatttcccagagctcacctaccttcactcacttcctccaaaaaaaaaaaaaaaagcgatgttaccaatgggactcccaaaggaaatctgcccctagaaaacactgaacaggtagaatcttgctgggagaagcttggcacaagacccggtgctgtgtcataaaagcaaaacaaaacatgaaacagaaaggagattctgcttttaaaaagggaagacaccatggagagaagctaagcccggctattaacctgcgccttcaaaccaaacactaccagtgtgactgtaaaatggtgcagcccctgtgcaaaacaaaatggcagttccttaaaaaattaaacacagaattagcattgaatccaggaattcacctctggagattgacctgaaagcaaggactcggatacatatttgcacgccagtgtttgtagcagcatgatttgcaagaaccaaaaggagcaagtaacgtaagtgttcatctacagctgaatggatgaaatgtggtccatacatacactggaatattattcagccttcaacagaatgaaatcctgtcccatgctacaacatggatgaacctggaggacatgaggctgaaataatacgccagatgtagaaggaccagcgccgcatgactccctcatatgagctacctacagtcagattcatagggatggagggtggagtggtgagcaccaagtgctgggaggaagaaggaatagggagttaataggtacagagtttcagtttgggatgaggagaaagttctggagatggatggtggtgatggttgtacaacaaggaaatgtactgtatactactgaactgtatgcttgaaattattaaaatgagtagtaaaaggggcaaacacagagacagagaaatcatacagtagagcctcggtggcttcgaggctacccaggacctggacacacaagctcaaaggccaggaatggggtccctggagcagcggctgtctctgtgcttctgtaagcatctccaaaacaggtctgtggtccccacagtctgcgcaggatcacacagacccactgtgtagatttttggaagaaaacagatgactcggatttcattttattgtcatgaaaaccataactgaagctagttcatcccctgtgaaatgtccacctttcagagtgttctttctcctgacaataaaataaccctttgtgattttgttgggctaattcagagttttccaccctctttgtcttacaagcaatttttgaaaaagtttctcaatgcacagttgagtgctacatacaggattgaaacattcaattttctctagaggagcaatcccccggtcagttccctttggctggaaggaccatggttgagttttcttcgaactgggctctgtgcttgggctttcccacctcttccagcatttcctggatgatgactctcaaggctcttcccagcaggctggccgggagcccgcgcgatagtggagggacatggatgagtgccgcgcagccctttccatgatgcagagacaggtaataggtataatcacagacgtatctgcaaccacaggaaatgccacattaattctcggaccagcctctaacctcagtgaaacatacgcagaagtggcaatgcaacacccacaaagcctgaggagggagcactgccacccaagggagacttgtgttgtttcacctcagaaagaacatggtgccaggatgagctggggagagctggctcttggcctcatggcctcatgaccggcaagtggccaaggcagaaaggggtcagatattccacagcacctgcatcccagtgaatccctctcattcatgtcttcgttgagtcacttactcattcattcactggggaaaggggaaaaaccacctactggggatcggagtttggagaaacaaaggtaaatcaatctttatctggggctacatcaacacagttaactcacaacttcggtcaccccaaaaatcaaaatcagaaaacattcacgaaatgttagtggctcttgaagtctgccttcccatctcttctcctagatcaacacaccaaagaccgtgtttccacaggcaggtctcacaaacgagacctcaggcaaggtgtgagcaactgtgctggcctgcacacagcaaagaggggcaatctgggggcggcaccgcatggccaagtggccagctggacgatacaggatggcttcttggaggtcggggggacgctgacggccattgcttctctcctacctgctcagagtcctgacacccacagagcatacctgcctgcatctcgggaaaagatcacgtcgacaccctccacagctacgcgcttgcagactgccttcatgcagacccctgactccagcacgtctgggctgccaggtaggcacacgccgccctcgggccagaagctgcggatgtcggcgtcccggtagccttggttcttgccagactgttccagaatgatcgccttggcggcggtgtccatgcccacatgcacgacgagctgtgtgaacgggtaacagcagagagaacccaggaaaacgaggcccaccctgctcaccaaatgtgcagaaggggccactccttttgagagcccggctctgtgcaaaacatctcaaaccccaaatccactgggaaaccccaggatcccccaccagtgtctcctaattaatatggctggaaagaaaaacagctggattcttttagctgaataaaaactcatgctgcatttacatttaaatgctttttacttcaaattattcttacagggtaatgtattctctttttgtggggggagggttggagggaggagaggcaagctagtaagtggtgaggctaccacagcagagtcttcgtgttttggtggaatcctgaatctttttattttatattttatttatgtatttatttatttttatgagacagagtctggctgtatcacccaggctggagtgcaatggcaccatctcagctccctgcaacctctgcctcccgggttcaagtgattatcctgcctcagcctcccgagtagcggggactacaggtgcaccacgcccagctaatttttgtatttgtagtagagatgggatttcaccatgttggccaggctggtctcaaactcctgacctcaagtgatccgcctgcctcggcctcccaaagtgctgggattataggtgggagccaccgtgcccgcctcctgcatctttttttaaatgaaactttaataaaggaagttagtggccatccagtgaaatcttcttagaatttattcaagctgattatttttcctttttgaaaaatagctgcccaagtatgttatcaaaacatctggggcattgtctgaatggcttgatagtgtatgttttattaacctcatca

SEQ ID NO: 17858 - DNA, 29963 bp, Homo sapiens
aaattggcccttgcaggcctcccttcacccagaatgcctgtgatcactgtgcctgggcacatgggcttcacttggcaacacctgtgctggcctgtaggaccaacctaccattttgtatcattctcctcccaccccaaagttgagtgccaaagatctgctcctggacccaggcacacctgcccccactggcacacctgggcacatctgcccccacctaccattgcccatcgtcaacacctgcacattctcaaattccagggtggtgtaggctgggtccagtgcagcactgtagtcggccatgtccatgtcgacgagggttttggagagtcgcattctccctgcctccacgccgcggccacctgccctaccctgggcgcccaccccgaaggcccccgccctccgccctcccactgcctcctcccagtgccctctctgccttcctttcaaaccgtcctctgggaagatctgctgggagtcttggcctagcctctgtgaaggggtggaggctctgccggggaggggtgggggttaatggttaatcggtcccccgccggtggataggctgggcggggctgcagggatttggctgtttgttggtttctggctgacacccggggtgctaattacaactgctggggccctaactcaccgatgttcagttatcaattgtacaaggcaggcatcatgactcacgggcactcatttgacccttgactcacccacccctccaagccattgtcaccccaagtcaggcattctaactgatactatcaggcactgacagcctacctccgagatcccctaattcaataacttcccaaatcattgacttctaccctcaatgcttttgcagagataaggctgccccatggcccacgatttagaaacctaaatcccaggccccagatgccaatcttctggatccttgttctgggagctcccttccagttcccccgcagtttcccggttcccctgggagcagaatggactggaagtttgggagggccagattcacctccaattccccgctcctgctccctgtgatcccaccctgcccctctccgtctcccacagctcccagtgtttctggcccaggctggctccatctcggattttcccatcacattctcctgtttccctcacccccaccccctcccggagcaggcagagacctggatttacattcaggcacctaccgtctactaactgggaccttgggtaaatgattctcctctccgagcctcagtttccttttctgtaaaatgtacaatcaacttcaaagggtggtttgagaaggaaatgagatggcataaatcaagcaccaagtggggcctggtagacgtccatcctcttccccctcctccctctccctgtttcgtatcccccttgccatccccctgtttctctccacccgtctcctaccttcagagtgggctttgtgggggtatcgccagtgcagtcacaggcaacccaacccttagaaagtcctggttcctggttcagtgctctgctgtggttgtcctaaaattcatcatgacttttgaacaagggattgtgcatttttgttttggacggggccctgaaaattacacagctggtcctggctgtctgaagctcatggtgcactctgttcttctcactccctccagccctcattgccttctgtgcagacattttcaagggctgccaatcaatctggggaagtaaagtcttgatgtagaaggcagagagtgagggcagaggaagaaaagcctgagacttgggaggcctgggagcctgtcctccactgctggctggaagggcaggttggagggcctcggtgacacctgtgagcaagagtgggcgaattagtgggagcaccaattaatgagtgagtgtgtgggggaattgatgagtgggtgaattaggagtgagtgaattagagacagggagaattaatgagtgagttgagtgaatgcatgaatgagtgagtgaatgaacgaatgagggtaaattactgagtaagtgagcaaatgggtgggtgaattaatgagtgaatgggtgggtgaattaatgagtgagtgaatgagtgaatgtgtgggtggattaatgagtgagcaaatcgggagtcagggcatgtgtgttcgagtggtatgaggaggcatcttcatgttctttccactgctagaagccctttctctgccctgcttagctttattctgtccacttgatctgacctctgaagctgagatgactggggagtgctattgcctgtagggaaaggggagagggagcaactgttgtggaggacaagagaggctagatttgacgtcaggagacctggggttaggaactagctcagtcactattccgataactttatttacatcgtctcttctcagggcttcaatttctccctctgtaaaatagaaagatgatcctggctcagttttctgttagccaggacaagactctgagggagggagcaagaggcagccccctgcaacccacactatgagacttgataaggggctgaaagagaccaaataccggcgggttcctcccatgcctacctcaggagtatctgacctggctccaccggccttgggggcagtgcagaggtgggaagaaacagaagatccgaccaaggggtaaacacagaagagatgtggagggcagctccgggaggagcctccaagggctgagcccaggcctctgccacctgcctggcacctatggcaggccacaggcacagctactccccacacaatccaggaatacatggcctcttccactctgaggcacagttccacattgcttaacggggaatgtgatcaatgtcatgtcagaatttcactggcaacaaaaataacaatgcatttttccatagatgacatcttagattcaattaaataaggtctacgatcaaccaagatcaaccacaccatgccacagccatgacccgttatatccaagagctactaggtggacactgcaaatgaagagctattagatacatgaatcatgacatacctgacttaccaaatgcacaatctgcatgactgcctaggaggcacattctagattcacatcccaccacattataacctaccccataagtaaatctatccactcatcactgtaaattgcataatctattacatacatgattcattccacccttagccaacgccaaacagtatctcctagatacacattcctcatataaatgacgcaccacctataagatctgctggctctgtgacctcaggcaagctattatttcttttgttcttgttgttcattgttactacatagtttatttaaaccaagctatgataatacagctgcccagaatctttgtggattacagatgcaaagtaactggagacgtgtccttgcacctatagttcagtaatagacagaaagtttgttacatttactaagtacagagaactgaatacacatgacattgtacatccatctttttgctttgtatttccattttaaacatatgtatgttacaactttacattttaaatatgactccatgtattttgtgacaatggctaagaacgcaatgatcccatgcccctgaaataagcacactttggtctgcaatgcagaatgttttcattggggtaccaaacaaacccttaacacataacagacaaaaactccttaaaaatcagatttaatacaatgttcttcatgttagataaggagaaagaacgggaagtggaaaaggaaaacattggggtactttaaatgtacagtgtcttgagaccttgaaagtttcaggccaggcacaggggctcacacctgtaatcctagcatcttgggaggccgaggcaggcagatcacctgaggtcaggagttcaagaccagcctggccaacatggagaaaccctgtctctactaaaaatacaaaaatcaaaaattagctaggcatggtggcatgcccctgcagtccaggctacttgggaggctgaggcaggagaatcacttgaacctgggaggtggaagctgcagtgagccgagattgttccactgcacctgggtgacagagcaagactctgtctaaaaaaaaaaaaagaatgttttcttcaggggatgaagagacgttggttcatgggtacaaaaataagtgagatagaaggaataagatctagttcttatagcacagtagagcgattatagttaacaatcatttactttatatttcaaaatagccagaagagaagatctgaaatgtacccaacacaaagaaatgataaatgtttgaggtgatggatatcctaaatactttgcatggtatgcatgtatcaaaatacatgtgctccatatatatgtacaattattatgtatcaattataaaaagtttcattcccttcctccaagggattttttttttaactagtggaaaaaagaaagcaacttcataacgccctccagtgaggaagaacattatcctgacaatgcttaggtgctttcatatgagcacataataaatacaggaagtcacagagcaaatgtcacagtattggtttggtttttatttctatgcttataaaaaatattaagcttctttctgtggactgagtgggtgttagcctgtgggtattggtctctggtgcctgtataccagtgactatttatattccaagcccagggccagctgtctgcacaaggcaagtttttatttcgaagccttggttactccttctgtacaaggggtctaacttgtcgtttgtcgtgaagattaaatgagagagtagataagcttcttagcctctcttcccctgacctctctttaggggaataaaccacagaccttgtgggtcagatagatctaggttaaaatccaggcagtgccaatgtaccaaactctgtgacctcaacttctacttttctcagccttagtttaagcatcagaaaaattgggttgataccttctttgtagggatggttcaagcattaaatgaccacgtgtaggcatacagtacaatagtagcaatcactgtcattggtcattgattgcatgacacactggccacataatcagttggaatcaggacccctgctcaggacagctccaggtaccacacacccagccatgaacaagcactagcctcaatgccatcaatttagcagctgttctttacctctgctcacttgctgtcgggccccagctcaagaggcagcagattccaggggatagcagaggacctcagagcccacagagagacccagttgagacgggaagggattgccctgggcaacctgcagttggggaggcatgtgtagggagcttgtgcctctgctgtggacggtggtaagggagctgccactacgaaccacattgtttctcttttacattataataaggtctaatgtttacagagaaattttgtgctagccctggtgctaaaaaccttctagccttctcatattatctgcctgttgagataggggctattgtcatccccattttaaagatgatgaaattgaggctcagagaggtgaagtgacttgcccaaagccacacagctcgtaagggaggggctgttgtttgaacccgagtctgcctccagagcttgagggcttcacccctctacgcattgcctgcatcatgactcctggaatccctgaaaggacttcggaattctaaggcactggagctggtggtttcactgcctcagtcttgcaggggaactcaaggacctgagaagtaaagcaccttatcccggggtataggcaggggcaggggcatcctccacacgcctggccaccccagggctgcttggcatcttcacttccccttggcgctcaccacaccattatctcctatcttttcttccccacccaccactccgggagaggtgcagagaaaactgggacttatcaagacaaagaacaaaagtcgtggaggaaagaagccaagagccatctctactctggggtagggcccttcagttttgcccctttgaaatttcaaattccagtttgtggacaaagtcctaactatctcacaatataggtccccaaccactgaccaaactccagtccaggcagccaccagctggcctggtcttgctgcttcctttagcggcttccaaggtccagggacagggggtctgggccaccaagaggctctgctaggctgtccctgcagccacagccaccccactggacccctgcctcccatctgagaggacagccctcttcctggagctgggatctgacacttgctgataccaacggcagataccaggtaggtcccctccctttctcttccttgagctcctaaaatgccamtcataccaccctctgcactcggcaaaggccactgtggcttratcaaatcaggcacccacaaagcttcaagactggaaaagatgccttggctaacccacccatttagtggacggaaacactgagsccgtcaggggagtggcagctggccacagactgaaccatagacttggggcccagacctggggcccctcacggagcctcagagggygaaagggacttgctcaagtccacgcagcggtggtgggtgagctttgtcttaacaacgagcactttctacttcatcacagaccatgagtggcattgtgtttgttcacccgatgatgggtggccactggcttgttcacccgatgatgggtggccactggcttgtcacaggagtatttccgagaggaagatgagggagcttggggctgaaggccagtgggtttggaaggaagcaacattcatgtggttaactgataactgggccccatccctgggcctccttcctccctccctgtccttagcctgattaagaccaacttacccagctgctaatcattgctgagcctgttgattttgccttaaaaaattaactgggcatgagtttgcggttttcctcacccctaaccctgaaaaggcctgggtgggcaggaggcctccagggttatgcaagaggccgctggcctcccaacgcatagcccacggccacctcggctgctctccaaagaagaggctttgctcaagagtcaacagtctgcttgttccccctgtgctgggtcctgagcaaatttgctctgttaccaaagagagataaaggcagctgggggagagctttccaaacagggatgggaagcggcagctttgagcttggggttctagaactctgcagtgtcagagccaggagaatctttaggaggatgtgggctggggtttttcaagctgggttccgaggctcccaggagccaagggtatgcatccacaggcccagcttcaaccagcgactcccttttacatgtagtcttaatattttatttgagggttggaaaaccactgattcagccccatcccctcattgcacagatggggagatggagatcagagggggaagtgacttgtccaaggacagaaggtcacctcgggtattcaggggctccagccagcatgggaatgaatggtgggctctctgtggacccgggcaatgtcttgaaagacattggtgaacaagacggctctgcaaacgccttgccatgccgttctccccctcctcccagggctggctggaagcagagaggtgcctgagagccattggaagacccaagtcaggggaatgcacctggctctgtgtcccatgggccctgtgaggatatgaccagcagccaggcactgcaaaccggagactacgttataatccatctcagccacgtcctgtctctggaggcatcagcactttgggaggctgagatgggaggattacttgagcccaagagtttgagaccagcctgggcaacatagtgagaccctgtgtctattttttaaaaagattttttaaaattaaagacagatgcccagtccctatcacaaaaaaagatgtagagccctgccctgactctctccacctctctgagcctcagtttcttcacctgtaaattgggaattataatacttaacttccagggttgtcatgaaaatgaaatgaagcaaaatatacacattgatcatcatggccactggatatgcagctgttttaggagctttgcatgtgttacttccttgatcctcccagccactctgggaggtaggcaatgttttcaccaattttttacacaccagaggcacagggaggttgagccatatacccatgctcacacagctgatgagaaacaagaagtggaattggaacttgggcagtctgtctctagagtctgtgcctctaactccagggctacccttcccttccagggatgccagtgagagatggccaggagaagggcagagagcagggcactgtgggagatgctgactgtaaggctccggaggtagggcagagagtatggtctggagaatgatcaggaaggaagccaggaggacttggatctgtgtgggtggagcttctccgcaggctgcctcctgccaggtggcttatgacatctgggctgagggtgttgctgtcctcctgtttatgttcatccctcctgtttatgttcctgaatttatctgcaggggtgaccttgggaattagatgcggccttcccggcccttgtggggcctgaaggctgatgggagcccctgcctgacccagactctggtttggggagtgagggctgagcccacatcccagaagccacccttggtctccccatactcttgttctgaggggccccagggatttgccaggtcactaaggtgaagtgtttggaagtcctgaggctcagatcagagttactgccctgtacagttgtgcaggttgctcactgcacaaaggttctccagccaagagggcaggtagggatggaaacccagcccttgttccacttgccaagcgaagtgcccatggagctctgcctgcccagagtggggtgcctttttcttatttgccctagggcttcatgtragctgctgggtgtcctgccccagctctggttccagccactgtgtgtccttgggcaaggtcatttccctccctggccttggtttcccattggagaagttttgtctaacaaagcagagactcatctctgaagatgaaatagaatcatctgaaacctttaaaatatacagatgttggccgaacatggtggcttacacctataatcctagcactttgggaggctgagatgggaggtttacttgaayccaggagtttgagaccagcctgggcaacatagtgagaccctatgtctattttttaaaaagattttttaaaattaaagacagatgcccagtccctatcacagatcaatgatcgaatcttggggtaggggtggggaggtgccaggcgtctatatttttgtgcagccaatattgagacccactgtaggggggcttcaaatttgaacctggaaagccttcgatggcatcaagttctatcacttactacaacttactagtcaaaacctcagcgaggctcagttttcccatctgtaaagagggaatgatgatcgtttcctcacaaaatcaaaatgccaattaaatgagataatgttcagacagtgcttggcaccatgttccccaagtagggagctcctgattcttgctaccaagactattattgttgttatgggcaatttgacgttgacaaaataaagggcctttctaggtcaaggattcggtgacttgaagacaggcctcctctgttgctttgagtcaatttctagtacctgggcctaaatcttgactgcacaccggtcatattattgaggtatgtgttattattattatttaatattttacttaatttgtgaacatctttacatttagttttgaattggtgctacattcgcatggttcagaatcaaaacataaaaggtgtaaattgagaagtcttgcttccagctgtctcctgttcacctgttctccttgacttcctcactatggggaaccacatcccttacagatgtatctgccaaggtttctttatacagaccagatagcatgtaagatcatacatgagtagcctctgctcttacactgttctgtatcttgtttggttcatttaatatcacaacctggagatgcttccatagcagctgagagcaagctttgaggatggaagggttctcgtctcccatcacaggtgaggaaactgaggctcagagaagaaacatcattttcccagtgagccaaggcaatggtgttagaactatctctacctggctccagagcttgtgtttatgcccctgcaccgatacggccttccatgaagcccggcccagaaagctttggagtctggttacatctctgccaygcaggcctggccttcccaggacaagaggtgaggaggggggctgtcggggtcctcactgtgtctggactcagaaatcccaaagagaggatgaagtgtagaacaaagaatgtcccaagtcatccagatagggacccagtgggaaggtgtcccctggatggaatagtgggggcctggtggctgtgcccgtcagcactggagaacctgccaggaactctctgccagcctcaggtggtgcgggtggcaggggaagtcaggaggaggatgagaggcagggagggaagcatggccgatgagacaagctctgggtgaggggatggaggggaccccatgcctggagctcaggaaggaggatttggagttcaaggcagaagtggcaatgagattttaaccgatygttttctgctcagggaacttcagggttccctctggattcttgacctgcttcagtttgctgactcactggctttgggcaagtcattttccctctccgtgcctcagtttccccaactgcaaaatgagagagataagagatctggtctttaggcagccttggactacccctaatactctacggggctcctctcaccttgttgaggtcgtctggattctccttctctgattggaacgtcattcacccatcagggccatggacgttcctgggttaggggatgagggtacaaatcctccacactgctcccagtctggaatcctcccccttggttctgtgtctctctcctaccatcccatccttccttccaggcagatgtggagtcaggaccatacctggtgggtcctgggggaagccctggccccagtccgacatcctcctcctgctgctatggggtcccgcacagtgcacaacctcttcatccttgagggagctcctgctggcccctctcagcaccccagaccctgcgagggccgctgggcagagttaatcccttaatactggtcacaatgagatttcagggatggtgggaggcggtctccatggaaactgcagacctgtccaggatccatgcaaggaattagccccagggctctgcaaggggctcctagagagccaaccccaataggaatgggagacacagtggtctggactcctgggtcctgctctggccctcctgttgtctctctggagggcttggaaaaaaccataactcttgcattgcttcagtattctgctcaactggacagagccatattcacagggagagccctatcacctttctgagcgtgtttctccatccccctattggcattgtaatccttaacccagtggcttttctagaagagtgcaggcttcagagtctgccagacctgagcttgaagctcagcttttccctccacgactgtaaacttagccgaggcatttcacttctctgagcctcagcttcctcatctgtatgatgggcacaataatagcaacatggcatccctcttgtgctggctggtgggtagtaacatccagtgaatgtgagtctccttctcaccttttcctgactgccacgcccacactgcacatttgccctccccagccccctgcagcttccagaaccccgtggtctcaagcagagagctgtcgcacttccttctttgccttctcatcctccaagtcccatcttagtcatcttcctccgggaaacagaacgccggggtcctcctctgtccccccatagcccccaaagctttacatcatcatcgtttagtcagatggtaattagactggttgtgtgcctcctccactggactgtgtcccatctaccattgtattcccaggacccacttgatataaataggctggatgaataactgagtgaataaaggatggaaatcgtccatygaaacagtcaacatttattcagcaccttctgcgtgcatcgttgtgggtggtggagatgcagcagggaagaccatgggcaaaatatccccctcagaggggtgcagatgagcaaataaaaatacaggatgcccagtcaaatgtgaatttaagatacacaagaaatacttcgttagtatgagcgtgtcccaaataatgcatgggacctgcttatacttttaaactgtggtgttcatctgacactcatatgaaactgggtgtcctgtgttgtgtcgggcaaccctacaccctccctcacagagcttgcgttttggtggagaggcgggttgcagacataagcaagtaaatacatgaaaaacgaagtcaattacaaacagtggttaagtgcagtgaagacgcacagcgcgatgtgatagcacctggggatgggcaggacgatcccctgagctagtggcctttgcctgcacaggtcattttagctccaatgagatgccactttgcaaaagttctttgaggatcttaaagggcacggtggaggctgctaaacttgagagaaggactctgaggagggcaaggggcgcacctgagggagtggggctgctaagtctcacttgatagactccacagttttgcaacttggatctgggccttcacaaaccttcgcgaacccgcagccccacccctcgggtcagccaatgtcttctgtggggctgggagccaggggaagaggccaaaggaactgtgcagagaagcgtggccacccgggccgcagctgggagccctgacaccctttgccgccccacctcatcccgcggttgccccagggcgcagggcagggcaggcaccgcgctgggccggagggcgtcccggaggaggcggccaagactctccgcagtgctgcgctttgcgcttcctgggctcctcctcgtggccaacgcaggaactggtgttcagaaacttagatagccttagggacttcaccaatcacagcaatcccgccaatcacaggcccagacgcactatgtctctccaaatccagaggaggcctgctcggttcgatcaccaatcacagctcgttggatttagttacctaaaagaacatctccccatcacacaccagcacatggccacggcagcaatcagaacgtaagattttaaaaccagttcccagggtagcagccgctgcccttccaccacctactaaacttctgttcccagcaccttgttccaatgtacgggggtggggggggtctttgaggaaggttccaggctttgtgctgcttccatgtggaagcagatgttagcatgtatggggcatgtataatgatattactatcagtaaatgtcatacccattatgaaaattaagataggcagggcgtgatggtgcatgcctgtaactccagctttaggtggccaaggtgggaggatcgctggatcccaggagttggaggctgcagtgagccacgatggcgccactgcactccagcctgggtgatagagtgagactcttgtctcaatttaaaaaaaaaaattaatgtgtggatataggagtgtggaaaaattataacctttgggttagacacacctggagcccatatactatctttgtgaagtaggacgactcacctccccttcctcagtcgtcaaaagagaatgatagtcatatctacatgtcatatatcatcacccaccttctctcaattattcaagccaacatcttgcaagtcacaatctttgtgttgtgtttctcatgccttccagttcatcagaaaatccagttcttgccaccctccaaacagaatctagattttccatctttccatctccaccccagccaaccttatgcatcatctctggaggtctgcaaaagtcttttcacttcttccctttttttttttttaaacctgccagggttggggaggggatctcccccgctccaccgccccccccgcctccccccccccccgcctgcctccaccccaccccttcactttttctcctgtggcttccctaccccctactcttcactcaggggccaagggtgatcttgtacaaatgtacattggctcagatcctcttctacttaaatttttatgacttcctatgcatttataacaaaactcatacaactcccacttaacactgtgaggccatgcacgcccttgtttttatatccctccgtgtccaacctcatttcattccacttgcccccacccctatcagcagcaggcatactagccattttaaagtttttctttcctgtcttgggggcctttgcatatactttcccctctgcctggaatacttctttttttttttttttttttttttttaagatgaagtttcgctcttgtcactcaggctggagagcaatggcacgatctcggcttgctgcaacctccgcctcccaggttcaagcaattctcctgcctcagcctcctgagtagctgggatccacacccagctaattttttaatttttagtagagacggggtttcgccatgttggccaggctgatctcaaactcctgacctcaggtgatccacccacctcggcctcccagagtgctgggattacaggcatgagccaccacacctggcctggaatacattttagtaagtgtttaatggatagttgttggatgaatgactgaaaaggtctttcaagaggaactgatagtgatgtaaacttcaagtgctcggtgcgtaacaggtattcaatgaaaaggattctatgcatatagtagaaattttggaaaataaaataaaaattgaagatttaaaaatcgtatgtgctccaacatttagaaaggttcaaactcttaatggctaaccagggtttcttgacctaagcactaatgacatttgggctagagaattctttgtcgtggggactgtcctgtacattgtccctggcagcatgtctggcctctagccactagatgtcagcagcacttttccctaccctcaaggtgtgataaccaaaactatctccagacatttataaatgtcccttgggggttgaaattatctccactgagaaccactgtgctgggcttctacccttacaagaaattttctctcagtcattcaatgcttctcaaatcttggtgtccataagaatcatctggggccattattaaaaattcagatggcagctgggcgaggtggcttacacctgtaatcccagcacttcgggaggctgaggcaggtggaccacttgagttcaggagttcgagaccagcctgccaaacatggtgagacctcgtctctactaaaaatacaaaattagccgagcgtggtagcacatgcctgtaatcccagctacttgggaggctgagacaggaaaatcacttaaacccatgaggcagaggttgtggtgagccgggatcgtgccattgcactccagcctggttaacaagagcaaaactctgtctcaaaaaaaaaaaaaaaaaaaaaaaatcagatggtggctgggcacggtggctcacgcctgtaatcccagcactttgggaggtgggtggatcacctgagttcaggagttcaagaccagcctggccaacatggtgaaaccctgtctctattaaaaaaaaaattagccaggcgtgatggtgcatgcctgtaatcccagctactcgggaggctgaagcaggagaatcgcttgaacctgggaggtggaggttccagtgagtgaagatcgtgccactgcactccagcctgggcgccagagcgagaccctgccttaaaaaaaacaacaaaaaaaatcagatgcctggggtcctacctccaggtgccaggaccaacagtgggcctagtcatcagattaaaaaaaagaaaatatttaataaatagaggtggggcatggtggctcatgcctgtaatcccaacactttgggaggccaaggcaggtggatcactggagactaagaattcaagaccagcctggccaacatggtgaaaccttgtctctactaaaagtacaaaaactagctgggtgtggtggtgcatgcctgtaatttcagctacttgggaggctggggcaggagaattgcttgaacctgggaggcggaggttgcagtgagaagagatcaggccactacactccagcctgggcgacagagtgagagtccataaattaataaacaaacaaattaattaattaaaaaatagagacggggggaggtgtcttgctatgttgtccaggcttgtcttgaaccccagcctcaagcaaatcagcctcccaaagtgctgggattaaaggcaggagccatggagcacctggcccaagtgtttaaygagcttctgggcacttctgataccaggtgccctcagaccgcactttgaaaactcctcaaggaggcctctcaatcacctgatcaccaaaccctgtgtgaggctccctacccacctggaccctctccttgaattcctctcctttccaattattacccttccctagatagcaagtggtgacagaaccaaaccctagctcagccaaagcccaaattgcctcatctcccttcagggaataggcaaaaaaaaaaaaaaaaaaaaaaaaaaagatcacagagttcagctgaaaccacttaggaaatatcagcatccccacctccccacccaaaaggactcctgagtggcagcctgagaggtgtgtctgctcatcagaataatgttgtcagactgtgttctttctgggggatcatcacactcccttttctgggaacaaatgttggccacttggtgggatgggccatcatgatctacgtcagacaaattcagtgagtcatgactcagcctatctctctagacccatcttttatgcccccttacttatagtctctctgagggctgttctcaactattctatttctctcctttccggcacatgatggggattacattttcttgcttcctttgaaatgagatgtgaccatgttacttgtttcaggtaacgagatgtgagcagaaacaacctgtgtcacacctgggcagaagctttaaaggccagtgctgcccttgttggggaagcaagtatagatatgaatcgttccacaacgcggagcgccccctgccgacccatgctgggcgtgtactataggtgagcaattaactttgctgttcaaaccattgagacttaggggtttttttgtggttgcaagctaacttcacttcacttgactgaacacagtctttccaaagtttcactaattttttaatgaccattatgattttttcatatctgtaacatttttcttacatcaactcacttctttttacttcaatttattttagaaagaaatattattactaccaaatgaaacagtatcataagtagaaagcaatgagaaaataaacagaatgaaagaaatcctgatatcaaatcctgacttaatactatttgcctttcaaagcctctggacctttggtctttatttaaaaaaaaaaaaaaaaaaaaaaaaaggagccaggggccaggcgtgatggctcacacctgtaatcccaggaatttgggaggccgaggtgggaagatcacctgaggtcaggagttcgagaccagcctgaccaatatgaggaaaccccatctctactaaaaatacaaaaattagccgggtgtggtggcatgtgcctgtaatcccagctactcaggaggctgagacaggagaattgcttgaacctgggaggcggaggttgcagtgagccgagatcgctccattgcactccagcctgggcaacaagagtgaaactccgtcttaaaaaaaaaatgggagccaggtgcggtggctcatgcctgtaatcccagcagtttggggggctgaggtgggcagatcacttgaggtcaggagttcaagaccaccctagccaacatggtgatatcctgtctctacttaaaatgcaaaaattagctgggcatgatggcatgtgcctgtaatatcccagccwcttgggaggctgaggcaggagaatcacttgaacccaggaggcggaggttgcagtgagctgagattgtaccactgcactccagcctgggggagagagttgagactccgtatttaaaaaaaaaaaaaaaaaagaggtccccaagagtacttctcaatcttttggatccccaaagctgtctaagattgtcagaatatttgaaggcagcacagtattgaggctgagtgtaccaattctggaacttgacatcctgggcttaaattctggttcagtcatggactagctgtgtgaccctggacaagttactgaactgctctgtgactgttttcttatttgcaaaatagtgaccataatgatgtgtatggcattaggtcgtggtggggattatttgtgttaatgtataaaaagggcttagaagtgtgcctggcacttagtgagtgctatggaggcattacctataaaatgatggcaggatccagatccaaatagatttggtgaattattgtttgttttttttgagacagggtctctgtcactcaggctggagtgcagtggcgccatcacagctcactgcagcctccaagtctccaggctcagatgatcctcctacctcagcctccagagtagctgggactacatgtgtggaccaccacccctggctaatttttctatattttgtagatatgggatttcaccatgttgcccaggctggtctggaactcttgggttcaagcaatctgccccttcttagtcttcaaagtgttgggattacagacgtgagtcaccccacccagcctggagaaatgtttgaactccatggagataagtaaaaaatcctctgcattggttaaaaataaatcacctggatgatttatttatttagtgtagatgggaaaagctaccttagcagaaagtgacatagcaaaattctagaggttttacttggtggcagctgcccaaacctctaacccagtcgtatgtatcattagagagaatgtagttcccaggtcagaggagctaagaggtccttggcattctactcctaaggagcatatatggacaattgtgtttagttttcattttaatatgaatacttaaaattttcctaggatggcagaggatgagaaagctatgccccttaggccgagtgcagcggcatggctcatgcctgtaatcctggcgctttgggaggccaaggcgggcggatcacgaggtcaagagatcgagatcatgttggccaacatggtgaaactccatctctactaaaaatacaaaaattagccttgcgtagtggtacgcacctgtagtcccagctacttgggaggctgaggcaggagaattgcttgaacctgggaggcggagggtgcagtgagccgagatctcgccaccgcactctakcccggcagcagagcgagagttcgtctcaaaaaaaaaaaaagaaagaaagaaagaaagaaagctatgccccttgaagaataatcaaagatccaaaagagttctgggctgggtattggagaagaggagagaaaggtggtgtagcagagtggtcagggccattgcctttgaaatatcagtggtgccatttacatagctgttggaccttgctaaaatcataagctcttcaagccttatttgcttcatctataaaataggaatcaatgataggaccttttcatagattgctttgtggagtaaatgtgttaaaccttataaacctggcaggtagctgcccagcatatagttgcgttatttactcaattcaaagtactttcctgccgggtgcggtggctcaggcctgtaatcccagcactttgggaggctgaggtgggtggatcacttgaggtcaggagttccagaccagcctgaccaacatggtgaaaccctgtctctactaaaaacacaaaaattagccgggcgtggtggcagtcacctgtaatcccagctacttgggaggctgaggcacaagaatcacttgaacctgggaggcagaggttgcaatgagctgagatcgtgccgctgcacgccatcctgggtgatagattgagactcagtctcaaaaaaaaggcaacaaagtactttcctttggaaaagagtgcccactggctgggtgaagtggctcacgcctgtaatctcagcacttgtggggctgaggcaggcagatcagttgaagccaggagtttgagaccagtttcaygtggccaacatggtgaaaccccgtctactaaaaatacaaaaataagccagatgtggtgtcatgtgcctgtagtcccagctactcaggagagtgagacaggagaatcatttgaaccctggagttggaggttgcagtgagcagagatcgtgccactgcactccagcctgggtgacagagtaaaactctgtctcaaaaaaaaaaaaaaaaaagctctcactgattcctacagcttcagagaatgaacgaggaccaaaatgtggatgctacagggaggaaacttgaggctcaaaatggagatctttctataaaatacaattgttctaccacaggaaaagctgctttattaagtagtgagtattccgtcattggaagtattaagcccaagctaaatggtcaactgtcagggaaggatggtgagaggattccagtgggttagagghcaaagagcgtctaccaggtgcaaaagtcttaattaacaaagtactatcaaaaccaaattcatgtttgggaaactgtatatccacatgcaaaagaatgaaatcagactctttccttacaccatatacgaaaattaactaaaaatgagtttgacggaaaagtataaaacctttggaataaaacataagggaaaagcttcatgatattagatttggtgatgatttcttggatatgacaccaaaagcacaggaaatttttaaaaattagataaattggactacatcaaaattagaaaaatttgtgcaccaaaggacacttgactgagtgaaaaagcaacttacagaatgggagaaaatatttgccaatcatatatctgataaggggttaatgtccgaaatatataaagaactcttacaactcaataacaacaaccaaaaactttaaaaatggacaaagaggccaggtgtagtggctcaagtctgtaatctcaccactttgtgaggcagaggcaggaggattgcttgagctcagragtttaagaccagcctgggcaacatagtgaaactttgtctctacagaaaaatttaaaaattagccaggcatgctgcacacctgtagtcccagcttacttgggaggccgaggtgggaggaccacttgagtcaaggagtttgaggctgtggtgagccacgatcctgctgctgcactctagcctgggtgacagagcaagacctgtctcaagaaaacaaaaaaattggcaaaggacttgaataggcatttctccaaggaagatatacaaataaccattaagcacataaaaagatacttaacatcactaatcattagggaagtgcaaatcaaaactgcaataagaggctgggcacagtggctcatgcctgtaatcccagcactttgggaggccagggcaagtggatcacttgaggtcaggagtttgagaccagcctggccaacatggcaaaatcccaaatctactaaacaatataaaaattatctgggtgtgggccaggcacagtggctcacgcctgtaatcccagcactttgggaggccaaggcgggcggatcacgaggtcaggagttcaagaccagcctggccagcatggtgaaaccccatctctactaaaaatacaaaaattagccgggcatggtggcatgcatctgtaatcccagctactcaggaggctgaggtaggagaatcgcttgaacctgggaggcagaggttgcagtgagccaagatcgcgccactgcaccccagtctgtgccacacagtgagactctgtctcaaaaaaaaaaaaaaaaaaaaggaaaagaaaaattatccgggtgtgatggcacatgcctgtaatctcagctacctgggaggctgaagcaggagaatcgcttgaaccctggaggagaagtttgcagtgagctgagactgcactactgcactccagcctgggcgacagagcaagactatgtctccaaaaaaaaccaagacaaacaaacaaacaaaacacacaataagagaccacctcacacccattaggatggatattataaaacaacaacaaaacagacaatagtaagtgttggtgaagatgtggagaaattgtaacccttttacgttcctatcactgctggtgggaacgtaaaatagtgcagcttctgtggcaagcagtatggcggcttcctaaaaaatgaaaaatagaactatcatatgatctagcaattgtactcccgagtatatacccaaaagaaccaaaagtagcatctggaagagagatttgtatactcaagttcatagcagcattattcataatagccaaaaggtacaggcaacccaagtgtcaatcaatggatgaatggatcaataaaatgtggtatatgcatacaatggaatattattcagccttaaaaaggatggaaattctgacacatgctacaacatggatggatcctgagggcattatgctaggggaaaagctagtcacaaagaacaaatactgtatgattccactagcctacaggaaagtagtcaaattcacagagacagaaagtagaaggggtttgccagggcctgggaagaaaggagaactattttcttttcttttcttttcttttttttttttttttgagacggggtctctctctgtggcccaggctggagtgcagtggtgcgatctcggctcactgcaacctccacttcccgggttcaagcgagtctcctgcctcagcctcctgagtacctgggattacaggcacgcaccaccacgcccggctaatttttttgtatttttagtatttattttgtatttttagtagagacgaggtttctccatgttagcctcccaaggggagctattttctaatgggtacagtttcagtgtgggaagatgaaaaaagttcaggtgatggatggtgctgatggttgtattacaatgtgaatatatttaatgtctctgaactgtacgtttaaaaatggtcggctgggcgtggtggctcacacctgtaatcccagcactttgggaggctgaggtggatggatcacctttggtcaggtgttcaagaccagcctgggcaacatagtgaaaccctgtctctactaaaaatacaaaaatcagctgggtgcggcggtgcatgcctgtaaccccagctactcgggaggctgaggcagaaaaatcacttgaacctgggaggtggaggttgtagtgagccgagatcacgccactgcactccagccgggcgacagagtaagactctgtttcaaaaaaaaaaaaaaatacatgcataaaagatgtttctaagagtgctaaaaaatgcctacaaattgataaggaaaggtaaataatacaatagataaatggtcaaaggatacaaacaagcacactcataatgtaggaagctcaaatggcaaaagagcctctccttctctagtaatagaggaaatgtaaatttgaaagtgaagcataattttacattcagtatcttacaaaatcaagtgctgatgaggttgtagagcaaccaaaactctgtaactattgttggaagtggaagttggcattcaagaatgagcaatttagcaacatctcttaaaagtgttgatatccactgtctaagatacagaaattccatctctgcatgttacctagagaaactctcatccacaggtataagaatagtctttggagcatcatctgagatagtgagccaagatcgtgcaactgcactccagcctgagtaacagagtgagactccatctcaaaacaaacaaataaacaaaacagaataaatatactcaggatatttacagacacttttattttattttttgttatttcaactttgttttttttacctgcctcccaggtttaagcgattctcatgcctcagcctcccaagtggctgggattacaggtgcccaccaccaggcctggttaatttttatattttcaatagagatagggtttcaccatgttgcccaggcttgtctcgaactcctgatctcaagtgatccacccgcctcggcctcccaaagtgcttggattacaggcatgagctaccgcgcccggctgcatgtgtttttaaacattgcctggcccgttatttcaacttttattttcgaatcaggaggtacacgtataggtttgttacaaaggtatattgcatgatgctggggtttccagtatgaatgaattcatcacccaggtaatgagcatggtacccaataggtagtttttcaacatttgccccctccctctctaacccctttggtttctccagtgcctattgttcccatctttatgtccatgtgtacccaaggtttagcccccacgtataggtgagaacatatgttatttgaatttctgtttctgcattagtttgcttcggataatggtttccagccatatccatgttgctgcagaggacatgatttcattcttttttatgactgtatagtacttcatggatacacagcattttatctattttatttcttttttattttattttttgatagagacagggtttcaccatgttgcccaggctggctcttgaactcctgggcttaagtgatctacttgcctcggcctcccaaagtgttggaattacaggtgagccactgcacccagcctacacagcattttaaatgagtggtctggtgcaacttgtatcatcatgaaaagatccagagacctattatgaggagtaataaaaggaagttgctgcaggatatgtacagtatatcatttaaataaattttccagataagcaaaatattttactttgcttatatagccacgtatggtagaactgtgaaaatgtgtctggtaatgacacattaccagataaataccaaatacacatgataaataccaaatggtgaccatgatcaccactgataagggtggcagggtgatgggatcaggaagacaaggggcttcaactctaagtgtaatgtttaatttgtcattaaaacaaacaaacaaacaaacaacatccaaagaaaacatggtcatgtagtaagatttgacaaaattgagaggtggatacataaatgttcataatattattctctatacttctctgcatatttgtaatatttcttactttaaaaaaaggagaaatgagattataaaaaaaagtcaaccatcttcctacataccagcgacagacaacttggtagtataattttaaaaatcatacaatttgcacaatgacaacaatttgcacaatgacaagcaaccgtggataaaaatctagaaatctatatatatatttttttctttgagacagagtctcagtctgttgcccaggctggagtgcagtggcatgatctcggctcactgcaacctctgcctcccgggttgaagcaattctcctgcctcagcctcctgagtagctaggattacaggtgcatgccaccatgcccggctaattaccatgcccggctaattttttttgtatttttagtagagacagagtttcatcatgttggtcaggctgatctcaaactcttaacctcgtgatccgcctgcctcaacctcccaaagtgctgggattacaggcatgagccaccatgcccggccctagaatcctattttttaaaagcaactaggagtatatctaagatatagcatttctctgtctgagagcagggagagcttgcataggtgtcaatgtccttcaagggactcttgaaactaattcagggccctatacactgcaggcatttcttggagtggccaaggtattgtcatgtgttaagaattctgagaagttctcggataatgaaatttgtgcagctttctttaattcagcagttttcaaacatctaacaatagaatccttcttgtctgaggggcctcgccttaggaaaggctgccctaacaacctcaaagttcccttccaacacccacagtccaccattctagtcttggctctgccactaacttactgtatgactttggccgaatcacctttcctcttggggtctcagtttgttaagttattaacaccctgggtgacagagcaagaccctgtctcaaaaaaaaaaaacaaaaacatttccctggcaaaaaatttatgactaaatcctccaaagcaatcgcaacaaaaccaaaaattgacaagtgacacctaattaaactaaagagcctctacacagcaaaagaaactatcaacagagtaaacaggcaacctacagaatgggagaaaatatttgcgaactctgaatccaacaaaggtctacaaggaacttagcaattctacaaggagctagaacctacaaggaacttaaacaattcaacaagcaaaaaacaaagaaccccaacaaaaagtggatagagcacatgaacagacacttctcaaaagaagatgtacaagcggccaacaaagatgaaaaaatgttcaacatcactaatcatcagagaaatgcaaatgaaatcgtgagataccatctcacactagtcaaaatgattattaagtttctttttttgtccccacccttgatatctgaagaatggctgtcattaaaaagtcaaaaaaataacagatgttggcaaggctgtggaaaaaagggaacacttatacactgttggtgggaatataaattagttcagccactgtggaaagctatttggagatttctcaaagaacttaaaacagaaccaccattcaatttagcaatttcatgatttggtatataaccaaaggaaaatgaattcttctaccaaaaagacacatgcacttatatgttctacacagcactattcacaatagaaagacatcagccaagcacagtggctcacgcctgtaatcctagcactttgggaggccgaggcgggcggatcacctgaggtcaggagttcgagaccaacctggctaacatggtaaaactgtgtctctactaaaaatacaaaaattagccaggcatggtggcacatgcctgtaatcccagctacttgggaggctgagacaggagaatggcttgaacctgggaggcagaggttgcagtgagctgagattgcgccactgcactccagcctgggtgacagagtgagactccatctcaaacaaaacaaaacagtagaaagacatggaatcaacctaagtgcccatcagcagtggaatggataatgaaaatgtggtacatatacactatggaatagtatgcagccataaaagggaacaaaacctcaaccaagttcaaggacagtgtcaaaaaaataaaaaagggaacaaagtcgtgtcctttgccacaccaggaatggagctggaggacctcatcctaagtgaatcaacacagaaacaaaaaaacaaatactgcatgttctcacttgtaaaaggaagctaaacattgggtacacgttgacatcaagagaggaacaatagacgctgcggacttctagaggaagggcaagggctaaaaaactctctgttgggtactatgctcactacttgggtgatgagctcaatcatagcctaaacttcagtgtcacacaatatacccatgtaacaaacctgtacatgtaccccctgaatctaaaataaaagtttaattaaggcctggtgcagtggctcacacctgtaatcccagcagtttgggaggctgaggtaggtggatcaccagaggtcaggagttcgagatcaggctggccaacatggtgaaaccccacctctactaaaaatacaaaaagaagccaggcatggtggtgcgtgcctgtagttccagctactcaggaggctgaggcaggagaattgcttgaacccaggaggcggaggttgcagtgagccgagatcatgccattattctagcctgggcaatggagcaagactgtctctgaaaaaactaaaaagtttaatttaaaaaaaaaagggtgtgtatagtttgatctcttaccttttcccagccataacacctcatgttggaccccacgtttaggggtttattaggggctttttaggggtttggttttatttctcctcccccagttaactgtttcttacttaactaaagcaggttcatggtagaggaattacaaaaatgcagagaaggatgattaaaaaagaattaaactaggctgggtgtggtggctaacacctgtaatcccagtgctttgggaggctgagttggaaggatcatttcaggctaggagtttgagaccagcctgggcaacacagtaagaccccatctctacagaaaattttaaaacttaaaaaaattaaaaagtaaacgttagacaggcatggtggtgtgtgtctgtagtcccagctacttgtgaggcttaggcgagaggatggcttgagcccaggaatttgaggctgtagtgggttttgactatgccactgcactccagcccgggtgacacagcaaaaccctatctcttaaaaacaaatcagatttactccaaatgccacttttggctctttatgatgacagctgacatttatagagcctttatgtgcaaagcgcagtggtaggatatctcgtttcacttctcgttgaagtggaagtcaagtctattcttatccttattttacagatgaggagactgaggatcagagagataaagtcacctgtccaaggtcatactgtggatgtagctctaacccaagccctcccgactgcagcacaaattctcagccactaccctattagccccttcatttgaaggtgtcttcatcattgccaagattccttttcctcccggccccctaagtcttcaggattccctcatctcatctccccagagaagccatgacaccatcttctccaaaaacaaagtcagcgctttcactgtagatggacctgtgttcttcccccaaactcagtccacctcatctccagaaaaactatatgacttgccctggagaagagggggaaaaaaaaacctcttcccaccaactccacctcccaaattactggatttggggtaaatttacaggctggagacagaagaatggatgtgtatttagctttcaaattgactattgttttatgtgaatgtctgataaagaaaacacaatggctgccagatggggcctgggagtgagatttcccatgtggagaattctagaagacatgcctggagttctggagcctggatcctctggacagacaggtggccagctaaccagggtggaggcaccaaagataactgtggggtggggagaagacaccagcccaagagatttgactgggattggtctacgcaagaatggaaaatggaggcagaatgagttagcagcaagcacacgtacactgctatagaatctgagggacccggccagtgctggccaatagaaatagaatgtgagccacagacataatttaaacttttcttgtagtcacttaaaaacatggtaaatctatgaaatagaagattgctcgtgcaaataaatgaactctgctttggtctcagtgatcaggggtcccacactcaagtgccctcaatacccagagaagtaactgaaataaatggaacagatagggtgtgagcaaagttcacacgttcctctaagaaaaacaatacagcaaacatggtgatttatgttcattaataagtttccgtatggggacactaaggaatagtggggactacggcaaattagaggaagcatgagaatctaaagtggctccaggagactgttgtctcataggtatcagtgttgctagaccttcactttttttaaaggaggtgaaagttgggattttctttaatttatttttttgacagggtcttgctctgtcgcccaggctggagtgcagtggcgatcttggctcacggcaatctccacctcctgggttcaaga

SEQ ID NO: 17859 - DNA, 19165 bp, Homo sapiens
tttctcctctccaggctctccttcccagggttgttggtcccatgacagatataacagttaagggcagacagggcacagtggctcacgcctgtaatcccagtactttgggaggctgaggcaggcggatcacctgaggtcaggggttcgagaccagcctggccaatatggcgaaaccccatctctactaaatatacaaagattagccaggtgtggtggcgcacacctgtaatcccagccactcgggaggctgaggcaggagaatcgcttgaacccaggaggcagaggttgcagtgagctgagatggttccactgcactccagcctgggcaacagagtaagactccatctcaaaaacaaacaaaccaaaacaaaacaaaacaaaaaaacacttagaggcagtcccaaaggtgggctggagggggctggacacacaagcctcttgctgctgtctgagtgcacgttgctggagaaatctgggcggagtccaggcctagtgtggcatgaggtttgtgtgcataaagggagggcagtccaggaatcagaggtccagggactgtgggtctcagccacagcacctttcctgggggacaggagctgtcgtagcctcggggtctcaccatctgtgctcgggagtttgaggagagagctgcgctccagactggctttaccttcccccagccttcctgtcttcacaaaagcatcttggtttcaccgaggggttagttccaggccttgcagctgacatcatggagtgcagggattccccgcactggcccacgctgaagataggggacttgagttccagtcttccttctgctaccgaccggctttgtgaccttgaacaagacttcccctccctgattccatcctcatgtcacatctgaagcctccaacttctgtcactgagctcaggattcccaggcaagcccacggagtgccccacagggtcagagccgtaacaggacttggaaaataacccgaaaattggtgcatggttcttttcttttcttctctctttttttttttcgggttttaatttccctatgtaataataatgatttgctatcacttttcttttttatttatttcttattttatttagagacagggtctcgctctgtcacccaggctggagtgcagtggtgcaatcatggctcactgcagccttgacctcctgggtttaagcaatcctcccacctcagcctccggagtagctgggacttcaggtgcgcaccaccatgcccagctaatttttttggtttttagtagagacgaggtcttgctatgttgcccagcctggtcttgagctcttgagctcaagtgatcctcctacctcagcttcccaaagtgctaagatcacaggcatgagccaccatgcccagcctgctctcacttttcaatgaggaaaatgaagtccagagcaggccagtgactcccctggggtgaccagaaggggtggctacacacaggtgtctacatcccaggctacccaatttcccttctgtctatccttatccctcactaccttccttccatttcctgctggcactaacccaggcctcagcccatcagccaaaacccacctggcttgtggaacctgtattctaatgaatggagacagacaaaaaagtaaatggggccaggcgtgttggctgacgccttgaatcccagcactttgggaagcccaagacatgaggattgcttgaggccaggagttcgagaccaccctgggcaacataggaagcccctatctctacaaaaaattaaaaaaatagccaggtgtgatggcgcgcacctatatcccagctactcaggaggctgaggtgggaggattgcttgagccctcagtgagtcgtgattgcaccactgcctccagcctgggcaacagagcaagactcaatctctacaaaaataagtaaatgattttttaaattaataaaatgtaaaagtgaaaaaaagtttaaaaatgtaaaaaaaatgtaaaagtgaaatgttcatttgagacaagaattatggcaggaaaggatagccattcagtggggcagccagagacgaagagtatggtacagggattggggagagggaactccaggcagacagaagagcttgcacaaggaccaggaagtaccagatggctcatcacctccacacaagcagcaagttgctagagctggcataggttgagaatgaggcatgaggctgtaggcactggctgaagccaggttaagaagagaagaggaagccaggcgtggtggctcacgcctgtaatcccagcactttgggaggccaaggtgggcggattgcttgaggttaggagttcgagaccagccttaccaacatggtgaaaccccgtctctactaaaaatacagaccaagctcggtggctcatacctgtaatcccagcactttggaaggttgagtctggcggatcacttgaagccaggagttcgagaccagcctggccaacgtggtaaaatcctgtctctactaaaaatacaaaaatcagccaggcgtggtgttgcatgcctgtagtcccagctactcgggaggttgaggcacaagaatcacttgaacccaggaggcggaggttgcattgagccaacatcatgccactgaactccagtctgggtgagagagcaaaattctgtctcaaaaaataataataataaaataaaaataaaaataaggccgggtgcagtggctcacgcctgtaatcccagcactttgggaggccaaggtgggtggatcatgaggtcaggagatcaagaacatcctggctaacacagtgaaaccctgtctctactaaaaatgcaaaaaattggcgtggcgtagtggcgggcgcctgttgtcccagctactcgggaggctgaggcaggagaatggcgtgaacccgggaggtggagcttgcggtccagccttggtgacagagccagactccgtctcaacaaaataaaaattaaaaaaaataattagccaggcactgtggcacacatctataatcccagctactcgggaggctgaggcaggaggatcgcttgaacccaggagtcaaagattgcagtgagctgagatcacgccactgcactccagcctgggcaatagagagagactccatctcaaaaaaaaaaaaaacacaaaggagcagcaagggattggggtgtgtcagggagccctaagagaagatggggttcaaattttttttttttgagatggagtctcgctctgtcgctcagactggagtgcaatggtgtgacttcggctcactgcaacctccacctgccaggttcaagcaattctcctgcctcagcctcctgagtagctgggactacaggcgcaagacaccatgcctggctaatttttttatatttttagtacagacggggtttcatcatgctggccaggctggtctcgaactcctgacctcattatctgcctgcctcggcctcctaaagtgttgggattaggccgggcgcggtggctcacgcctgtaatcccagcactttgggaggccgaggcgggtggatcacgaggtcaggagatcgagaccacggtgaaaccctgtctctactaaaaatacaaaaaattagccgggcgcagtggcgggcgcctgtagtcccagctactcgggaggctgaggcaggagaatggtgtgaacccggaaggcggagcttgcagtgagcggagatcgcgccacagcactccagcctgggcgacaaaacgagactccgtctcaaaaaaaaaaaaaaaaaaaaaaaaagtgttgggattacaggcatgaaccactgcacccagcctaagatttttttttttaattagagaagggggtctcactatgttgcccaggctgactttgaactcctgggcttaattgatcctcctgcctcagcttcccatagtggtaggattaccagcatgagccacggcacccagccaaccgccccctaccctttctttttcttttcttttcttcttttttttttttttttttttttgagacagtgtcttgctctgttgcccaggatggagggcagtggtgcaatcttggctcgctgcaacctccgtctcccaggttcaagcgattctcctgcctcagcctcctaagtagctgggactacaggtgcctgctgccatgcctggttagtttttgtatttttagtagagacggggtttcaccatgttggccaggctggtctcaaactcctgacctcaagtgatccacccgccttggcctcccaaagtgctgggattacaggcatgagccaccacgcctggccttattttattgtgtttttaatagagacggggtcttgctattttgcccaagctggtctggaactcctggcctcaagggatcctctcacctcagtttcccaaagtgctgagattacaggtgagagcagagtcgcccagccagggttcaagatgtgagaggtaaggcagttctgggtgacagtagaggttgggaggggccatggagagagccgaagcgaggccccatgtggtcaagggggtgagcaggtggcatgcctccaggacccgctgtggggagccccagctgcataggctgccggggagtgagctgccaccactggggggtgctgcagaggaaacaggggctggactccagccccagttccctgtccgtctccagtggcctgtggggctgctccctcggcagatgttggtatttccctggtgcgctcgttcccaagtggcctggtgggcagtgcccaggcaggccgaggaggcagagagcaggaaggggaagccccgcctggtttctatctcacaccagggacccggcagggaaaccccacaggtcctaaaaagaaagtggcagcagttgttcttggggaagaccaagaaaccccatcctctccctgaagatgggaaatccagggcggggctgagggtggggctgtgctggaagggagacctgtggtccatgtggcccagccctgaccatggcctctacagagcagaaacaccaagattattcttggacctggttgagccctgatcctgacctcactcaactcaagcctggccacaggctgagccccgatcctggtcactgactgagctctcatcccagcccaagcctggaccccctgctgagtcccagtcccagtcagcaccttggccaaagaccaagctctagacccaaccctataggccacaagcaaagccccaggtcactgatagctctgaccctaaacacagacacagccgggacattggcccgggactaggctgtgagttcagctgtacactgattcctgatcctgattatagactgaaatcaaatcctatatctgactcaggttaaagatggagacagagcccttggccctggaaaaaaccctaaccctggtcccagatatggcctcggacctggttttatccagccctgaccctagttacaaactgagctccaatcccaccctcacgctgagcctctgcctggccccatgcaaaggtgcatcccagccacccactgagcactgactctctctgcgccacctccctcagccatctggtaaaccataagggagtcagatgactcaaaaccccgaatcccctcgggtgggcaatccccttacctggctatccatctttggaaggacagtagaccctaggatgatggtggcagagccgagaatcaggagggggtttgggactctgggatcaaccagtgaatagggctggatggctcacccaagcatgggacattgaggacagggctggacgtgggagcttagcagtgagtctggagcttggatgtcccgaaaccccagcttcccgtcaccccccatcatacctcccaccccctccgggaagggaaattacatttccccattttagcaaggggtggcgagagggaagaatgagtgaacacaaagctgaaagtacaagcaggacggaaagtgaaaccgggcacagcccccagtataagaccccccctacccaggagatggctgaccaaagaggctgggccccgccatgggccagacggcaggcgaccttggctggcgtgagtttgaagccaggggtggggggcttggttgagtttgggcagagaatggacgagcttggctggtgcagatggggggtcgagagctgagagcagcaacttggccaagactgaggattcggctggctgctgcatgggaagggaggctggcatgactgggtgggggcctggggcagtggggtggtggtctgacccagggctgggcagaggatgagaaggaggccttggctagtgggaatggggagggttggaccagcaatttgacaaggaccaggtctaggcagataaatgaagagtttggagtgaataagcagaagccaaacagcttggctaagactgagaatggggccggctggaggaagagcagaacgaggtgctggcacaagtggagcactgggaccaagatgtcagcagcctcactgggtcaaaggtctttagtttgatgttggaaagaggtccaatctgcggctggtggctgcagaactcaggggctagaaccagagcagtaggcagtggagaaggtaacatgccacgtagggcaggtagggaccaaaggctggaggatggagacagagccttcaaaggccagagccaatgacccaggatcagctgcagagggtaaggagggggtctggggtctccagaggtcaggttggagatggcacagctcacttacggttgggcttgatccaccagggcctgggggcacccaccctgtccccaacattgagctaggaagaaccccactctgccttaagtctccaggatgtcagagggtccgagtggccccaaaaccagggagtctgaatgccagagatcttacgttaggcatcgcccaccacatctgcaagcccacgagggaggtagatgtccctagaagctccccttcacctttatcaggggacatttcgaagagcagagcccaggggttagagattgagagaggacagggaagaggcagggagagaagggagagcaggatggacttcgggccagttttggtttgtgtttcgaggagaattgtgtaactcttgtgcttgctagatttcctctccctgagggggaaattgatgaatgctgccctcttcctagagcgcccatccgctgcccctctttccaggaaaacacaggtcaggaagcacactcggaattcagccattctgggctgggcgcagtggctgatgtctgtaatcccagcactttgggaggccaaggcaggcggatcacctgaggtcaggagttggagaccagcctggccaacacggcaaaacccctctctactaaatataataaaaattagccaggcgtggtggctactcaggaggctgaggcaggagaattgctttaacctgggaggtgaaggttgcagtgagtcgagatcgygccactgcactgcagcctgggtgacagagtgagaatctgtcttaaaaaaaaaaaagctcccatactgtggattcgccccaggcaggttaccctgctaggatccacctgccgtggtggaaactggacaaacctgtccttttgactccctggaatagagcctctggcattgccagcccatccctggggacctcatggccagttcaagccatcagagccgcttggctgagcccaaagaatccttgccagaacatggtgtgcccactcctggggcagatggctgcctccctctgcattctctggggaaaacccatgggctctgcatttggaaaaacctggaatccagtcctggcttcccaccttctggctatttgaccttgggcaagtcaacctcactgagcctcacctgcaaattggggagaacaatagcactgaggctgccacacgtggttgtgcaggttgctcactgaaaaaggcatttggccaagggagtttatgggggtcaaaatccagtctctgtcccggcacagtggctcatgcctgtgatcccagcaatttgggaggctgaggcgggaagatctcttgaggccaggagttcaagaccagcctgggcaacatagtgagaccctgtctctacaaaaaaatagaaacagttaggcacagtggtgtgtccctgtgatcccagctacttgggaggctgaggcgagaggatcacttgagcctaggagttcaaggctacagtgagctgtgatcacaccactacactccaggctgggtgatagaacagaactctgtttcaaaaaaaaaaaaaaaggatcaggcttctggtctttttgcaaaagtgggcacaccatgcggagatgccatatgggggccgtgctggctgcatcgtggggttttgttttgttttgttttgttttgtttttttgagacagagtctggctctgtcgcccaggctggagcacagtggtgttagctcactgcagcctctgcctcccaggttcaagcgattctcctgcctcaacctcctgagtagctgggattacaggtgcccaccaccatgcccagctaatttttgtatttttagtagagacaaggtttcrccatgttggccaggmtggtcttgatctcttgacctcatgatccgcccgcctcggtctcctaaattgttgggattacaggtgtgagtcaccgcacccagcctccattgtggttttgaggaggcagaggaatgatgctggtcaaagtgcctgcaccgtgctcacagctagcacaggctcagaaaaggcatgttcccttccttctcaagctctctccctgtcttgccaccctcttcccatctctccagggctcagcctgttgctgcttcccttgctcctggttcaagctggtgtctggggattcccaaggcccccagggaggccccagctgagcctgcaggagctgcggagggagttcacagtcagcctgcatctcgccaggaagctgctckccgaggttcggggccaggcccaccgctttgtaagtccccctaatgcagctggcgctggagatgggcagacccccaatcccttctggcccccactaacagaccttgccccccaggcggaatctcacctgccaggagtgaacctgtacctcctgcccctgggagagcagctccctgatgtttccctgaccttccaggcctggcgccgcctctctgtgagtgagggctggtggagtggggcgggaagcttgtgataggctggggccagggtgcaagatgaggctggagattgagctggagatgcattggggatagaacctggataaggctgaatatgtcattggacatagagatgaaagacaggcatggtgacttamacctataaacccagcactttgggaggcccaggtggaaggactgcttgaggccaggagttcaagaccagtctgggcaacatagtgaaactttgtctctacaaaaaaaaatttaagagttagccaggcatggtggtgtacacctttggtcccagctactcaggaggctgacatgggaggattgcttgagctcaggagttggaggctgcagtgagttatgatcctggactccaggatggagaacagagggaaaccctgtctcagaaaaataaataaactgccaggcgtggtggctcatgcctgtaatcccagcacgttgggaggctgaggagcacggatcacctgaggtcaagagttcaagaccagcctggccaacatggcgaaaccccatctctactaaaaaatacaaaaattagctgagcgcagtggctcacgactgtaatcccagcactgtgggaggctgatgtgggtggatcacctgaggtcaggagttcgagaccagcctgaccaacatgaagaawccccacctctactaaaaataccaaattagccgggtatggtgctgtgcgcctgtaatcccagctactcgggaggctgaggcaggagaattacttgaacccaggaggtggaggttgcagtgagatgagatcgcgccactgcactccagcctgggcaacagagcgagactccatctcaaaacaaaccaacaataaagatgaagctggaataaggaagtggggttgggaagaggtaagagtggagctaggcatggaacgcggcaggcatgggactggaatgaggctggagacagatcacagcagcatggagggtgggtggaggtggcactgggggtgagaatgcggatagttagagatgagaaggtgatgatgagggtgaacgttaagcatgggatggagaagggatggggattgctggtggggaagggaatggaatagggttaggaatgaggttggagatgggatggaaagatggaaagagtgagwctgggcacatggaggaaggatggagttggggttaggaatgggaatgaggctgaagatgggatggaaacacatgggcaggaggtatgatgggatggtggargagggaagggaacagggctgtggatggagagtgcttcagggactgagagggggtgggttagagaagatcattggcataggagtgaaagggaggctggaaaaggagatgggacaaatgtcccagacagtggagatggaaggaatggggacacagctgggctgaggtgggggaagagctacagggatggactggaggctggagcgtggaatgggaaggagacccrgatagggagggggtgggtgtgatatggccatccttggcctgtggacctttcctgaccatctccctccccttcaggacccggagcgtctctgcttcatctccaccacgcttcagcccttccatgcccygctgggagggctggggacccagggccgctggaccaacatggagaggatgcagctgtgggccatgaggctggacctccgcgatctgcagcggcacctccgcttccaggtagagcccggccaccctccaccaccccagaccacgtgggaaagaagactcgctggctcattcagtgatcccatgctctgagtgtgtgtgagtgtgagagtgtgagtgtgactgagtgtccatgagtgtgtgggttcatgagtgtgagagtgactgtgtgggtccgtragtgtgggagagtgagtgtgactgtgtgggtccatgagtgtgacagtgtgactgtgagagwgtgtgagtgtgggtctgtgagtgtgagagtgtgtgggagtgactgtgagtgcatgtgggtctgtatgagtgtgagcatgactgtgtgtgagggtgtgggtccgtgagtgtgagagtgagtgtgtgggtctgtgtgagtgtacctgastgtgagastgtgtgggtgtgactgtgagtgwgkgtgtgggggggctgtatgagtgtgagcatgactgtgtgtatgtgcgtccgtgtgtgwgtgtgactgtgagtgtgtgggtctgagtgtgaaagtgtgtgactgtgagtgtgtgagtgtgtgggtgtgactgtgagtgtgtgtgggtctgtatgagtgtgagcgtgaccgtgtgtgtgtaggtccatgwgtgtgagactgtgagtgtatgrgactgtgagtgtaagagtgtgggagtgtgtgggtgggtgtgtgaatgtgagtgttgtgagtgtgaaagtgaggtgtgtgggtgagagtttgggtataggtatgtcagtgtgtgaggatgagtgtgagtgtgagagtatgtgggtacgtgaacgayttttttttttttctgagactaagtctcactctgtcgcccaggctggagtgcagcggtgcgatctcagctcactgtaacatctgcctcccaggttcaagcaattctcctgcctcagcctcctgagtagctaggactacaggcgtgcaccatcakgcctggctaatttttttgtatttttagtttcaccatgttggccaggctggtctcagactcctgacctcgcgctctgcccgcctcggcttcccaaagtgctgggattacaggcgtgagccactgtgcccagccatgaatgtgttttgtgtgaatgtgactgtatgggaatgagtgtgggtgcgttgtgagaatgagtatgtgtgtgagtgtgtgcgtgtgtgcaggcgcacacacagccacaccaggccctggtgctgcccctcaatcttcacattctcctggggctctatcttcaacaggaggccattgggctgtgaggtcactcggggtgtgtcctgagtgcccagcacagcgtctgcctcctgtttcctttctccctctgattctctgatgtcacccagatcctccagaacctttcaaagggaaatcagaattttacacttaatgaaatgagaatagaaaatgcaagcagcagggctgggcgtggtggctcacgcctggaatcccagcactttaggaggccaaagcgggtggatcatttgaggtcaggagttcgagaccagcctggccaacatggtaaaaccccatctctactaaaaatacaaaaattagtcgggcgtggtggtgcgcgtctgtagtcccagctactcaggaggctgaggtaggagaattgcttgaactggggagacagaggttgcagtgagccgtgatcaccccactgcactccagcctgggcgacagagcggggctcccaagaaagagagagagagaggaatggcaagcagcagggaatctgagctatgtcaccctctgcctgttgctgacccgacccaaaagcaactttcacagcagagagaaacttcctgaaccccacgcctcggggcagtccttggggtgatctagctctgtgagcatcctcttgctccttgacttccattttctcgaactgaaagatcaggtgagacgcgttagcaggtgacatcatggaagatcaagcagggaatgtccggggaaatcatgaccttgtggtcactgatgtcattgggaaccgctgggcatgaatagggaatgaggattcctctcaggttctcggcctggcccctccctgacccatggcctctcctcacaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggctctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatccacccctggcctccgcttctcttcgggtaagggctgtctgacacccagagggcagggcagcctggaacggggtcagcaacctctagccatcctgaacccctctctgctcctacatttttggggtctctggcccaccttcccctactatgtcctgctccggcaggcagttgccatagtaaccagcagcatcctgaggccgagctaccgtgttggaagctcaaggcagctcatctctgattctgaacagtgctccttaagccctcccaaccgccttcctttggcctggatgcagctccagaggtttgtgttatccccgcccagttctgagggtcttggtgcagggagttgggctgggaagtgggagttagagaggaaggcctgtaaggaaaatggtcgctgttccctcagtcttccttgcagtctttattgttttattttgtttttaaaagatggggatcttgctatgctgcccaggctggtctcgaactcctggtctcaagcgatcctcccaccttggcctcccaaagctctggggtgacaggcgtgagcccccgtgcccagcctccttgcagtccagacagctgactcaggctggggaggaaccagggcaggcaccctgagaggtggtctcagtggggtaggtggtccaccagcctgtgtcggagaatcagactccttaagttcacggtcttcccagacgtctggttttgcctgctccatgaatgatacatcaagacactgaggcccagagggtggagaggatgtgtccacagtggcagagggagcagggctcagtggcattggagcaagccttctggcacccactcagggcctggctcccagagcaccgggtctcagtcactggggcttaggccggcccagacgggcttgcagctcctgcatcatgccagggtgcgcgaggccaaacctggaggcggaagtcaggcccgtgagaacaggttcccaggtgcccgcggtctcttccccaccccagctgagttgccctgtgcctacccgtgtcccaggggccttctcctggctggcaccggggtcccatcatgcctcagagggcttggctccaggggttcctccagctggaggggtctctgctcaggagctgacagctcctcctcaggagggttgggggctgggggctcctcctgctgctcccaggccggagtccgacgaaaagagggccgggagcgacgctgtgaggagcttctcgagaggtgcacgcgactccttgggacagagacgtctaggagggacccggggagcggggcctgcaggaaagggggcacagaggaccatggggccggcttcgggattccactcgttccccccgagaccccaccaagagccctcacctcgctccagctgttggcagcacctcctctggcactgcccatggcctcagccgtctcggcttccccgactgactccggcgcagcttctgcaggggcctggtgtgttggctgctcctcctggcccctgacatgttccaggctttctggctcagtctccttggcctctgccctccggcccccggtcaccatgagaccctctgcatcaaggagccttggtgcctctccctcagggtggtagtccccacaccgcccctcactgtcttccctctgttctctctcctgccatccaacagcctcttcttccaacagcgtccacttttctagaagccccccagcctccaccatggctcccatcccctctgccctcgctgtctgggagcccgcgggatccagcccacagctgtcctctgcgcctgcagattcctcggcctctacccgccctccccaaggtcctccctccctggactcaaaagcctctacttggctgcctctgccagtcacctcttcctctgctgagccctccagaccaaattcttgcccacctgcatgctctcctgctgctgcctcttccttttctttcgagtcccagccttgcccaagcgccccttccaaagcttcaccagcgccagcagcgctgatgtgtgggaccacatcaccccccataatcccagcagccacagagccagtctgtgcatcctcacggtccgggaggcccacagccaccgcttgcagcctccagcctcttctggatgttctgtcagcctccgcctcctcatcctcagtttctctggcataggcctctcccagtgacgggcaaggccctgcgtctgcccctgtgcttccgtccagctcctggttctctgagacagatgcctctccctcctcagttccacatcccgcgtcctgggttgtcagcccctccccgcctgcctctgggacttctgatagttcagactctcggtctccttcagcctcagccgccagggtctggcctcccgcagtctcctcctcctcccgctgctcgccatcggccgcatcctcctgagtatttcctctctccatgtcctttctcgtgcggttttcccaggctcctgggaaggcctcggaggcctcaggctttacagaccccgcgtgcctgggacctgcctccaggctcctctcctgctcctctttgctcagggccagaactcccatgagctccacctcccctgcctccctttcctcgggttgcttagttggggtctgggcgccccccatcagctcaggtccttggcctttggtgacgctgtgtgtgaggccaccccattccacgcccagtaggccacagctagtctgggccgcctcactctcctcccctgtgagctcctcctcaggcctggcctctggagttgcctccaagtcggcagtgccttcagcctctccatctgagggcagctcagccactggatccctgctgctccctctctcctcctgggcctcctctgcctgtaccagctcttccatcctggcccggtcggccctgatccccaagtcctgcctcatctcagcctccttaccacgcaggtctacctggccctcaaagctctcccctgcctcctggcctcccacagcttccctccctgcggtctggctctcagcagcctcttctgttctttcagtgcccaggacctggggctgtttggggaaagggctcacctcagcctctctctcctcatccccctcctcctctaggacccagacttttccagtagcctctaggagcctttctcctgggactgctccatattctgtctgtctgactcccagcaggtcagcctcctctttgcctgaggttgtccaggcctcgtcccctcctgaggctgtcccggcctcctcccctcctgaggctgtcccggcctcctcccctcctgaggctgtcccagcctccccgcctgaggctatcccggcctcctcccctcccgaggctgtcccggcctcctccccgcctgaggctgtttcagcctcctccccgcctgaggctgtctcagcctcctccccgcctgagattgtcctggcttcctccccatctaaaattgccctggcctcttccctacctggggttgtcctggcctcctctctgcctaagattccccagtcctcaggctctgcccctgggccccacgtcccccatgccctagtgctttcacaggccttctccaccactaccacctcttctcctttcccagccccttcggccccaggctcctcagtttcccctgcatctgcctccctgaccccctgctccatctcccggttgtcccctgccgcctttggcccaacagcaccagccttcccctccgtctccccatgccaggtccactctgactccgcccctctggccatccctggctctcttgccctgacctcttcctcctcctcctcctgttcccagcttctcagcctctcttctctgttcacttcctgctcatgggactcctgcctctcctgggcttggccgctcctgtcttggcaagccccagaccctgccttggatttctttctggcctccaagtgggcgcttggctcctggcacctggcagccttggctgtctccccagccccactgtcctgcctctctgcttgggacccatgggagctgccatctccccagccccaggtctgttctacagctgagctccccacttcatgtcttctgtcatctccaggccctctcagccttccagccccctcgttttggctgcctctaaggccctccaggtcctcctgggcttcctcctctacaatcttccctgtctttcccaccgccaccacccccagttcctcagccgcctgcgcctcccgctctacagtggggactgcatctcccaggaggtaggagacaaaggtgccgagggaatcctaggaaaaaagagagagagaggggagagtcattgaggagagtcccagccctttccctgggggccctggctggaggagcccaggttaaggaagagggtactgggatctgaaaggagaagaagaggatttgcagaaggagccagaaggggcatcgattaggggtacgaggacgcatggttggaggtggggactgaaattcagaaaatattaggccaggagtctgcctgaacctgagaaagcaatctccagtttgaggagatcagaaggaggaggggaaaggtgaggccccaggggaggtgcccggaagtgaggccccagggaatggggtgcaagtatctggcagctgtctgcccttctcaccagtgcccccctcaaggcctggtgcagcccagggaggtatagccggaggaagtccatcctgtctgtctctgtctgtgtgtccagaaagctgataatgaccgtccccacccaccaagacaagccaaccttccccaggaccaaaggcacttcctcttcccctgtctccctgatgcgtccccaccccaggccctgcccacggcccctgatgcccacagtagcccccactgcagcccgggaaatgggtgtacatcacacaggggactcaggtgcacatttggaaataaaggacaagcaagaggccagaaaggacaaagtgggagcaggagaccttagaactggggagggggagagggaggggacatgtggcaacagcagctcaagtgactcaggtctcgtatccgcacctcagccatttctgcctcccctacaagccacagccactctgcaagaggaagctggggtttgtggttcctgttttgcctgggaagaaagagtagcagtgaagagggggctggtgggagctctgacacatttcggcgtcattaatgcttcccccaggggcggaaggggccggattggtggctctggggtgcatcccctcacctatgattaggcttgcaaaaaagaacttggctaaactttatattgtggatatctgtgtctgcctcccaccttcctgtgacttccttgatggcagatgccatgtatgaaacgctgctgaatttctagagccctgcacgttagtaggattccattttccatcagctgagtgacctgggaggcacactagagagggcacatttcttttcttttcttttctttttttttttgagacagtctcactctgtcacccaggctggagtgtagtggcgcagtctcagctcactgcaacctctgcctcctgggttcaagtgattctcctgcctcagcctcccgagtagctgggattacaggtgcgtgccaccacacctggttaatttttgtatctttagtagagacagggtttcaccatgttagccaggctggtttcgaactcctgacctcaggtgatctgcccaccttggcctcccaaagtgctgggatgacaggcat

SEQ ID NO: 17860 - DNA, 21322 bp, Homo sapiens
ccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggaggcaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttaataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagggcccctcagggtgtggggccctgtagacctgcatagatcaaactcccatgaagccaatcctgagtcccaggcaagctgggacttttggtcatcctagcaatagtcatgtgagtgcaccatcttggaagtagatcctccagtacagtcaagctttcagatgactgcagtcccagcagatacatgactccaatctcatcatccactccaaaactaacctacagaaactataaggtaataaatgttttcttcacagttgctaagttggaggtcatttttcattcagctaaagttaacttatatgacagccatattctttttacaatggaaaagtcagacaggcatacaatgctcattttcagcttattcacattgtcactattttgtggggttacctggtgggcacaggacagtgaccaagtttgcaggtcctccagctcctgctggatcttttagcttctccaaatcctagaaaagttgtgtgtttagctctttcagaaaacacctgaccttctcatgcatgttactccaccatcgaagttagaagcttggagataacatgagactgatgcaggttttagtccatttcatgggctcttctcttttcaggcttccagtgtatacttgctttctccacttcacctcacctttccttccacagaaaggtcagggtatggagctcatatgagggtttagaggaatttggctcaagggccagggccagcttcctccagtgtttcgggtcacaacctagatacacctttatcagcgcctgggaatgttcaaggtcctaattttcattcaggcctgttggctgggtcacagaatgatcaagccactccatgattttctagcatgacacagcaagaaactgggggagactggaggactctacaaaaactttcattttatgtatttcctggtagctctgttttctgatagaacctaactgagataccatttttgccagttcttctatggataagtattatttttttaatttttttaatattttattttttgtagagacagtatcctgctatgttgcctcgacttgatttgcattttttttttttactttaagttctgggatacatgtgcagaacatgcatgtttgttacgtaggtatacatgtgccacggtggttgggtgcacccatcaacccatcatctaggttttaagcccctcatgtcccccaggctggagtgcagtggcatgatcatagctcactgcagcctcaatctcccaggctcaagccaggctactgcctcagcctcccgagtagctgggactacaggcatgcaccaccacacccagctaatttttaaattttttgtagagacaggatctcgctatgttgctcaggctggtctcgaactcctgggctcaagctatcctcctgtctcagcctcccaaagtgctgggatgacaggcgtctgccactgtgcctagccagtactatttctttttaattagtttgtaagagttctttgtacgttaacaatcttaattgaatgtctgtcgtatatgctgtgaaattacttaatttgtcattaaccttttatcttttttaaacaatgttttgctatatgaaagctttacatttttatgttataaatttatcagcattttcatttatggctttgggttttatgacatgcttagagtagctttttctgcaccaagattataaaaatatccacacatagaattttctatcataaaagtatgacagaaaatgtcatattttgtatataattttattttttgtttagtcctggatccatctagaatttctattttgcatagcatggcaaagggctcacacccaacatcatattaaataaggtctttttccctgatatgaaatgccacatatatatgttattataatgcatagttagataccatgtggtgaataaaatatcttagaattattcaagcctaagaggatagaactactgcaaggatgggttttggtatcaacacagatgtttatacatagagagaaaatgatgtctgtgtgcttagctgtcaaataaggagactgggggagggttaaatgtaatcagtgatatcataaggagtggtggaattctgtttggaacttcagagacctaaggagaagactgaccagcttcttctgaagacttctgccctctaaagactaaggcctaattccactggtttctttgaattccgtggtcctaagtccattttcaggtaagtggtttcccgctggatgtgggtctctttaagccgtatcaaacagtaggtgagtgtatcagttataaatgtcttaagtaataggaggcccaaattataatggctcaaataaaagtatatttttctcataccatgcagtccagaagtaagcagatacaggtgttagtttagtggcttgaaattatcagagcaacttcaggcaacatttcttaagcaatattcaaggcagcataaagggaaaatggtagcaccatctcttttatcaagacagcaaaaagccttcccaaaagctatccatcagatttcccttatgtttcattatccagagctatgtcacatagccatgcctaacttcaaggatggctaagaaagggaggattcagctttttcagcttatctagttggatgtagtaaatgaaaaatgggtgggaacaatatctgccaaaagtcgccattcattcaaaaaatatttattgagcacctggataccctatgtgctaggtactgtttagcagtgaacaaaacagacaaaaatccctgcactcatagagcttacattatattcaggagatacatataataaagtaaagtaaaatatattctactaggttctgatgaggttctggagaaaaatcaagcaggtaagacaattaggaagtttgtaggagggtggtacaattttaacaatgggatctaaggaaaatcctcattgagaaggtgatatttgagtacctgacagaggtgaggaaataaattctgagaatacctgggggaaaagcattccctggaaagggaaaagcaagttaaaaagccccaaggtaggaacatgcctagcttgttcaaaatgaaatgaggctaagttggagtgatgatcaagaggagactcataggatatgtggtcagcagtaactaggacataatctgacctacaacctaccaagatctctttggccactcactggagaagaggcttaagggaggcaaggacggaagcagaaagacagagatgatggtgggtagcagtggaggtggtgtgaagtggcaggattctggatacgttttgtaagtaaaggtgactagacttttctgatggataaagtgtatgagagaaaaagaagagtcattactatatatgtaaatctaagcaaacatttactttttaaagcaayttaaagtttgttacttgaatatataaaatatatcatggagttaaaaatatatagaaatttattatatttggtatctaaagtagtcaaattcatagaaacaaaaatgaggagctgtttagagtttcagttttccaagttgaaaaagttctagagatctgttgcacaacaatgtgaatgtacctttttcagcctgaacaggtgaaagagtttctactaattgagttggggaagattgaaaaggtatcaggtgtaggaaggaatgtccggtatctgacctgatagagcatagtcaggttttgttttgttttcttggaggggatatattttgctttggaaactgaccattttcaggagtcacctgtgtaagtcagtcaattgtccttatgttcgtgatggtgagaagatttttggaatatgagctaaaccatcattgtctaacttttcagacaaagtttctgtggaaagacctacggacaaagacatctctccttggcagagtgagctaggattaccagctcttcagccgcagctgaaggcgggagtccatggaaccccagaagctgctgayaattggatttctgctatgctctctaacttgcctcttgttggagacagtagcttcctctcctttgcctttgtctgccttgggaatacaagaaaaaacaggatcgaaaccacgctcagggggtgtgtttgctgttaggatgaatgtttctttcttcataggacttaagattcatgtttcagttcaggtcaggtaaaatgaatttcatgtttaaaaagaatgttcataggaaagcaaactattctggtttggttcaatttagttcaacaagcattaacctacctactacgtaccaagcccttttctgaactacatggattaggaattgaacagcctctgttatgaaggagctcacagataggcagacaaagccatagatgccaaccttccatggagtatgatcaatgctcccaggggacaaggggataatttaaattgttttgggggaggggtcaggaaagacttgacaaaggaggtgaaattgaaaataaacctgatggtccactgatccacaatctaggttccaacatgcacacacatgctattcaagtgtcttgctggttagtggtgaatcctctcaactccatgctgcagacactttcgttttcccctccttctttcttcagggtcaaagcactgtaccttcctcccccagttgctaatgaaaagacccaacatccccagccttacattgatcagcaaactccccctagaggtccttcttccagtggccctggcccctttctcctctgctcttagggctggtggccttctcctttctcttcctgggatactccctctcctcagcctcctgcaggactcccagatatactctaggcaacaacaccttagtaaagactttcttgttatcaagtcatgcttctctttcaaaaagtacccaatatactcaagatatccgaaacaacaattattgttcctatttgacttacaaggaggcaaaaattatatccatctcaggatactttaaaaacaaaatgtttgccctttgaacatcttacagccagcacagcaaagtagtttagaatatgggctctggacaactgtaagaacatgatatctgggacaactatttgaactcgaatttggattcaaacgccagccctatcatttacttgacctctcctcaatgaatgtctatgctctttctgcaggtaatcacaggtcctggctgaacaacttcagggattacttatggcaacttatcaagagtgccttacctccagcagccattgttgcttttcttctcacctcagcactaatggggatcctctgctgcttcacgtaagcttctgtgggaagaagagacagggaggagagagggaatgtgaaggggggtgggaacagaaacaggttgctcaccagcctgcatatctgtaattaagggaaagttttaagaaattcaattctgggaggaaaactgtgaaaggtcatgcaacccccttttaaaatgtctactttctcttttacttcctccaacttgctccatttgttaccagtgactgacaggtcacatttaatgactagtgtttccaatggtcatttcttttatcaactttattaactcctaatttttcttccctgtggctcaagaactatacatagaaaataaataattagctgtgctctcaatttcctgaaaatttatcataatatttatctacataaatcatatgaagccaaaagaatcctgaggaaaacaaaatagttgagctaaattttgttaattcagtcagtatttaccaacaaatgactacttgcttgtctctgtgcttgttgctagaaaggcagagaaagaagacaattaaaaattacaaattggtaggtcattgctattgtgggagacagagtccaagtggggagacctatgaaagtgatcaacaaaggtgttaaagagatgaggtcaggaaatagttggccagtttgcaagaggaactaaaagggaatagagaatagaaatggggggtcctgcagagctcaaaaatctaataaaagtggctgaggataaagatcagattaagggtgtggcatcacctatggctcctgtaacctcaaaatgatcacaggatcaagaactgtgtctaggaagcaaccttggatgtggttactggcacatggaactgattggagacaaatagattagaagtcagctaagcttttgagagaagcttattgccagagaaaccataagccagaactaaatgagccatctgttgtaaacaatagttaggcctccacctttccatgaaaaagaaggacaccagcttcgaaggtcccaacatttgcttcagatgcagccatagagaataatggatcagtagagcctcccagagaatggacaatgggccacagagtcaccctttgaaagcaggatttgggcctaatccatgcctacctaccaggactccaggattgccacagagcagtgactgctgtgtgtctctcattcttcctatttccaaatgggaatgtttatggtgcttatcctcttcctgttccatcattattctggggtgtggagatcaggagcatataactcgttttagttcataggtcacttaaccaagcagagccaccctcagacttgagagaactaagcatcacccagatactctggactttgagctggacacagtgatgagtgtgacttagtactgaggaaagggtttgccacaagtcaggtattctgaaactagacagggagaccggaatttggcattcagagtataattaatgatcaatgcctgtggaagatagggggtggaagggagaaatcaaactgccttgcaagcccaacaaagactcagtcggccccatcagggttgtcccacatggctgaaatggctggacctctctaaccccacctcagtcattcactggatgtgggctgcccccagaaagtacatggaagctctctgcagctgaggcagactctgaatgagctgacaggtagaggctttctgctgacaacactctcagcagctagggaaataaggcctttctcaagcggaaatatgggtggaatatttccatatgcatgacagggtggctgtgttccacgtatgaaaggaaaagtgaaacagatactgggtgatcagaaagacagactgtaacagagactggctatatgttcagcaatcctgttccttcttccccaagcacagagtaacattatattcttaaccttccttccagttaggctgggaccacagtactgagatttggccagttaaatacgagcaaaaggaatgtatgacatttccaggcctagccataaaatgtcttgcacatgtgtccatgctgcctctctctttcacatatgcagggcttcaactgaaggactctaagatggtgaarccacatgatggaaggagctgggatccctgaatcaccttgtggaggagaacttaacttacatcagaatgaggcatgagtgaaggatcaattttattgtgttaagctactaagatctcaggattgtttgttatagcagctgaatatccctgactagtatacctagcaaccaaccaagggagctggaactcaaatcaagatatgtctggttccacatctttgaagtcattgttactcaaactgtggtcagcaggtcagctgcatcaaaagcatctgaagtattggttaattaatattcagagggacttctgtgaagataaagcaggcaatatgccaagaaaaagaattccttctttgaagtagatggcttaacctgaatagaaaagccaataagcccttgctgggaacaagcaagctaactagtgaaagaaacatttctggacccagttgggcaccaagtagaagcctaacaggtaaattggaatgaataagcatataggcaagccatatttttaagaagcagtttgttgaggcaagaaggtaaagtctgaaacttctttatgctcagacctacatctgctgctctcacttgactggaaagaagtaaaggctacaagagctcacacatacctcagcatcatgaagagaatttgttagtccaaagtatagctctggacttgtgcacatctcctgtaaataactggtccagtaagagtttacctcattcaacaggaaacagcaccagatctatgcagagttactatatggaaaacacaagaaacgtataagcaagaaatggcagatgaggaatactcactagaaaaatatctcagggcagataaaaaccatgtactaacatattgccataaattcaaaacatttgatacaaaatataaaataatagctaaggtcgggcatggtggcacatgcctgtaatcccagcattttcagaggctgaggcaggaggattgcttaaggccaggagtttgagaccagcctaggaacatagcaagacctcatctcaataataataatagtaaatgctatatgcagaaatacaacagggcagataaggtataccaaaacaaaagaagaagatgaaaattagttggaaaatcccaagaaaaatgtaaaagacaaaaagtaaaactatcaccaaaatgaggaagcatgaagaaaaagagacattggtgcaaaatatgaaagaaaatatggaaaataggattatataggcaagcagtattaagtaaacagtttggtgaaagtaagattagagaagaaatggtagatgcaggaggcacagaatgatttcttcgatgaagagaaccaaaataatccaacagaagaaaaagttataattttttctttttcttttttcttttttttttattgttactatactttaagttttagggtacatgtgcacaacgtgcaggtttgttacatatgtatacatgtgccatgttggtgtgctgcacccattaactggtcatttagcattaggtatatctcctaatgctatccctcccccctccctccaccccacaacagtccccagagtgtgatgttccccttcctgtgtccatgtgttctcattgttcaattcccagctatgagtgagaacatgtggtgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcatttgggtatatacccagtaatgggatggctgggtcaaatggtatttctagttctagatccctgaggaatcgccacaccgatttccacaatggttgaactagtttacagtcccaccaacagtgtaaaagtgttcctatttctccacatcctctccagcacctgttgtttcctgactttttttttttttttttgaggtgaagtctcagtctgtcacccaggctggagtgcagtggcaccatctcggctcactgcaacctctgcttcccgggttgaatcgattctcctgcctcagcctcctgagtagctgggattacaggcacgcgtcaccacgcccagccagctgatttttgtattttttgtagagacggggtttcaccatgttggtcaggctggtcttgaactcctgatctcgtgatccacccgcctcggcctcccaaagtgctgggattacaggcgtgagtcaccgcgcccagccaagttataattttttaagtgttgcagaaattaaagaagactggagtctgtggtcataaaggacacatcaagtcccaggaaaaattgggacttgctactgggcacatagtagactctcagtaatacttgttgatttttaattaagacatttcacagtgaggattgcacacagcctctctgtgcctcattcttcctcctctatactcacctgtgtataccattagctgcagctgtaatgaaggcttaagctagctgcttattacctgaggcacatggaagcttggctaatctcccagcattccagaagcagaggtggaaatcaggaggactgacaggctctaacaagtccacaaagatatgtgtacaaggaatttttagtatggtttacgatagtgaagaaatggaaacttaaatgtccatcagtctggggctagctaaagaaagtattgcacattcatacactgagtactaaggataattacacagaaacatattcatgaaatatcattgagtggaaaaagcagattataacagaagatatatagtttagtctaatttcttattaaaaactaattgtatagggggaaagcctctaagaacctaacccaagtattagacattggttatctccttgtggtagtgaataggttgttttattactattggcggtggtgttaacttttgtttttcctgtctaattgcactttctgatctttcttttttttctttttctttttttttttttttttttttgagacggagtctcgctctgtcgcccaggctggagtgcagtggcgtgatctcggctcactgcaagctccgcctccgggttcacgccattctcctgcctcagcctcccgagtagctgggactacaggcgcccgccaccacgccaggctaattttttgtatttttagtagagacggggtttcaccctgttagccagaatggtctcgatctcctgacctcgtgatctgcctgcctcggcctcccaaagtgctggaattacaggtgtgagccaccgcgcccggcccactttctgatctttctacaatgagctgtattgtttgatcagttcatttttaaaaagatactttaaaaacaaaagaagaaaaactacctaaccatacttataccactacctccaagccccactgtactggaaacacattcttattctgctttttcatcaaagtattttgtttgtatggaattatttggttcatattaagagaaaaactggtgtcaaatccaatctttgaaaaggttatataattatatagcaactctgtgcagagcattcaccattttatcttcctttcccagcattcttgtagttgatccagtccactgaagaactagaagattcaacagggcaagtgtggtctctccagttggactccaaaagagtggggcatttgctatctgcttaaaatgaggaagtatctatcagttgaaattaaatcgtcttccaacttgaatcatcctttgcyttcattttctccttcaaaagttgcaattttaaaatgtgaatatccttattactgttttggttataatagtaatacatatttattgcaaaaaaaatttgagaaatacagagaaaagagtaagtttccataattctagcaaccagaaataaacatcattaacatcttgatgtacctcccttcaatttttttctatatatgtattacaagttttccaaagtctgttctgtgaaacaatagttctgttttaataaaagtcacaaaacagtgagggccctgtggtcagttatgtttgggaaatgctggattaaacaaatttaaagctatctttctttgctcaaggacttctaagaacttttaacaggctaatactaatctccacaagggagtataatatatagcatttcccaaactaatttaaacatgagcttttttttttaatgtagtggagatgacataagtcatttaatgacctctccatataataattatttaaggtatttctatttattgactattataaatgtaatacaggtaatattattaaaaattattggctgggtgcggtggctcatgcctgtaatcccaacattttgggaggccgaggcgggtggatcacctgaggtcaggagttcgagaccagcctggccaacatggtgaaaccccatctctactaaaaatgcaaaaattagctggccatggtggtgagcccctgtgatcccagctacccaggaggctgaggtgggagacttgctagaatccgggaggtggaggctgcagtgagctgagatagtgccattgcactccagcctgggtgatagagcaagaccccgtcacaaaaaaatatatattaatttgcttttcctttttgctgttctgagtttgaaatcattcattcaacagacacttgttgatcacctactgtgagccagacactgaacaggtaacaaacagacggggtcttgctctgtcacccaggctggagtgcaatggtgctatctaaccccagctcttgtggagccaccatgctaatgtgaagattcagagaaaccagattaagcgaggggcagagtagatattgtgagccattgaaaggatttaggctcttcctgggggccatagtgggggccaacagaaggtttagatcggaggagggatgtgaagggagagcagatgggatttgattaggatttggatgagatgagagagagagtgaggcttcaagcatgcctccgaggtttttggcccaagcagatgaaagaatggggttgtcatttattgagctagagaaaactgcaggaggttaggaatttactacagagaaaatgcaaagagaaagaaaaactgaagtgaaattctaattgatgctgaggtgagatccagtgggctgccacatggcctgtcatgtggcctgctgtggcaagccaaggtgaactcagaaaagacttggagttttgcttaagtccaatgtttcctttttgactgtctttctggatgatgcgtccactgttgagaatggggtgttgaagtccccgtgttgctgtcaatttctcccttgtcttctgtaaatatttgctttatatatttagctgctccaatgttgggtacatacatatatatatttacagttgttatgtcttcttgatggattgaccccatgaaaggaaaataaatcgcccccaaatgaccaagcgaaagggaaaagtcaagctgggaagtgcattgggcaaacctgcctcctattctattcctaaataagataactacaaagatttttttttaaagctacataccttcctcacaatttgcccatgaagaaattccttgtaaacaaaggacaggcagaactcaaagtcatccctctgctcacatgagacaaatgcatatctgattgcttcctttgccctattgtttcacaaagtcagactaaagcataagtgactcttcctgctctcacatgtaaattgtgtattcagtgaaaggctaatcagcaactcaaaagaatgcaaccatttttctcttatctaactatgacctggaagccccctccccacttcaagttgtcccacctttctggaccaaaccattgcatatcttacatatattgattgatgtctcatgtctccctaaaatgtataaaaccaagccttgggcacatggcatcaggacctcctaaggctgtgtcatgggcatgtccttaaccttggcaaaataaactttctaaattcactgagacctgtctgagatatttgaggtacacatttggtgaccacaaagagactctgagtggaggtggccctgacctttgacaaatctcctatcagtacttggtaccaactcgagctatctttatggctcaaaccaatagaacaatttgctgaggcctgggagctcccctccctccagagaatccctcatctcccaaaatttggttgagatctaaagtttattttgctgtacaactccttttctggagttttgcttgcttccaacaaggaaggcaagttttcctgcttccatgacaatgaaaggcaaataactgcattctggaatttgagctcacttccaacagggaaggtgagtttgagttttttcctacttctgggatggtagagagcagtcttcagcctgagacccactcctaggtaagtagctgaattggagttttctcttggctaaagttatgattcacagtcggctggtcttaatttctccttaccattagaggactcagtaatcatattgttggggttcttttgttgtttgttccagtctttctcccatcagatttggccaattctacctgacttggtcaaatttgaatgagaattccaaatagtgagtaacaaggtatctctgaattggctaaaattcctcgcagctgcaaaagagaaaaaaatgaccaaacatgcagttggtttgtgtgtttgctccctgtcttaaaaaaataactgttctttcgtttacttttcttccaccctattcctccttctcccctcgccatctttggtaccaagaagaatataaagaaggcatctaatgactctaaccctttaaagaactcaggacaaaggcaccgttcactcctttggggctgttctgttttctttgtggagtttcaagagtcatgggcagattcttcttaggtgtaaagctctgctctcctgtattgcattacctgacctctttggcttctgggggtgaagtggctacattgtctggggtatacaccctggggttcgttgtcatgcaccaggaaaatttaggacatggacacacacaagtctaggagcagaggtttaatgagcagaagagaagagaaagagaagcagctttctctatagagaaaggggtctcccggtggaaaggaccagcgggtggtggatgcgccaaattttagtcaggtttgaggaggtggtgtctgatttacatagggctgacagattggttcgatcaggtatgacgtttacatagtgcgggggaaggctggtggccccagctgaatattattatgcaaatggactttccagttgattggagccatcttgcctctctatgtctgcagctgaactttacaggctgctctttgttagaaaatcatttgaggctgcttttcattaaaaagaaaaactttactgaggatccccatacccttactgtctgcctaagtgatttcttcttaagtcctgtatcaggggtaccagagattaccttgtcctgtgagaggatttgaccttggcatgtgtaatagcagacaagagctacagttaaaggtggccgaggacagtttacagaaagtggtcttggctgggcttttttcctcctaggaggttgtttaggatctcaattctaattcagaggtgcattttaaagagtcttctccattgcctttcctgcccaaattaatctccattggcttgtctgcatatttgcatgaggaactgcactgtcactttcatagataaatgagagactgagtttcctcaaccccaaagagaaagggcattttgctcctcccagtcaaaaggtgctcctgggtgactggaggccaagtgggagtgtctgggggttgcctccatgtgatgtgcagtagccctacagggaattgccaacaaaattagttttaaaagcctcgtccagggagcacatataggagctgctcaccccaagctttgagccctcccagaggtgctagacctctggagagagaaactgagacacaaaagagggccgaaacaattcagtggtgatgcattgtggagtcctgtccgcaaccagcacactttgacccaccacactaaaccctaggccacagctcagttcctccttttaagaaaaaaacaatgtgggaaacacatcatctaagaataaggaaagacaaggagaacaagcccccttggaagcccatttggtttcatggctcctgtactcgcaagtggctgtgtaaatggaagggccggatttcctacgactccagctgctcacgcgttaggtctgttattgtgcacgttttaaactgacaggcagattacatcaaggaaaattccgagcctgaaggtcaatctgcaactataaagctcctgagttctctatctctctgctttcttttctgcctgctttaagtctgttgttacttttctactgagataaaatccactgtttgcacctaaccgtttctttttgttattgtttttgcaaaccaatgagttgttattaatatcgcatggctagagttctgaagtaaatgctctaggatatttgtttatatgagtgtgtatgtgtgtgtgtttacgtgtatgtagatgtatttggttatatgttttctgccacaaggtaccaaatttggcttaaagagtactcataaattaaataataagcccaaatgcttttcaagctcacatgacttaagtagagtttttactaagctagctttaaaattattggtagagtaatattacaaatatcttcagaaatgtcagtatacatttttgtttgcatttattgatcaagagatttcatacttatccctgccaaatattataaggtgtcaaaatttgtcataaagcttattttattttattttttgagcggagtctgcctctgtcgcccaggctggagtgcagtggtgcgatctgggctcactgcaagttccgcctccggggttcacgccattctactgcctcagcctcccaagtagctgggactacagatgcccagctgatttttttgtacttttagtagagacggggtttcaccgtgttagccaggatggtctcgatctcctgacctcgtgatccgcccatctcggcctcccaaaatggtgggattacaggcctgagccaccgtgcccagctgtcataaaggttattaaacaataaacccagcccaaaacagaatgatctttgcttgtgtaatctttcacaaaaaagacattattattggtttaatgaagacagctaaatcctgaattatttggtaaaataaccatgtattcaatcttaagattctaactcagataaatgcctgaaattcacaagctataaaatggttgacaggaaaataactttggtgactgttgcagttttcataaataatctaggtaaactattaaaataaaataattaggtaaatgtgatgggataaatacttgtagataaacttgccatcatttagaatctaaagttaaataataggtatttcattaaatgggtgttttctaatgaaaaaatatgtattgtaggaaaacattttttctaaaaaatgtgtgtgttcttgttaaagggtgagtaatttttgtctaattcaaaggttatttaaaggttatgtataaaacaaggtaaaaagaaccgggaaataagagatatgtaaagaaaggtatagaaatgaagtatttttggtaagaaagcttaaaaataattttatatgataaagaatcttatatggtaattttttgtcccagaataaaatgattgtttatttaagaaagagggaaggtcaggacaaaccagaaagtccaagcatatcatgaatggtctggccacagctcagttcctccttttaagaaaaaaaaaatatgggatcaaatcttatatgatcggtgggtctcagcagctcgggtggcgggaggagtggcagcggccaggcagcccagtttcgcgaaggctctcggcgcgccgcagcccgcaggcacccggcacacaccctccctgccaccaggatgcccaagaggaaggtcagctccaccaaaggggccgccaaggaagagcccaa

SEQ ID NO: 17861 - DNA, 42132 bp, Homo sapiens
ggttctagggcagagggtggagaagcagggcgctggggctcactgcagacagacaactaaaagactggctctgctatcctggcaaagggcctagaaccatttgaaaactcctgattagataattgggtagcagccttccaactctgagcatccattgtttagtaacttgacttaggcctcagtttactgagttgggctttgaaatatttttccttttgtttccaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaagtatggcctcatttattcagtccttgaccctgtgatatcaggttgttctgtccctgctatttgtgggatccagagctagggtgaaaacgaagttttgcatatcatgtttaaatattaaaaacagctaacatgctgttaaaatatgacttatgctccaacattaacacatacaactttgcaaccacctagaaggtcagaacctgaaaatttaaaattctcagactccttagaataccacaccagaattcccatctttgcctctgtctctcacagtaggagcctcatgggcatacttgtggacattgtaggctttgtatccaagcttcatctgcactctaccctctaccctcaacctccaacacacaaacccacccacacacacatacacctgcctctgggctatgcatgtgcacaccggcgttgtggtccactctcagtaaagatgggcccagggaaaagtcatgtgcaggctctgagagagcgcacaggctcttctggctatttgggtagaaatgctggatgtctggatcatgatttagaagaggaagtatgtgagctttaggtgaatgtgctcctagcctggcagtctccttaccttgtggggaggggtgcaactggaagagggcccaagtgggaccctccaaaggagggtcagcaaactacggcccatggatcaaagctagcccactgcctgtttttgtaaataaaattttattggaagacagccacactcagttttttttacatattgtctgtggctactttctcccaacaatggcagagttgagaagtatgacagagatggtatggcctgcaaagcctaaactatttactctctggccctttacagaaaagtttgccaaccccttttctaaagcacggtgctcacagcaccaggtctaagactgattccggtgtcagactccttaattttaggatgaactgttttcccccattttcccaatttcttccaatcttttccgtctagaaaagccacttttatcctgacctttgaacaacagtttcatgcacatatttaattctcatggcttgtgaagttagtgataataaacccaattttcagatgagctaactggggcatcattgtaagggtacatgtctgataagtggtggcaactagactgaatccaagaaggcggctgcaccagaatgtccgtggaggagggcattagaggtggctacacgatcaaagcagcataaggtgggaatactaggagacttttttcaaaactgctttgaatatcctattatgatggaaaaccccagacgtacataccaaagaatgggaatggcaagcactgacagatactaggggaagttagtccccaaggtccccttgaatgctgctccagtgctcagatcttcttactacaaggtagaaattgcttgggcacctctctggctttctaactctggctttctaactttgcttcctatggtaattgaattctcaagaagcagaagatcagagtaattaagaacatagtctggagccagatctcctgggttcacacacagtggctttgttaccaacctagtggctatgtgaccttgggcatgttatttatcttttatgtgcccccagctttctcatttttaaggtggggataataacaatatctacctctcagggatatgataatggttaggtaagttaatatttgtaaggcatttgggcaaatgcccgacacatcacaaatactatttgtgtttgttattatttccattaaaaggaaaacattagataaaacaaatccaacagagtttatttgagcaaagaatgattcaatgaattcggcaacactcagaaccagaagaggttcagagagctgtcctctgcaatatggagaatgagtatttatagacagaagagaaagtagagaaatagtctaattggtcacagccaggagtttgccttatttaaacatggtctgatcagttggctgcctctgattggctgagatctggttactgttacaaaaaaatatacttctaagttaggtttcagtttatgtacatactacattaggttctagatcattaggagggactcaaactacagagataacctcaggccaaagttaatttaacacttccattatccagctgctgtaacgggcacaagagagagtatgggcagctgcccaacacattaaccttggccttgcatggagcctaagagcccattaaaggtctatgtcttgggctctaagccgtgaactcatggagccctctctcatgcttactgtgaggatagaaccatttgttttgcaaacatccaggagaagattaaggaaatcaaggccccttgtttggctggggttggggatggattctggtcatcctttcctctcctctcctctcctctccgctactttcctttcctctcccctacacccctacccactacaacccctttgaggagatctttgtaggctaagagtcttatgccaaggaggaaccatatcttagacttgctcaggggcagtatgggtgagagtcaggaggtcgtaagaacccaggccccagttggtctccgcttggattacagctctgctacttctcggtgtgatctttggcagtttgcttagtctcctgtccctcagttttcctaatacgtagaacagatgacagtaatagcatcttcctgaagggatagttttgaataaacgaattaatacatatgaagcttttagcacatcgtaagtgctgaatgaatgttcgctattattgtgttcaacactgctccagttctagttagtcaatgcctccagtttttgacattcttctagtgttcagacagaagctaaacagtcaaaagcctgggaaggatggggacagattttaggtaataaatagctttggaaatgccatcagctctgcacaaccatacacatgtactaaagttggtaggacccatttctgttttctttgtgaatctaatttgcctttaaacggatccggcctcaaagatcccaatggtctgagtagcatctcccagaaaaatcttgaaaatgtacctggcagatctcttaagaaggaggtatcttggcatatactgggagtggagccagcagcaagactctctcctagatgggatttcatttaagttaggctatgtcgatgcctcggggctaatgtcaataccaaaggtttttttaaaaaggcctgccttggaggacagcagatcacatctttggtactttcgttgtcttctggggcagagggaccctcagaaatggtctagaaacctatgatgtggcatcatggtgggcttcctgtaggtggcatccctttatgtatgggtagtaagactggggaaggagtggaaggaggtgggtcctaaaatattgtgattttcaaagccttgatccctgggcatttttgcagctgtcttttctctgatatacattgttcccgggatctgtcccagggcttgctgcctctcctttctgagtcaaagcataattagaaatgtctgtcccaggtgaattttctctgtcctctgtaaaccagacaacatttgaataaacagaaacaaccttggaaaatgatgctttctcatgccaaacttgatagaactcacaaacttcttgtagccactacccaaatctattgctataatagaatcaaggtattagggcctgggcagggataaacccacccaggatggtttatccaggaatgcggtcaaatggttatttgatgtcctttgtccatactcctctgctagcatccatctggtctctttggacacatgggacctactctgaccccaaatgactttggactctaggtcagcctcatacgtgtgccaaatatgccattttcctcaaagaactttcagtcaacagccttttaaagctgccttcccatgtgtccctgggttggttacccaagatggaaaacacagataagattcagagagctaaggggagccgtatgccacccctatccctttattcctgatctcccatcatgcctgctgaagggggtcaggtgcaggatgagagggcctgcatgctccctataaaagctgttgagtaccccactcagacctggaacttgcatttaggacttcccagaaaaatgggcaagctgctgattcttgctgatgagtctttcccaggcaggctgagtttagctttcagagcagctgcctgttctcctcagttcacttgctgtctcctcccctatcctatgttccaaaggcctgcactctgtccttcctccgtctcttgcagccttcttgagttcataacatggtggggaagtaaggaagagttcactgagcaccttagggcttcatactggagggaaagtggataactctggcagaccaggacaaggccatttccaccacgtgaaataatagaagacttaggccagcccccaccccaacccctttccagtgttctgtgattcccgctcagtgccagccacagagcaggagcccaagacactcacttaatcaaagattaaccaactaccaggagcaattagtagaaaaatgaataagacagatgtttctctgaatgtagaactctgggagcaggtgcataggagggggtttgggagagaggaagaaaaggcctcaaagagttaatgcagctcccccatggctaacttgtttcccagagagagtgaccaaactgtagaaagaagcccaataagggtgatcactgggatggcacaacagcacatccagggtgtggttgggtggcttggaaaaggatacaatttaaaaacttcatctgagttgaaaagcagagtgtagttgttcctggaaaagatgagttgtagctctagggtgaagagactgctatgggaaggggccctctgcctgaaatctccctttcttcaccttctatgcctcctgtgcccctccccaccaatctggcttatctttagggtccattcattcaacacatattgatagagagctgactgtgtgctgggtagtggggactcagccgtgtcagcacagtctttgccctcacagagctcacagtctgatgggcagaccaataaacaatcatctttcagtgtggtaagggctgtgatggggataagcacagatgtcaaaggggcctagagggacagcagggagttccagtcccaaggtcacctctcttgggaagtcttccctgacctctgtgtctcaattttatcacttgtcatatggcattgcacctatgtgcttacaggtgtgactttccaccaggctgtgagctccttgaggggagggaccctgcctatgtagttttttgatctctaccacccagtaattaatataggtttattgaaagaataacaacacatcctcctggctcctgagtcacacaccatcacctgagcttccgggtagccaagtgaatgcctacattagccacctgctccaaatatgtcatacactagcctatgttgggaaagggtttatagagcagagggggcgtcaagccccatctccctttccccatttactggccatggctgccataggcttgccccttcccagccagagacaggatgaccctggcaccctctgaccaagayctttttgtctttaggtctggccctcctgctgcagctgggtaagtatcccatgagagggttccccaaaagataccaacagcagaatgtttagcctttgaatgctgtccacagtcactctcatgccgtgcttcattggtagagccttcagcrtccttctccccaggagaggcaggttgctgtcatttttctggattcttttctccaagaaattcaactccccagcatcctattctgtgtgtcacaggaggtgccatccacaaaggattctctgtgaatagtatcccctgaagtttgccatgttgctgtacagccccacaacaacctatcaactagctgccaatttaacctaaagtttaacctaaaattgcaccagctaaatgcttagcatatttattgggtaactactgtgtgcaaggtgcttttcatttattattttatatacccacacattaaatgcaatgaagtgggcatattaaaaccatgttaaggttgaggcaactgagtcatagggaggttaaaagctttccctagcccacagaacccaggaaggccagatcaccttatcagctaagttgatgcttttgtcccatcaggaatccaatgggtaggttttatagtcragctcacaggaccatggtataaaggacttaggtgtgagtcctggctctgccaccttacgagttggatgatckcggtcaagttgcttcatctctctgaataccacttaaaggtcaaatgatattaacagcttctgccttgtggggttataagarttaaagaagcaatgcgtgtaaagtacctggcatttagcaggcactcagtaaatggtagacgcttccactgccggtgttccttgctctctcctagactcagacttccagctttctggcctygtgtatcccggaagctccagccaatctactttctgtgctgaggggttgatatctggctccctcatcctccccaggatgccctgtcttttcttccctgaagttcccttctgcaccagggtccatcagcccactggcagagatgggagcaagaacctactcaatgagttatttatagcgtgccctggaggactcatggcacaagggccccttgatcctacagagagctctgttcccaacacaaaggccttgtgtggaatgtgagggtggagggaccgactggcaaatgacagctcgtttcaagtggaatttctttacactagtatctttttatctccagcaacacagaactgaaaacctcgctgtctattggtggctggaactttggatcccagggataagacctagcattcaggattgaatcatttccagattaatcagtctcttccaagctccaaggactgtaagtttctctraagtgagtgaaccccgggcctcagaccccagtgtagacatcccagaactcttctctgaccaggtctccctgaagtctgctcttccttcatcatagctcttaccacactatttttttaaattggacatttcatgattttttgttatattatttttaacttagttttttaattgacatacaataactgtacatatttatgggatacatagtgatgtttcaatatgtataatgtagagtgatcagatcagggtaattagcatattcatcatctcaaacatttgtcatttttttgtgttgacaacatttaatatcctctttttagccctttgaaactatacattattgttaactatatagtcatcctataccacactgtattttaagttccatttacttatctataccttcctctatatgagctcctccagggcagaaactattttattcaccactctatcccagcaatgttaataaatgacagaataactgaatgacagtaaatgacaatagatgacagaataactgaatgtatgtccaggcaaatagtaaggcggataagtggcaagacagagtattcaggagcttaggctactgtgatttaggctacaatgacttattgactccagattctctgatgtggcggccactgctgagaaccgccagaccttcatgcagtcagccatacagtttctgaggaagtacaacttcgatgggctggacattgattgggagtatccaggcaatcgtggcagcccagctgacacccagcagctcttcaccatcctgttgaaggtgtctcaccctcactgtgtccaaagaatacatgatctggcccacagcgggctgggagttctggagaggggttctgagagaggctgaatatatgctggccaggggtgtggatctcaccctttctggctcacagcctcatctctttagtgtaagagcagatctctcttttggggaaaactccgactggcagtgagaagtatatctttgagcaccaatgttagcttcgatgctcttatttccccttcttccattttttctgatgattagatgcaatcacatatacagtttgcagtgctggaggccatttttgtctctttaatacaatctccctccttttaaaataaaattctactctggacattatttgtttattttaaaatttaactttcagaggatgaccgaatttccctcatttccaagttttcggaagasagcttactgttatccccagataccaacaacagcttttggatcaaaggactctaaaccgagcacgttgcagctttcttcataagagctgtgacctcgtcacatgcccacttgtccctctagcctgtgttcagtgtcttctgtttcacaggaaatgtatgaggcttttgagcaagagtctacccgcagcaaaaagcccagattgttgatgtctgctgctgtgtcagctggcaaaggtaccattgagactgcctgccagatccctgagatgtcgaggtaagcaaacccaggagctcatattcagagctaagtgacccttagaccttccccgggcattgtcaaatgcccagataccagtgaccaatgctcaggtacccaggatagagaggactctatctcagaggaatgaaatgacctcaattcctgaggaagaggcagagggagacagtatgaatgctggccttgtttctaagtctatctccaaggttctctagggcaaacggccatttggagaaggttaattgagtctcaagcttctacaagtcctgaaggtctgagtgtaaccagatagtgatcatggaatgggtgccttttatattccaggtgctcttgagatgaaggtgagggagaatggaataaagaataacaatgcataagggaaactttattgcatagtggcaaacagcagatttggctgtttgtcaaatctgcaatcagccgatttgggactaggagtgttaggggtagtgggttagaaagaatgatttcccttgggtcatttatttcctcttgctctctctcccagctacctaaggtacatggacctcatcagtctgatgacctatgacctaaggggctcctgggagggcttcataggcgaggacacccccacttgcaggacctaatgaccagggagactacaaatacttttatatggtgagtgaggaagccagtcctaacagacatcttcaaagcctgtcastggatcccctgccccagactgcaaaggagaccaagaaacttgatggacagctcatgttctctacctccctgtccctgtgactgattgtatccattcatctttcacaaaaaaggaagcagaatagtggcttgggataatcycaaacattggggaattttaaaaaatatattttccatttatgctaggagcacatctcatgatccatcttcttcccactcttccttccctcccttccacyctctttcttcctaatttatgtggtttaggmagctgtaatagttagtctgcctaatgattagtaggtgagtaaatgggctagatgtcatttcagtggagatttcaaccagggatttaaaaattgacatgggaaaatctcccagtcgatgctccatgcacgaacaattctcagcattgtagtaagcccatttggaagacaagtggatgcatggctgaacaccagtcatgccccaratgaactccagtatgaggaaaaagaggatctctggctaacactgggccctgctactaaarcaatgaacctctcttaayaccyrttctagaaggggcagcactcctttcctttcaatgagattggactgtggaaggggtttgactggatgctgtacctggagatactagggaattaggcagaaaacctggctgttccaaggcctctgggtacatactcagctgctttctcatgatatcttcctcatcttgcctccaggattaggcaatgaactactggaagagccaaggtgcctctgctgagaagctgatggtgggctttggggcttatgctcacaccttcactctcagtaatcctgccaatcatggcctggatgctcccacttctggccctgggacttctgggccctatacacaggaggctggaacccttgcctactttgaggtaatgtcctcagagggcctagaggacccactctctctgttctcaaggttgaagataagtcaatggagagagtctacrctctgatttccagtagagggtaccctgttgctgactgctctgaatatatgtggcagtgagagraaggaagagtgaaagattgataaaacatcttaaatgttaaccttttaaagtaaacwtgcatctttaatattagaactagctaatgcttactgagtgcaaatggagagccaggttgtgctccaagtgacttttatatatcatctcatttaacaaacaataaggtactgcattctccccatcttattcaagaggtgactgaggcacagagaggttaagtaatttgctcaaggtcacagaattagtaagtggcagagctgggattcaaacttaagttgtccagctccagaatctcagaccttacccattatgctatactgtcctcttattagctgttttgagacacaactctttcaaacggaamaaattcatttcaaaaggaaaccaggacacaaggcataargaagctgcttgttcattgttgcacatgaggttattggcagacaaaggactgaattcatgtctcatctctctagctagagcactccactgtcccatgggacaaaagcagggcagggagctgggtgacactggaaccagkttctattatttccagcaaaggggaatgggctgggatgaggatcttagaaaagaaatggagggaggacagagaattggcytgagtacagcagggccaatctgagttatgactgctccttctgtacctgccccagttctactccttcccgaaaggagccacctaggtgtggaatgccccctgggaggtgccttatgtctacaaggggaaccagtggatcaggtacgacarctccaagagcttcaccctcaaggtaaggccctccacactcttcctaatgcatggttggggagagttgggggacctaccctccagttgcccttgaattgcaatcccaggagacccctgagggaggtgaggagagacacagagaggttgtgaagtttcagggtgagccagtgacccagccacggagcctgacagttggagcaaccccttcacctccttttccttcctttccttgactcctgcactttctccttcttcccacccctggagactctcctttggccccctcccctgctcttctctggtcctcatgcagctctttgattcatgcttcctgcttcttgatacaggtgttsttccccactccaaagacaaagtgtagaccacagagttttttgctctcctttgcctatctcctgcccatggcaaattcacacaggctgagcccaaatcgggaggcgatagagcctctggtctgtgaggttatgctcaggtctggggaggacataattgctgtttatcaatcccagggcccttcaccctacaccttccatctagagccctctcactttgcccaggtactttgctttgtgaagggccctatatctctatagcactcaacccacccaaactccagctctgaggtgccttctcagaaggtggttggtgataacaaagggcagggggtaagagctgcttggggccaagactcattctctgtgacttagtcctacagtcctgtacatacaaatatgttcatgaattcctcaaagttgcctcctcaaaacccacccccagtctctcctctccatgactagatcatggtcctcctgccatcctgctggagttactccctgcatttgtgcaaggacagcccagaatccccctggttctcttcctctggtttagtggctcctaaagaacagatttggaggggccattgtctgggccattgacctggataatttcacaggcactttctgtggatgaggcaaataccctctcatgaatgcactcaaatccgcgcttggtgtctccgcacccagtaagtagtgatgacctaacagccatgagataacaaactagacatggttaagaggaagagaagaccagagctcctcccagtctcacctcaaacaaggcctcctccagatcttccagctgtcttagtgtgtccagttggaacttgcatttaggacccagaaagcaagacccagtggacttactaaagggcaggccatgagtgagagccctggcaagtaaaaggggacctatcaatattctggaggattctcctctgtagagctactcagggaagcttctataaagtaaactgaacatgctggagcctgggtagggaaggggacaaaaacaccgtattccctgtcactgctgctcggctccagcttttatgaactttgtgggtcagaggaaaaaaaaagcaagggagggattaaaaacttagaagatgaggaaaggaatgagagaaggagaactctaaaggggctcagctagcatctttcctgaagtggggagcagagctacagatggtctcaacacatgattctatcccagccccgagaacagggcaagtccaggaagaaagaggggctgggaagctgcggaaaaagctagtgctaatgattggatctttattccgtgtcaagcctgctggttcttttagatttcgtataattctcataggcactcttggtgccagstgtattagtttacttacaaataaaagctaataattatgtggtactcactatgttatatagcgtgcacattggaaaatgctttacctaataattctaagagataatacaattatgccatcatttcagagaggaaattgaggctcagagaagtgttaatgaatttctcatggtcacatagctcatggcagagctgggctatgaacttgggtatcctcgattcaggctcagagcattaaaccactggtttaggtaggatgtgtactgagagaaacccacagtgaccttacagacatgacactcatcctgggaaaggagtcctctcctgagcttatggggaccattttccttctctcttcagattgcagagtacccacctctatcctgggcaccagcttggcccccatcatcactgcagcacctgggggtggcagcacaggtggcagtggattctgtactgggaagtccaaaggtctgtatcctagtcccaccagcaagcatgctttctacaactgtgtggatgagcacacatacgaggaggcttgtcaggaaggcctggtctttgataccagctgctcttgctgtaactgggcataagctattcacctgctgggtcccttggagattgtaagactaaaggatgattaaagggaagttttgcatgtgaatgccaagttgtctgttttgatttataaatctgtgtgatactatcctgcaagtaaaagacaacctactgccaccccctaatcctcgttgtccacaagctcccaggagatgcccaaacattgaggctgagagagaaggaggaacaggtacctgggacctctctgagcatctctatgggaagttctggcactctggcccctcctgaagcaggacgagagaggaaataggctctaaggaacaagagaaaataaagcctcattctttctcacaaatatgccttcaaagggtcttgcggaaggacccagaagagtggctggacttggaacacttaatttacggcatccaccctctttaggaactcttcacgaagtttactcatttcccaactccatggcaaacaaccctaagaaagcctgtgttttaaagacaaagcatgatgggctaaccacaggctagtttacacacacctcttccacacctatgaggttaggaaaaaagaccatcgccgatgatttcaagattacttcatttccaaaacaaattcatttattatcattttattgccacaccatgctgcaacgtaccctttgattcccttagggaaggcaataagaaagctagaagaaaaaccacattacagcaggagtcagaggtcctctttctcctaccacctccagagcctggccttggctttttccccagttaccatgctgcagaaggcaggaaaaatgcagctcaccaagcaagggagacacctctttgtccagccaccttaacttgtttattggtggatagggagggagtctgtggattatacgcttttgacaaaactgtcataatcagtcataagcagaatccccagaagtttattttgtccctcccatctggctagctggagtataagcaggatgtctatacatctctgtttgctcgggaaagtcctggttaactattgttccagtgtccaattcatttagcaattgtgtgggtttaaaatttttattataaagtatttttattactattgtattgaagttatatgacatgaatttatacacytccactttatactactttttgccgtgtttcataaacagagttctttaatatgtggttaaatctgaacatttaccagagataacccctctcctttcctggcccttttctgacaaaacaaattacagccccctttcaatgactacttgctgggtgcttgctaataaactgatgtgcactaggacggaagtagctagagatagctatcacctctggtctccaggactggtgagggactgctgctcctgccaacccctttgtggaccagccagttgtgccatggcctgtgagatgcataaagccatcaggccacatgtcagtaggatgagtgggtaattataggttaagagtatgtggaatataaacagggaaatattaatagaaactaagaagacattccactgagtttgtagagagtagtctgaatgctcttcctacaagggctttatcatctattgtgtagtataaatctacaaccacttatttattttattgtttggtaacactttttattttgcaaataaatgcttttgtcagcaatgagctttaaaatttcaaatgtctagataataaaaaattaagtaatgaatttccattttccaagaaagttgatggtgaatgtataacttatgtacaacttgcataagatgttggttgacatttaccaaccaccatggggttgtttgatatagcatgaaaaccaaaagacatgaatctgctgaacaagcatcagcatctacttcaaagaaatcattattttaagaggattttgcctaaagatgatgatttcacaaaagtagttgccaaaggtattatttatatcactaggtgccatggtctgaacgtttgtgtccctagccaaattcattgaaatcctaacccccaggtgatagtattgggaaatgaggcctatgggaggtgcttagaattagrgaccttataaagagaacccagagaactagcaaacctcttccaccatgtaaggacacagctagaagcttttatgtataaaccagaaagtgggtcctcaccagacactgaatctgcccacttcttcatcttggattcctaacctccagaactggggaaaataaatgtctgttgtttataagctacccagtttattgtattttgttacagcagcctgagtggactaagacactaartgaaacataaattttcatttaggtagatcaagtgactgatgcttcaaattaacttttctctttttctattccaagttttatatctgtgtgtgtgcatatataaaagtgaagttctatttgcagaacaactttccaagcttttaaataataccaagttaatatcaatgtcatcagatatttcaaatagaaaatcagataagatagttattcaaataatgatgggatagttggatttttttttcacacagcttatgaaataaaaataaagctttttggtagttcatttcgttaaaggagagacattggatgttatcataaatgctattttaaattcagttaaatagttcaacactaaaattaattattttgtagtgatatgaattcaaatattgatggaacataacattatgtaaaaacagtattccttctaaatgtcttagtccatttatgctgctatagcagaatactgcaaattgggtaatttatagaaaacaaagatttatttctcacatttctggaggctggaaagtctcagatcaaggtgactgtatctggtctctgatgaagaccttcttgctgcatccttatatggcaagaaagcagaagggcaagctagctgaattgctgcgtgaagccactttgaaaagggccttcatcctagttggaaatcatcattctcagcaagctatcacaaggacagaaaaccaaacaccacatgttctcactcacaggtgggaattgaacaatgagatcacttggacacagggcagggaacatcacacactggggcctgtcagggggtggggggctgggggagggatagcattaggagaaacacctaatgtaaatgatgagttgatgggtgcagcaaaccaacatggcacatgtatacctatgtaacaaacctgcacgttgtgcacatgtaccctagaacttaaagtataataataatgataaaaaagggccttcatcctattcatgagggaggagcccatatggcctaatcacctcttaaataccccacctcttaatgctatcacattggcaacagctgaattttggaaaggacacattcgaaccatagcagcatgaaacatctgacatcattgtaaaagctattgtagattcagtttagaagttcagcattgaaaatcaattatttttatggtgataatatgaattcaaatattgatggaagcataacattatgaaaagcaataaagtgtattttcttctaaattaaaacaatatagggcagaagtgttctaaaaattggytgcaggctataaatcactctatatgtccccaaaactgatattttaycattcaaaataaaaattgtcaaatttttaggtatttttatatacatagagtaactgatctataaaattttattaacaacactgatactgaatacaagacaacacacatcacggcactatgtgctttctctccttgctgcctattgtcaataggattttagaaatgtttgagtcatggaagaattactttttaattaatttgaagtgtcccacgatagtattgaacttttttggtacacaagtcttctaagtttggttgcattttattcaaaattattataaatttttcttctttaatttctgtaggcacatagtagctgtatatatttaggggtacatgaaatattctgttacacgcatataatcataataatcatctcagggtaaatgggtgtctatcaactcaagcatttatcctttgtgttacaaaaattcaattatactctttaagttatctttaaatgtacaattaaactattattgactatagtcaccctgttttgctatcaaatactagatcttgttcattctttctatttttttgtacccattaactatccccacttctccctcacccacccactatcctttccagggtctggtaaccatcattctactctctatctccatgagttcaattgtcttaatttttagctcccaaaataagtgagaacatgtaaagtttgtctttctgtgtctggcttatttcacgcaacataatgaccttcagttccatccacattgtcgcaaatgacaggatctaattattttttatggctgaatagtgctctgttgtgtatatgcaccacattttctttatccatgcatctgttgaaagacccttaggttgattccaaatytgggctattgtgaatagtggtgcaataaacataggggtgaagatatttctttgatatatggatttcctttcttttgggtatatactagcagtgagtttgctagatcatatggcggctttatttttagctttttgaggaaactccaaattgttatccatattggttgtactaatttacattcccacaaacagtgwatgagcatcctcttttatccaaatatgtgccagcatttgttcttgcctgtcttttaggtgaaagccattttaattggggtgagattatatcttattgtagttttgatttgtatttctctgatgattgattatgttgagcacctttyatacacgagtttgccatttttatgtcttcttttgaatttctgtcttttgctcattttaattgaattattagtaaaagacttatttcctatagagttgtttgagcttcttctatatatatatgccagatggatagtttgcaaatattttctcccattctgtgagttgtctcttcactttgttaagtgtttttgtttttttttttttgctatgcraaaactttttacctggatatgatcccatttgtccatttttgctttggttgcctgtgcttttggggtattactcaagaaatctttgctcagtccaatgtcctacagagtttctaaatgttttattttagtagtttcatagtttgagttcttagatttaagtctttaatccattttatttgatttttgtatatggtgactgataggggtctagtttcattcttctgcatatagatayccagttttcccagcacaatttattgaagtgactgttctttccccartgtatgttcttggtgtctttgtcaaaaaggaactcactgtagatgtacggatatgtttctgggttmgatattgtattccattggtctatgtgtcagcatgccagtatcatgctgttttggttactatagctctgtagtataatttgaaatcagataatgtgattcctccagttttgttatttttgctcaggatagctttggctattctmagtctttcgtgcttacacataaattttagcattttttttctatttctgtgaatatgtctttggtattttgatagggattgcatttaatctataaattgcttggggtagtatggacattttgaacaacattgattcttccaaatccaggaacatgaaatatctttccatttcttatctcctcttcaatttcttgcatcaatgttctacaattgtcattgtagagatgtttctcttttggggttaagtttattcctacatattttattttatttatggctactgaaaatgaggttactttctttatttcattttcatattgtttgctgttagcatattaaaatgctacagatttgttatgttgattttgaattctgcaactttactgaatttgtttcagttttaatagtttttggtggagtatttaggtttttccaaatataagattatatcatctgtgaagaagaatagtttaacttcttccttcccaattttgatgccctttatttctttcttttgtcttattgctctagctaggatttccagtactaggttgaataacagtggtgcaagtgggcatccttgtcatgtcccagatcttagaagaaaggctttcagttttccccattcartgtgatactagctgtgggtctgttgtatgtgacttatatcatgttgaggtctatttattttatatccagttatttagtgtttttttaatcatgaatggatgttgaattttatcaaatgctctttcagcatcagttgaaattatcatatggatgatcacattgatgaatttgtatatgtcaaactatccttgcatctctgagacaaatcccacttggttataatgatctttttaatgtatttttgaattcaatttgccattgttttgttgaggatttttgaatcaatgttcatcagggatattgacttgcagttttctttttttgatgtgtctgtctggttttgttattagggtaatactagcttcatagaataagtttggaattattccctcctcctctgttgctcagaatagttgaataggattattattagttcctctttaaatgtttggtaaaattcagcagtgaagttgatatcatttggatctgtgtccctgcctaaatctcatgtcaaatcttaatccccagtcttggaggtggtggttggtgattggatcacgggagctgatttttctcttggtgctgttctcatgataatgagtgagttcttgagagagctgggcaactccccatcactttctcttggtctggccatgtgatgtgctggctcctcctttgccttccaccatgattgtaagtttcctggggcctcttcagatgccagcctcatgctttctgtacagcctgtggaatcatgagcaaattaaaccttttttctttataaattacccagtcttaggtatttcttcatagcaatgtgagaactgactaatacagaagccactgagtcctgggcttttccctgctgggagacttttattacagcctcaatctcagtacttcttattggtctgctcagggctttggatttctttatggtttccctctgtaggttgtatgtgtttagaaatttatccatttcttctaggttttccaatttattgacatatagttgctcaaagtagactcatgatgctttgaatttctgtggtrtttgttgcaatgccttygtttgcatctctgattttatttatttttgtctctttttcttagtctggctaaaagtttgtcagttttgtttatcttctcaaaaaaacaactttttattgtttcactgatgttttgtattttttgtttcaattccatttactttagctctaatctttattacttttttttgcttcaactaattttgggtttggctttctcttccttttctaattctttaagatgcattgtgaggttgtttatttgaagtttttctactttttaaatgtagrcacttccatattagtattgctttcactctatcctacaggttttggtatgttgtgtttccattatcatttgtttcaagaaattttctaatctccttcttaatttcttcattgacctaatgttcattcaggagcatatttttaaatttttatgtgtttatatagtttccaaaattcctcttgtcatttatttctagttttattccattgtgctcagagacgatacttgatattatttcaattcttttgaatgttttaagacttgtgtcctaccatatgctctacccttgagaatgatccatgtgcagaggagaagaatgtgtattctgtagctgctgaatggaatgttctataaatgtttattaggtccatttggtccataggacagattaagtccaatgtttctttgttgatttccaatactgaaagtggggtgttgaagtcttcagctgtcattgtattggggtctacctctctctttagctctaagaatatttgcttttcatatctgggtgctccaatgttggatgcatgtatatttattattgttatagcctcttgctgaattgacccctttatcattatgtaacaactttctttgtctcttcttatagattttgtcttgaaatatattttgtctgatacaagtatagctactcttactctttttttggtttctatttccttgggatatctttttccatctgtttattttcagtctatgtatatctttatatgtgaagtgtgtttcttgtaggcaacagataattgagtcttgttttttaatctactcagccattctatgtcttttgatctgaaagtttagtctatttacattgaatgttattattgataagtaaggacttactcttgccattttgttatttattttctggctgttttgtgatctcctcttacttctttccttccttcctgtcttccttttagtgaaggtcattttctcctgtggtatttttaatttcttgctttttatattttgtgtatctgctgtattttttttatttgaggctaccatgaggcttgcaagtaatgtcttaaatctcattattttaaactgataacaacttagcactgattatataaacaaaactaataaataagcaaagggaaaattaacaaaaaccagactttaacttcatcttcctgctttttaactttttcttgtttctatatctgtgttattgtactgtctgtctagaaaagttgtcgttattgtttttgaaatgttcatcttttagtctttctactcgagatattagtagtttatataccacaattacagtgttatactattttgtgtttttctgtgtacttaatattaycattgagttttgtgctttcagataattccttgttttttttaatgccctcttctttcagattgaagaactccctttagcttttcttgtaggacaatwctggtgctgataaaattcctcagcttttatttatgtgagaaagtcttcatttctccttcatatttaaaggattttttgctggatatactattctaggataaaagtgtttttttttttccttcagcacattaaagatatcatgctactttctcttgacctattaggtttccgttgaaaagtctgctgccagatatatcagagcgcctttgtatgttacttgtttctttcctcttgctgttttaggatcctttctttacccttgatctttgggagtttgattattcaatgtcttgagatagtcttctttgggttaaatctgtgtggtgttctatagccttcttgtacttgaatattgctatctttcactaggtttgggaagttctctgttattgtccctttgaataaactttctatgcattaatatacatttctctccacctcctctttaaggccagtaactcttagatttgcccttttgtagctattttctagctctcttgtaggcatggttcattctttcttgttttttgtttgtttgttttgttttcttaatctccactgactgtgtattttcaaatagcttgtcttcaagctcactacttctttcttctgcttgatcagttctgctattaagggaatctgatccattcttccgtatgtcwactgcattgttcaactccagaatttctgcttgattctttttagttacttcaatttcttcactaaatttatctgataggattctgcattccttctctgtgttatgttgatttttttttaatttcctcaaaacagctattttgaattctctgtatgaaagatcacaaatctctgtttctttgggattggccccttgttccttatttagtgttcatgtttttggtgaggttatgtttccctggatgatcttgttgcttgtggatatttgtcagtatctgggcattgaagagttaggtgttgattgtagtcttggcagtctgggctatttcccacccatccttcttgggagggctttccaggtatttgaggggatttgagtgttgtgatctaagtttttgttcactgatgtcacatctgcattggtgggcatcccacacctagtaaagctgtggttcttgtagacttgtagaggtatcatcttgttggtcttggataagatccaaaagaatttcctagattaccaagcagagattattttctcttcccttactttctctcaaacaaacaaagtctctctctctgtgctgagctgcctggagttgcaggagggggtgacacaagcacccctgtggccaccaccgctgggactgtgctgggtcagacctgaagtcagcacagcactgggtatcacccaaggcccatcattaccactacctggctactgcctatgttcactcaaggccctagagctctgcaatcatcaggcagcaaggccagccaggctgtgttcttcccttcagggtggtgagttctcttgagctctgctgtctggtagccagagcctggagtcagaaatcttagaaatctacctgatgctctgttctgctgtagtttaactgacacccaagccacaagacaaatccttccctctcttccccttttcatgggcagaggagtctctccccatggccaccatcaccactggcttattgggaatactgccaggcttccactgatgttcacttaaggccctagggctcttcagtcagcttgtgatgaatgcttcactctgagattcacccttcagagcagtgggatcctctatggccctggggaggtccagaaatgccatccaagagctaaggcctagaattggtaaccccaagagccttcctggtgctctagcctattgcagctgagctggtacctaacctgcaagacaaagttctgtttattattccctctgattttcttaagcagaaaggccctctttctttgtagccataacagctgggaatgtgctgggacacacctaaattcagcatggccctcagtctcacaaaaggcccacaatgagtacttgcctgggtaccactgccaattatttagggcccaggggctcttcagtcagtgggtaatgaattctcccaggcctgggtccttcccttcaagtcagcaggctcccttctggctcagggtgtgtctagaaatgttatctgggagctagagctggaaagggggtctcagaactctgccttgtgatctcttctactgtggctgagctggtattcaagttgcaagacaaagtcctccttattcttcctcccctctcctcaagcagagaaaaggagtctctttccgagctttgagctgcactgcctagggttaggggaggggtaatgcaagtatacccttagctgccctggctggtgtctcactagatcacatgtcccttaagttcactggctctgagcccagcacagcaccagaacttgcctagaagttgcagtccttgtggcccaaactgcctttccagytttttaggaccccagagaactttagcccatggtggcaaggtttgctgaactgaagctacaatcactggggtgggcgattcccctctggctggggcttgtctaaataaatgtccccttcatgggtgccagctaagttctgtccagtgttggcactaagttccagtgcaaagtcctacaatcactgtgttcttcctccacgtgcacagattccgtctccgcaccatgtagccactgccaggggatgcaggaagggtggtgttggcaattcaagactgtctttcctatcctcttcttgacatgaagataaaacccaatacagtgatcactcacctgattttatggttcttataaaggcatttttttgtttagagagttgttaaatttagtgttcctgcagggaggaaaatcagtggaggcttctgtttggccatcttgctctgccttcatctcaaatgagcagttatacattttttcatcaaagtattcagcaaatgaagctccaagatgctctaaacttaggacattttagtaagttgatattgaacaaagaatgttgcaaatagtgaaactttgaaagaggcaagaacgaatcaaataaggagtgctctaatgctatacaatatacaaattctataattgcaatttataatgtttcaatttttgggaagaatcttttgatggagcaactattttataagatattatttttaatcagatacattttttgctatattagattggaaagaaacttaagagacctatgatcttgcaacatctaaatctggtgagacatttcaaagagtcatagagataacttacttgacaagtttcctcttgtaaagatgtttgttgaagcaaggagctctggacggaggcaaacagagcacctgtgaaacatttgagttgaaatatttcaacattttaatggaaaaaatagaactgagaataccctacatttgacagaacttgctctgagcatctgtagagatattttttctcgattaaagtttttgagttaaaaattttctgatctacaaagacaatcagtagaaggtattatgggctgaattatgtccctccaaaatttatatgttgaagtgtcaacctccactaccacagtgtgactgtatttggagatatggcttttaaagagataagtgaggtaatatgaggtcattttggtggtccttaatccagtacgattggtgtctttataagaagaggatgttaagacacagacacacacctagggaagactttgtgaagacgcgtggagaaggtggttgtctataagccaaggacagacgccttcagaagaaaccaactctaatcatggacttctagccctcagaattgtgaggaaataagtttctgttgtttaagcctctcagtctgaggtacttgttatggcagccctagtaagataaaatgggaggtaccagygtttttaaattgattaaccataaaaattaactttgaagaagattkcaggcaatattatttaaaaatttaattaataaaatcaaattgaaaaaactctattcttcagaaaaatgccagtggcacaatattagaaataaggccaagaaacgaattaaagtttgtgaatatgtagcatgaataattattcagaattctacagttttatttactgtacakatgtttatttttacattttagaaactatatttttggaaatagttttaatagaactattttgtagttatttttaaagaactacttattttgttttataagtccattagtacaataaaacactttttcaatcaaaaataaatatttcaaagatttcataattttaatgccccctttcaccctccagtgtgtctggctttggatgatgaatcacatgaagagactagaattgctgagtggacattccattattcattgaatgttctcataaacaatcagcagaaaaggaaaacccatatgtgcaccaagtgctagcccagccattttgtaaactaatgacaaaaagagaacgtgaatttaatttcttgtgaatctgacatactttgcatatatttcatggccattcaagtggatctggacaagggtttctcgattcccctgtgatgcttgcggtttgcactttagctctttgtatatgtgtctggattatcttcatyttcagaatccccacaccctgatggctccttatcttattgccctggctagtccagggaggaagataggctggagtcatccttggtattctcccagtcttctccccaacctccttcctgccgctttacttatgtaacaacagtactctgagcaagccctgtcctgagcactctgtgaacatgggaatcttcataacgaccctatgcggtagtcatggttcttacatggccactttccaggcgaggaaactgacggagacactaagagatttgaccaaggtcaaatagctcaaaaatgcatttcaaagttggctgtctggctccggcgtccaggatcttagcgcacactctgctgtcctttggcccaaccgcaactcgaggccacctctcattcctgcccaggcgccagcgtttggaccttaggacccagggaaagttgggtggagcaggtcaggtggcaccaccacaagtttcaggattccctctcttcaaagcaccccatccatgacgccgcccctggctgcctggccgcccccgctgcgcccccggccctctctactgatggatggagcatcgcccccaagcggtgacccaccggtgagtcccgggtggcctagggtaaggcggaccgggagccacctcacacccacacagcctgcgggaaggatccgacaaggtgagggtagccccgcgcggggccgcaacagcctattcctcccgtgtgtgacgaccccagccagagagaacccaacctgagtgccagcgagagcctgtccttggtcgctccgacccctcgccaggggatgtccggtaggaatagcactgagctgakgtgacggcgcggaggcgccaaaatctccacttagggcaatgaaaggtcatcggtctccctcttgccggcactgaaggaaccggcgrggtgcgacaaggtggggcggggcaaggaagcggatcttcatccatgtccctggatggagtaaggcacactctggaggtagcagcgagtttgaagtgtctaagaaaaaggccttctgcaattcacaattcktatggctacctgcacctttcatttacccactcaaagctaaaggtagccgacgtttttcaaaaactctggaggggcattcaacattttttaggtggcctgaactgccgaggaaaacaaatgctggccagattccaagtgaaatactgcasaggatcccccaaggcacgaagctggctggagggagctggagggagcgccccacctgccgcgggaaactcacgaggaaagtgcagaccttcggtggcgctggcacccgcgtggccctgattcctaagacgacttggcattggccactagggttctcttctctccagccagtacaggccaccactgtctggtcagggacagaagcggggcagtcaccaccgtctccagatgagcgacaccgggagtctttaaatctcccgactgagaagctctttgtgtccagatcggaggtgggcaagtctgtgrgaccagatgcccagacttgcccattgtcccccacccccaccccaatgacacttgcttctctcttgttctatctctagttcctcactccattactctgttgttttttcaaaaaatcgctatcagagtaatcctttggatgtgaccagttccatcagctgcagcagcatttcacaaaatgtttcaaataaccctagctttttgcaagctagtaacaaactaaacctgttttttgggaaatgctatcctatactcatgctgtgtgtgggccacaaatttggttttatatttctggtagaccagtgaaaaattagaaacaaaattaattacacaatttataatgtgcagaaaatcagagcaaaccaacaaggcaaactattttagattgaaagaccagaaatatacttccctccaggatttttattgccagaacactgcataatccaaggatcaacatcctcacagtaaacacaaaggcctatttttacatatgaatgctccctatagcatcccttaaaagaaagggagggcttaagtccaaaacgcaatcaatctttcaagacgaagatgccaaagcaattgcagcaaaagcaaaaattgacaaatggaatctaagaaaactaaagagcttctgcacagcaaaataaactgtcgacagagtaaacagacaacctacagaatgggagaaaagttttgcaagctatacatctgacaaaggtgtaatatccagcatctataaggaacttaaactaatttacaagaaagaaacacacaaccctrttaaaaaaccattaaaaagtgggtaatggacatgaatagaaatttctcaaaagaagacataacatgcagccaacaatcatatgaaaaaagctcaacatcactgatcattagagaaatgcgaataaaaatcacaatgagataccatctcataccagtcagaatgtctattattaaaaagtcaaaaaatgacagatgttagtgaggttgtggagaataaggaacagttacacactgttggtgggagtgtaaattagtttaatcattgtggaagacagcatggtgattcctaagacctaaagacagaaataatatttgacccagcaatcccattaccaggtattataccccaaggaacataaatcattctcttataaagacacatgcatgcctatgttcattgcagcactactcacaatagcaaagacatggaatcagccaaaatgcccaccaatgttaggctggataaagaaaatgtggtacatatacaccatagaatactatgcagccataaaaaaagaatgagatcggccaggtgcggtggctcatgcctgtaatcccagcactttgggaggccgaggcaggtggatcacgagttcaagagatcgagaccaccctggctaacacagtgaaacctcatctctactaaaaatacaaaaaattagctgggcatggtggcaggcacatgtagtcccagctactggggaggctgaagcaggagaatggcatgaacccaggaggcggagcttgcagtgagctgagatcacgccactgcactccagtctgggcgacagagcgagcctccatctcaaaaaaaaaaaaaaaagaaaaaaaaaagagaatgagatcatgtcctttgcagggacgtggatggagttggaggccattatccttagcaaactaacacatgaatagaaaaccaaatacctactacatattctcacttacaaatgggggctaaatgaygagaacacatggacacatagagggaaacaacacacactgggacctatcagaggctggagagtgggaggtagaggatcaggaaaaataattaatggatactaggtttaatacctgggtgatgaaataatctgtataacaaacccctatgaracatgtttgtctatgtaacaaacctgcacatcttgcatatgtatcccgggacttaaaagttaaaaaaaatgcaatcaatcaaagcaaacctatgggacgcttatataaaaggcaggtttcagctttctactgatctctctagagcgatgttgtacaatatggtagtcaytagtcacaggtggctactgagcacttgaaatgcgaatagtccaaactaagatgtattataagttggaaatgcacgccagattttgaatattttctagaggggaaaaaaagtaaactatctcagtaatttttatattgatcacatgttgaatgatatatattaggtatactagattaaataaaatatattattacattagtttcacttgtttctttttacttttctagatgtggctttttaaaaaatttagagttccatatgtggctcccattatttttctattggacagagctgcaatgtttcttgaactatatactctaagatatcaatatatatactatatatgacaaaagggtttcatagtttaataatttggaaagcactgcctactatattccttcgtcttgtgttctgcagggtaacctgagattttggggaaaaatttttatggattaaatgtatttgggatatgccagttaagaacggaggacttagaactctcaatgtaatgtgaattatgattttctaagagaggcatcttatatacagtatttctccaacacactcaaagaacgcttttcatcataaacacaacccccattaatacaattctgaaggagagtttagggaactggagtagaagataaagctcataggccttactttgcttcatatatctgttgtatggctcaaggcttgcattgtaagtcttttctctagcttttccctcaactaatagctagactagtattttcaccagatactggtgaagtcctcaccccagacgtaatcaatcagacccttggagatcacccttttgtgttagttaagccttgttgtgtaagaaactaccccaaaatataatggtttaaagtggcaacaatttaacacgctactatatggataaaccttgaggacatcatcctgaatgaaataagccagtcatgaaaagacaacagtgtatgattccacttttatgagagatctagactagtcagtataatggaaacagaaagtagaatagtggttgccaggagttggggagtggaggaaaattgggagtcatttgatgggtacggagtttccgttttgcaaaacaaaaaccgaaagagttagttgttagaaaaagtcctagagatctgttacacaacaatatgattatagctaacactactgtacacttaaatatggttgagagtgtacatttttattgtgttttttaaccataatttcagaaaattaaaaataaggtaaaatcaaaacagcaacaatttatttagctcacaattctgtgggccagcagtttgggctgggatgagccaagtacttctggtcttggcggctgggcttactcatgcatttgtggttggctggcagtcaactagtgggctctgcttctgggggttgcctggctgtcagctgaggccattgggagtgactggccacatgtttctcattgtccctcaggctaactctggtcacatgacaataacagctttccaagagtatgagcaaaagcctcatggcctcttcagaactaggtttagaactcacacaatgttactctagctgtgtcctattagtcaaagcaaataacaaggctagcccagattcaaggggtgagctaagcaactcctgatacaaggcgctaaaaagcactgtgactatttttacaattgtccacacttgtcctgcatcccattttctagaataatccattttcttatattttatatgagaaaatttcctgtttcttatattttatatactcagaagcatactactcttttgtgcatcactttcttttactttctcagacactctttcatctcatcagcatatcagaagtattttattctttttagtggtgaatttttgcattatcattttgctgggcttgcctcactcccctgtctctccattatctttgctgtatctcaatgctaaatgctaaatattataaaaacaatcttctctaaaagtgtctccttgactttctccctctgcctctaacaatttccttgggaatcctaaaatccagatgcctggctgtccactccttaggctgggttccttttcacttgctgtagtagttattatgggctaacttgccttgtaatgtttgactcactaggtcataagtttttatttacttatctatctgcaccagtgatggtaagccctgtgtcttgtttacttgtatagccaagcactcacaaggtacctgacacaatataggcattcagtaggtaattattaaataaatgaataaacattaattaataaataggttgatgtaggtgcattcccaaggtgtttactgcaaactacaccatctaactataagatcccctataggggattccctgtaggggatgggaattgcacctcttctctttcttccttctagcttgtgactcatcttttactggaaggataccttcttttaatatctcctacctgatttcccatatgcaaatcaacactctcagctttcatgtgttcacaccatgagtaccatctgccagactctatctctttattagagtatttctcctctatatgtgctttaactgatgagagtgctctagaaacaagagcccctcccccatcattccttcatatgcacttgaaaagaatatgactgtgtaaaagtgtatattgtgtaaatttttgtgtaatgtttatatatgtcaattaggccaaatattaataacatgctcaggtctagacacttactgacttttttctttgttctgttactgtgagaggtattagaagtctcctactatgattgtagactggtcttttctccttttagttctggcaatttttgctttccatattttgtagctatgttcatgagtacatagagattaagagtttttatatctccctgttagattgacacttattgttataaaatgtctttatctctaggaatgcttcttgttttaaaatctactttgtctgatatcaatatagctatacctactttcttttggttagtgattgcatagcatactttttccatccttttattttaatcttgctgtgtcactgtcatatttttcttaaaagtagcatttacttgaatatttttaaaaaagaaaacacatcagtaatctttgactaataaatggagtatttagcccatttatatttaatgtaactactggtatatttctggtatatttaagtaactttcccaaagccacagcatgttagtgggagagtgcacactaggcatttcctgactttcaagtccaggatgctttctcattcattacctcagacttgggttaaaggctgtatttcccaccctcacatctgcttctgccactgctgtaatatttagtccttcaagttccttcagagatataggcggcaccgctctggaatcttagcctgattccagaataaaggaatgttaatagccctctgtgagctttccaggagcccacacaataaggttggtaggctttcaaagaaatcagttccattagtgaagtagcacaaacaattgtgaatttccttgaactcacctgaaagccttaagatccaggagtaaattcagggtcaggaccttgatgccatactacaggttgagaacccaaaacatatctaaggtaggactgaatctaggacccacagccaccagcaaagaactacctatgctatattgctagcactccctagctcacctattttacttttttttttttttttttttgagaccgagtctcactctgtcacccagactggagtgcagtggcgttatctcagctcactgcaacctctgcctcctgggttcaagtgattctcatgcctcagcctcccaagtagttgggactacaggcatgagccatcacacccagctaatttttgtattttcggtagagacgggatttcaccatgttggccaggctggtcttgaactcctgacctcaggtgatccacccgcctcggcctcccaaagtgctgggattataggcatgagccactgcgcctggcctattttacttttaagaacaaggaaggctttaagcattctaaaacacaactagggaggcacaggagaaaacagtggtgatctgggaaagctggagtacaagatgaatgaaaccacttaccttcctgcaggtgctcctaacgtacacagtgcctcagtgcctctgtcttatggctatgagctttacagcaatctttctcaaactgcaaaaaggcctaactaaaatccatcttgcaattcctagcacttgcgttaaggtaggcagcatgtctacacatccttctgtaggatgtaggtttaaaaatatcagaagattttttacccaaaagatgcccttgtgccagcctgctttttcatgtgtaaaatacaacaattactgctactaaaattaatttatttggtgctcagtgaatgtttatttagaagccctattttgcataggaaatagactttaggtacaacatgggaattaacatgggtttgagtagtattgggtttttttggaggactggtattcttaaggaatttttaaacagaagataaggcacatgtgcaaatagtctataatgattattatttgtggagtgtttattatgcacctgattctttacaaatatttcatttaatgcttacaactgccatgcaaagtaggcatttgtatcccaattttacaaattaggaaactgagattaaggaactgtcccaatttctcaaaccaaatgaacaatggaaagaatttgaacctcaatggtagaaagaatttgaactccaatatgtgtggctttttccactggttccacatttcttccctaccaatggttcataaaaagaagtagtgagttttccaaatggtacaaacaaaataccagagaagtagaggtgaggaaggtagtcacttccaggtgtgatgattggggaaggggtcatgggggaaagccactgaggtgggcctttaatggagtgggaggtgggtacaggaggacaatattctatattctagacagagggaatggcctcagcaggagggtgaagatgagaccatttttgagtgtggagaacagtataacttaatatgcaagatttatattgagaggctagcagaaggcaaggcggaaagttaaattgaggcaagattgcagagtcgatgacaggcgaaggagaaagaactctatgaggcaataaggagctgttaaactctgccccccaactccagggatttggagccatatacagaaaagatctagaagaaaaagaagggagctacagtgcactgtcacagtgctgaactctgacagaagtggcggcggggaatggaattgatgattccaaggagaaggggaactctaagaccaaagagaagaggactatagatttcagtgaccaatgggttttggagagtagaagaaatgtatgaatcacaaaaactatagtggtgagagcctgggtgatcaagagaactttggaaccacacacggaaatgtgggcaacaggaagaggtgctggcttaggggaaagaaccacctggaaagtgtcagccacacagggtctgtggtcaggtatgttacaccgggggccctggggcaggctgaatccgaggaagtatcacaaaggaaaggagcttcctgagaagagaagaaccaagtgaaggccacttcaggggtagagggctgggaaagggtaggagaaataggagtagaaaaatcaacagaaggaaaagaggtaatgaatttggggtcaaaaagacagagtaggtaatgaccctctatagactttgcttaaggaggaaactttgttcttacaatgagtgaatgaatgactgcaaagaataaatgaatgcaaagttactcaatgcttccatctgacaaagagtgcgtgaaatagccaatcagttgcttcactatccaaatggagaatatagcccactatacataagccattttgaattatataagctactccataatggagcttattagtgtggttcccgggcttgagcccaatcttttcttcttgtgaaacgaaatcaagatagtattgtttccctgtcaataatgggttcttaaatgggcttgagctttgtgagcactgccaatatcaacacttactttagaggcaatcttgataaaggagaatctgataaggcacaagagagggcaaagagggtataaatggcaggttggatgagggacactaccactgaggcaacatggccaagctcacccttctcactggtaagagatcgtctcatctctgtacctctgaatgactctctccatcttgtttttctgcccctttaaaactcttttaccttcaaatttaaaccagatcaactgagatttttgctttcggcaaaagtatggggatgtactgaacagggggacagccccaaattgcctggtgataggtttctcactgccctgctgtccccctcccttcaccaagcctcaaaggctcatggtactttaatggtcttttgaatggaaatagaggggagtgggtttccaggacaaatccaaaggctttgccagcctcagtaggttggtcatctacagaggatcttaagagaatgaaaaatagaaaaagcttcctactgcttaagtgaggtgactaatgtataaaggctactctactcacattcctccagttcattattctctctgttgctttaaggtctgctccttgtgctgacagctgaaataggtaggtatatttcttgggatgaaccactatattgttcctctttttcttattcataatttggaaactcagtactgccctgtgtccttccacatcagacaaagaatattaactactctctacagagtttgaaattccctaaccaagtttaaaggattgataccattggcctaaaaatcccaaagcagaaaccaactagatggcagtcttaaagaatacgtgctaacaataaaaactaatgtggtgaggcagctacacagtgtcctctgctcttaaaacattttaaaatctgtcatcttactgagttttaaaacaactcttctttgagaggtgtacaggaaaggcattaccactccatctcacagaccagttaaccagggcagagataagacatatgacctgacctaggtaatacagagagttcatggcagaatctgaaccagtagccagggcccttgtctcttggtggaagactcatttccccctgggtggaattactcagggagatatccaaaagggctaaataggcttatactatcatcctttctgtgtctcagtttccaaatgggttaaaatgagaaaataataatacctctctcaaagggttttggtgaggattcatgagtaaatataagtaaatttctcagagcaatgcttggtacgtaagctgccacataagggagctagaatacatctaaatcatagttcactaagctttaaaattctatttcagctaaaggcactggtttctaaggttatttaattctctcttggaggaacagagctatctctaagagatatcttcagccctgaattgcctgctcattattgcctgcaaattatataattataggtttgctgcaacataaagttcttacattgacttttcccctttcctttgagacttcaaatagggaaatcatttggaaatctgtggtttttaaagaaatctgtgactcactagggagcttgtctctcaccttctttctctgggtaacaggctctgcctaccagctgacatgttacttcaccaactgggcccagaaccagccaggcctggggtgcttcaagcctgatgacatcgacccctgcctctgtacccacttgatctacgcctttgctggaatgcagaacaacgagatcaccaccatcgaatgggatgacatgactctctaccaagctttcaatggcctgaaaaacaagtaaatgacggaaaacctgagtttcaaatcttttaacctttaaggacagtttaaacaagatcttccacagcagacttcaggctgaaattccaaacaggccaacaagcaggtaaattcagctttcttattatttcaagtgcaagaatgactctaattttaaggggaatggctggctcacagaagctagctgctaactaaagcccagctcagttgccaagggaagcttataagtccaactactggtggactcagttgagaacaatcttccacttagaagcaatccaaagctggcattgataaagcattcagtctccttggtcaggagattcactcctagggaaataattggaactgtggagacattggggtgcagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatgagaggctgcatgacactttcctggcttcttgctcactattgcagctaaatgttgaaatggcttccctttcttttcatttgttctggtaaaacactttgtttcttttccctcagaaatagtcaactgaaaactctcttggctattggtggctggaactttggcactgctccgtaagttctttttggtgatgacttcctaggttgattttactctaaggtgttgggaccaccaaggtctcaccctgccttctttgggtctccctcagtttcactgccatggtttccactcctgagaaccaccagactttcatcaactcagtcatcaaattcctgcgccagtatgagtttgacgggctggactttgactgggagtaccccggctctcgtgtgagccctcctcaggacaagcatctcttcactgtcctggtgcaggtgagctaagttccagatcattttcactggaaagcatacacccatctcatatgaaagatcactgggaccttaaacctagtttcctagaattttatttggggtgaaggacctgaaaatcctattccagtaaggatgctgaggaatgaatggaaggatggaagaggttaatttaattcagtgtcatgaacctcatgaaagtaaacttaaagttactattcacagactttctcctgctcctgtacaggaaatgcgtgaagcttttgagcaggaggccaagcacattaataagcccaggctgatggtcactgctgcagtagctgctggcatctccaacatccagtctggctatgagatcccccaactgtcacagtgagtgatgtgccttatcttcaaacccctggaggtatcactcaggcagactagacttgtctttggtctgtcttgctattcagggaccttgtttaggaggctatggaagtggtgccttgtgcccgcacaggtatgggaaatgaccatcagaatgactttaaatcctctaccccacctcaggtacccggactacatccatgtcatgacctatgacctccatggctcctgggagggctacactggagagaacagccccctctacaaatacccgactgacaccggcagcaacgcctacctcaatgtggtgagtccctgtacagatgcaagagcagaccagagatgatgatgaaaatcacatagagattcaggcacaaaaggcatcataagtttagtggttttctcaaatgagaaattaggctgccataatcaattaaatattctcatttactaaaaaacttgcctatttattaacaccatactgataattttacctaatatgaaagaagattaataacaagtgcattgttttttaataaaagaaaatgatatgccactgctcctatttcaataaattataaaaggctttttccaccttcccccttttgctgtttcccttttgccttacccattttctactgttctaatcccttgcctatgtatatcatatagaatttcggacattaactaatgaatcataccaggaatatcattttaaaatctctgctcttctatcatattttttttatccaaagggtatatgtaaagcctgcttgttattaaaagaatttagttgagaattagacctatcactttaacagatatatgtcagtgatgctctaaaatatgttgcaagtactttgtacagtgggcacaaccaaatcaaaaaaagtttagctaataattaatcactaggccatcagctgtgggtgagaactctagctaacccactgccattgcaggattatgtcatgaactactggaaggacaacagggccccagctgagaagctcatgttggattcccagcctatggacactccttccttctgagcaacccctccaaccatggaattgatgcccctaccactggtcctggccctgctggaccctataccaggcagtctgggttctgggcctactatgaggtatacactcagaaatgttagaggaaatgtggctttctcttggtccatgtagctaataatatgagcaatatgcaacagttcttggattggagctgaaagtggatgtttgtggctatctagaagggaggcaagataaaccctcctgttgcaccactttaattgggccttcactaggtccctttgaggctagattccaaacacagagagtgtaggaaagtaggctaccattagtgagagtatatcaatctgtagacacttctgactgccagggtattccttgatttaagagtttctccccacattgaaaataaattactcaaaaggagtaaacaaacagaatcccaaataactaagaaatttgctggtaaagcaatagaccttcattttcaaggagtttttatgcaacactcctctacttccccttccccatgtccttttacctctgccaccacaaggacactgcctacctcttgacctgtaccttatattctgttagatctgtaccttcctgaagaatggagctactgaagtatgggaggcttctgaggatgttccctatgcctacaaaggaaatgagtggcttggatacgataacaccaagagtttccaaatcaaggtagactgtgttctatgggttgttgttgcctgtgagcatgttcccattatagccctggagccacagctcagccttggtgtctgtacataactgacttcctttctaattaccacaggcagattggctaaagaagaacaactttggaggtgccatggtctgggccattgacctggatgatttcacaggcactttctgcaaccaaggaaaattccctctgatcaccaccctgaaggatgctctgggcctgcagagtacaagtgagttagggagtgag

SEQ ID NO: 17862 - DNA, 54854 bp, Homo sapiens
ctgggccaggcaagggggacgtttggggctcagtctgtcctggtcccttctatggctactccagtccctcccctgcttgctgcactctagccacccctggactcctccaagggtcttgatcaggccctgcacgggtccctggggctctgcactcgccaagccctctgcctaggaggttctttgcccagatacttacattgtgttctcctggtctttatccacgggtccctgactttcctgacctccctgaaggaaagccaggaagagtggagaggtctgagctaggagcctgtgggagtcaaagaaggtgcccagaggaggagaggaagagaaagggtgagccaggtggggggactctgcccacccctcataccccggctgagccctcccatgcctgcctgctcccgtcaacctcccacctccctgctgagttggagccgggggagcctggaggtgaggatgtgccaggtaggagccccacaggggccatgggacaccaagaggtgatccaggaggcatgcgtggcagccctgcctctgaagtgtggggcctaagagggacctgttgggcagctcagggcttctccttggggagctgacccagccgtctgttctgtgaccaccttgacacccacatccagttcctgccgcagtgcgcctctgtgagccccaccccctggcggtgcttgtgcaaacaatggaaggaatgagtattccaggcactgaagcagcaggcacaaagtcctgaggcaggagagaacttggtgtttttcatgggaaggagtcagtattccaggcactgaagcagcaggtacaaagtcctgaggcaggagagaacttggtgtttttcatgggaaggagtcagtattccaggcactgaagcagcaggtacaaagtcctgaggcaggagagaacttggtgtttttcatgggctctttcagaatgactggtctacagtgagccggagaaaggggtgcagatgggtctgaaaacagcagggccagtggaccacgcaggcctcagcagcttcatctgtgggtggggctcacgtttactctacccacccattctgggattagtagctacccagggctttgctgctctggggtgctggtgtctcgcattaggccttctcttgcatgatctctgctgatatccactggccatgcagcctcgagcaggtggggacagacttggtctactccagggcaggtgcccaaagtcacacggcaaaagggcgtggcgggaggtggtaaaaagctgggagcaacagtccatctagcacaaatacacatttgctgcaaaaagccctgttgtcaagacagtcctcaggtttgacgattcagtagaaggactcacagttattcattacagcaaaaggacacagaagaaaatcagcaaaggaaaaataaggcacatagagcgggcccggcggggagaccaggtgcaagtacccacaggatatcgctctcccaacagtactgggagtgttgccaaactgggaagctcacctgagactttgtgtccagagctgtggttaggggttgatcacataggcggggagtgcccatatggctgacctgagttactcggtctccagctccttcagagctcaagctcatgacccaaggcctctagttagcttagactagctggtgtggtccaaggcccccacataagcaaagacactcttatcaggtgggatattccaaaaggtctagggccagtcccttttttggaacatgcagggttgaacacactaggcctgctgcactagccccatcctgcacaaatctagatgagtttcagaacacagaaagtgaatgctggctgggcgcggtggctcacgcctgtaatcccagcattttgggaggccaaggcaggcagatcacttgaagtcaggagtttgataccagcctggccaacatggtgaaaccccatctctactaaaaatacaaaaattaaccaggcatggtggcacgtgcctgtaatcccagctactcaggaggctgaggaaggagaatcacttgaacccaggaggcagaggttgcagctgagatcgcagcattgcactccagcttgagtgacagagtgaaatgctgtctcgaaagaaacaaagaaagagaatgcggaaagaaagagggagggagggagggagggaaggaaaagaaagaaattgctccctgtatcagctcctgcccaactctaggccatacccagttgtgaactcactcagccaactctcatgcctggctccttctcaccctttaggttgcagagctggactgttatcttgtctctaatcaccctctttaaagttaggttcctcctttttttttttttttttttttttgagagggagtctcgctgtgtcacccaggatggagtgcaatggcgctatcttggctcactgcaacctctgcctcccgggttcaagcgattctcctgcctcagcctcccgactagctggggttacaggcacccgccaccatgcctggctaatttttgtatttttagtagagacagggtttcaccatgttggccagagtggtctcgaactcctgacctcaggagtcctgcctgccttggtctcccaaagtgctgggattacaggtgtgagccaccgcacccagcctgttgttttcttatacacattttccccttcctttccttacacaaaatttccttacgttgcaattattcttgttttggaaaaggatctgtctccactattacaatgtccacacatgagtccccagtgcctggcccagtacctaaatttgcattgaaggcaagagcatgctgggcacttcccatgtgaccttactgaatatttacaacaccctctaagacaagtgttcttggaggtctgggatccctcatccgcaattctgaaatctaaaaagctcagaaacccaaaatagttttctttctttcttttttttctcagagacagggtctcactgtgtggcccaggctggagagcagtggcacaatcaccatttactgcagcctcaaacccctgcctcaagcaatcctatctcagcctcctgagtatctgggactactggcacacaccatcacacccacctagtttcttttaactttttgtagagatggggttttgctatgttgcccaggctgggctccaacttctgggctcaagagatcctcctgccttggcctccctaagtgctgggattacaggcatgagccactgcacctggccccaaaatgtttttcttaaaggtggtacaaaatctgacttcaacagctacaaggctttttctgatcttcattcatctcgcagtctgaatggtcaccctgtctttgcagaaattgtaatctgtctggttttgtggtgctgtaccatgtcccagtgggagcactaagtcagattttagctgttcattttccattgctgcagaacaaactatcccaaatgttagtagcttaaaacaataagcatatattatctcatccagtttctgtggtcagggactcagagcagtttagctgggcggtcctggcccggggtcttccatggagtcacagtcagtatgtcagtgggggctactgtcttctgaaggcttgactagggtcggaggatacagtcccaaagtggcttcttcaccacagtgggcaagtgggcgccggctgctgccatgaagcctcagttccttgccacatggacctcttcacagggttacttgatgatagggtgggtggcttcccccagagagaatgctccgaaagagggcaaggcagtagccgtgatgtcttgtgggagctagctgcagaagtcacactccatcatttctgcagtaccctcttagttacccaggtcagccctctccagtggattggaggggactacacaggagcatggatattggaaggaggggatcctctttgaaagctggctcccccagttatatgtacctatttgaaatccaaagatcctcatttctaaaatacacatggcggcctggcgtggtggctcacgcctacaatcccagcactttgggaggccgaggcaggcggatcacttgaggccgggagttcgagaccagcctgaccaatatggtgaaaccccgtctctactaaaatacaaaaaattagccaggcgtggtggcgggcgcctgtaatcccagctaattgggaggctgaggtgggagaatcacttgaacctgggaggcggaggttgcaatgagccaaaaatcacaccactgcactccagcctgggcgacagattgagactccgtctaaaataaatcaatacgatacagtacagtacaatacaatacaatacaccacacctgaccccaaggctgttgttggatgagagactgtggattgtcacatgcaccttttacagttgaggcagaggctcaaggtaggtcactggaatgacgtgccccaggccacacattagcctctaacagctctgggtccagttttgttttttccactcatgccccagacaatcaataggcattgtttgtaaccatagccatggggactgtaggcttgctgtgcagcagccactgcactggacaagcattccatgcacactccaccctctagtccccacaacagcccaaccaggtagggtgggcactcgctctgcccttccttctgctgagaggaagcccaggctctgatgagtaagaaggagccttccatagcaaagccaggcctgtgtagcccaatgtccgggccataagcacttgggtggctctggctttgcttataggcttgtctgattctacaagcttgtgttttcccaggctcagctcaggcttggctgtggatcacataagggaagaaagtcaagaagctgctcaggggcggagcctgtgggcaagtgcacacacagggaagacccctgccctatcctgagtagggaaccttggaaagaccccatgtgtgcttgggcatcattgtggggaagactgggctgtggaaaaacactagcgtttgtctgggaattttggggaaggaaagggatggaaaagcgaaagggtgggaaggggctggtttcctgctgcttctgctatataagaacagcatctagcaggaaggttgtcccgtgggcccatactagccaccttacaaagcagcgtctgcagtggctgacgcctgtaatcccagcactttgggaggctgaggccggtggatctacctgaggtcaggagttcaagaccagcctggccaacatggtgaaacaccatctctactaataataccaaaaaattagcagggcatggtggcgggcgcctgtaatcccagctactcaggaggctgaggcaggagaatcgcttgaaactgggaggcggaggttgtagtgagccgagatcgcgccattacactccagcctgggcaacagagcgaaactccgtctcaaaaagaagaaaaaaaaggaaagaaaaaagaaagcggcgtgcggggcagggggttggagctctttctgggctcagtgtccccaggtgacggaacacatgccacgtgcttggtgcgctgcgagctcagctcctggagcttctgttgctgctgtggccgcaaggcctggaccctcgcggggagattcagacccacacttagctccagagcttgggggttgtcgttaagcccttcctttccatcagaggctgatgaatccccaaactcctgggctgagttcgactctccgacaactcctcagaggcggatgtttggggccactggaataagcccagcaccagctggggtgtggacagcctcgggggccaggccaactctcccggacgggtgcggacggcaggggcggggccgggctgtaggcggtgggaggggtggggccgggcgagaaggggctgggcgggctgccgtcgggcggggctgcgcggggaagggcggcgctgcgcggggggcggggctgcgtgggggagggcggggccgggctgttgtgggtgggcggggcgcaccggggaaagttccgggaagggcggcagccggcggggcccgggcgcggaagttgccggcggccgcgcggcctcccgggcgggcctacagccatgtcccgggacccggggtcgggcggctgggaggaggccccgcgcgcagctgccgcgctctgcaccctgtaccacgaggccggacagcggctgcgccgcctgcaggaccagctcgctgcccgcgacgccctcatcgctcgcctccgcgcccgcctggccgcgctggagggggacgccgcgccgtccctagtggacgcgctgctggagcaggttgcgcgcttccgggagcagctgcgaaggcaggagggcggcgccgccgaggcccagatgcgccaggtacgagggcgggtaccagaggagctgcgggagcgagagtgcgtgtggcggccgccgggtcctgggtgggtgagcgagcgggccccgggtcctgaggggttgagggggtactgggtcctggggttgagttggcctcgggtcctgaggggttgggggagcaccaggtcctgggagttgagggggtgccgggtcctgggggtgagggggccccggctcctgaggggttgggggagcatcaggtcctgggggttgagggggtgccgggtcctggggttgaggggacactaggtcctgggggtaaggggccgtcgggtcctgggggtgatagggcaacagcttctggggggtgaggggaccctgggtcctaggggagagagggggaccaggtcctgagtgggataaggggacaccacgggctgaggtgtgctgggtcctggggggtttgaggcgtcaccaggtgctggtggaggtgagggggctctgggtcctgcggggtgagggtgcaaggttctgaaggggataagcgaatgctggatcctggggggttgggagggcactgggtcctggggggatggtgaggaggcactgggttctgaggaggggggttggtgcagttcttgggttctgtgtgtgtgtggtgtatgttcaggtgggctcttaggggtattttgaggttcgtgtgtgggaacacattccgaggggggtgtgtgtatgctgtgtgtattctgtgtgtattgtgtagtgtgtatgttccggttggttcttaggggtgttttgaggtgtgtgtgcgggagacacattctgaggggtgtgtatggtgtgtgtgtgtacgcacacatgtgtgtcttgggtccaaggtcgtgtactcatattgtgttctagagtcccttccagccctcacccatgcatgtgtctttcactagtggcgcttcaactctatgctgggagcaatggcaaatgcagcccgtgtctgataaaggacacaaatcctaggctgggtgcagtggctcacgcctgtaatcccagtactttcggaggcaaggcgggcagattgcctgagcccaggagttcgagacaaggctgagcaacatggtgaaaccctgtctacaaaaagtgcaaaaaattagccgggcayggtggcacgtgcccgtgctcccagccactagggagacttaggtgggaggatcacttgagcctgggaggcagaggttgcagtgagccaagatcgcaccactgcactccaacctgggtgacaaagtgagaccttgtctgaaaaaattaaattaaaaatggacacaagggtccggacgcggtggctcatgcctgtaatcccagcactttgggaggccaaggcggcggatcacgaggtcaggagatygagaccatcctggctaacatggtgaaaacccatctctactaaaaatacaaaaaattagctgggcgtggtggcgggcgcctgtagtcccagctacttgggaggcggaggcaggagaatggcatgaacccgggcggcggagcttgcagtgagccgagattgtgccactgcactccagcctgggcgacagagcgagactccgtctcaaaaacaaacaaaaaaagacgcaaatcctgactttcttctctttgtccttgtctatgatgtttatgtctgttttttgatgataaactataacaccacaacagcagtataagtaacagtttttttgtgcaatagtatttgcaagcatctgaaacattcgggtgagctctggcatctattattccatttgattcatggctattatcctagtttgcccaggaaagaaactaagcctgcaaaggcagtagtctgcgaaagatagtttttgtctccagggttggccccacagcctgattttagagagaaaaagaaacatgccctttttaaaaaagaaaaaaaattataaaacaattttgaatatctgaaaaataaagaataaaatagccgctgtagtcccacagtgcagggatgactagtgttaatctcttggcatgccttcttcctgtttttcctctgtgtataaggtgtgtgtacacttggcatggttgttttcatgctgtgtatacagttgtacttaatattaggttgtcagtatctacatcatttaaaatactttcagcagccagtgtctcccctactccactctctccctctttctggaaggtacatcctgactcactagagcagaagggaagtttagaggtcacctggtctgcaccaacaggttttagagttgtggatgccaggagccacagatgagtacagaccaaggacccrgaaggacactccgaagtcatctccagaatgttggtgggacaggatgcagggacctcacaaccagagcagtatacttgcagtcggtggccattggtgttccgctcacaygtgttccctggtgtcctgtgtatctggccactcaccaagcagcttattgcagcttcctggtagcctcagatagaattagttctgtgttcccagtattactggccctggtcctgtcttcccaacatgtaagcatgtaggttttgttttgggatttttatttttttatttttttgagacagggtctcactctgttacccaggctggagtgcagtggcacaaacatggctcactgtggcctcaacctcctgggcttacgtgatcctcctgcctcagcctcccatatagctgggaccacaggagtgtgccatcacacctggctaattttattttttttttgtagagacgggatcttgctgtgtcgcccaggctggtctagaactcctttcttcaagtgatcctcctgccttggcctcccaaagtgctaggattacaggcatgagccaccacgcccagcatggggggatttttaattatttaaggaacattttaatgatttagttttgtttgtttgtttttttatttttatttttatwtttttagagacagggtcttggtctgtgacactgccacctaggctggaatgccttggggccatcatagctcactgtaaccttgaactcctgggctcaaccagccctcccatcacagcctcccgagtgtctaggactataggcgaagagcctaccacaaggactatgagccaccacacctggctaacttcttaagtttttgtagagaaggggtcgcatgatgttgcccaagctggtctcaaactcctggcctccagggatcctcctgtctcggcctctcaaagtgctggtattacaggcgtgagccactgtgctggccttatctggtattttatgcaattacatatttattgctcatcccaacgttcaatctgaggtcggtcatggaacctgtggaagaatggagaggtttstcacctcctgcaggccctgggttcactgaggtggcagtgcagagttaaagacacagcaggaagcaagccgttgctaggttgctctcatctatgagagcccgttaggagcaggaaccctggaccagtagggactgagggctcccagagagagtgctgaggctcagaatgtggaggagctgaccagtgcgtctgtgatcaagctgcggtcagtgtgtgatggggcaagatcaggccagagaattgtggtcctcagtgcagccacagctggacttgagaccttacctcatctgtaacacaaggcctgagtggataactttacaaagcccctccagttaatactttctggaataatggcaccaattcattgtgcaacctggtcctgcccaaccccatcctgtcaccattctcgggaccagcttcataggctttgcctggtcctggcgtatcagccccctttcccttccggcttagcttagctttgctttgcttgttttcttggctctttcttttcttttctcttctcttcttttctttctttccttccttgttcctttttttttttttttaaactgagtcttgctctgtcgccaggctggagtgcagtggcgggatcttggctcagtgcaacctccacctcccgggttcaagcgattctcctgcctcagcctcctgggtagctgggactacaggcgcccaccagcacgcctggctaattttttgtatctttagtagaggcggggtttcaccatgttggccaggctggtcttgaactcctgacctcgtgatccacccacctcagcctcccaaagtgctgggattgcaggcatgagccaccgccccgggccaccttccttgttcctttctttcttcctttctcctcccctcccctcccctctttttgacagggtcactctgttgcccaggctggagtgcagtagcatgatcatagctcactgcagccttgacctcctgggcttaagtgatcctcctgtctcagcctcccgagtagctgggactacaaacgcccaccaccatgcctggctaatgttttttgtattttttgtagagacaaggtctcgccatgttgcccaggctagtcccaacccttgggctcaagtgatcctcccacctcggcctcccaaagtgctgggattacaggctttgggagaatacacttctgttgtttaagacaccaagtttgtgatactttgttgccgcagcgctaaaagccaagaggccactgtgcctcttaaggccaatccacaagactattaatagagctgtttacacttttgtgttctgagcgtggagctatggagttgtgggtcccggcgacaggctttcctgagagatgtcagcccagttgctgactagtctgtgtgttgtgcctgtgtgtgtagacccacaactccagctcgtaccttgttttctgaccacagtggtcgaggtgctgttgtgtcctaagaactgttactaactggacaaggcactcagacagataaaccagcacaaagctctgcaacttcagagccagtgacaaatgccagaagcccgggggctggaggggtcctggggccctcatgctgccgaggggaggatgagtggggcagccctttgcagggctggcctgcccccacgggttgagcgtagagcctgcgtcctgatctgtctctgtatggcccagtcttattcccatttactgggcatctgtgtggggctgggctcagtgttgagtactagggtgtggaggcaagagagagccacgccctcaggatctacgagctgtggacatgctgccctcctgtttgtggagctgtttgtttctcctactgtcagcatttgaccaaygcaggaaggaggctccgaaatcagattttacctgggcacggtgacccctgctgaggcaggaggaggattgcttgaggccaggagttcaagaccagcctaggcaacatagccacaccctgtctttatcaaaaaaaaaaaaaaccagaagtcaggttttgctcaaagtcctttatccctgaagagggtctcactgtcacccaggctagagtgcagtggcaccgtcacagcacactgcagccttgacctcgagcccatggtcccagctatttgggaggttgagacgggaggaacacttggacccaggagttcaaggcttcggtgagctgtgattataccactgtattgcagcctcggtgtcagggcgagaccctgtctctaaaataataaaataataataataataataataataataataataataataataatcagggttctcgcagtaatagggcttagtattttgttccattgtgatgagaacattctaggttcccggtctctgtcccttcttacctcaagtactagacacagaggctggacccttctcccgccacttctgggggaagcttgggctcctccgtgacttttctgaaactgtttcttcacttgtgggatggactagttgagcctgcttcacctccttcatgtaatgtactgtttattttggaggattctttgaaaacggaaaagtacaaatttaaggccagatattaaaaaattgtcaggtcagwtgtggtggctcgtgcctataatcccagcactttgggaggctgaggcaggcggatcactcaagtccaggaccagactgggcaaagtggtgaaaccttgtctctgcaaaaaatacagaaattagccaggtacggtggcatgcacttgtaatccaactacttagggtgctgaggcaagaggatcacttgagtctgggaggtggaggctacagtgaaccatggtggcaccactgtactccagcctgggtgacagggcgagaccctatctcaaaawaaaattgtcattttaagaacctttttaaattctttaagaagtaattggggttgggtgtgttaatttcctagagctgctgtaacaaagtaacacaaactggggggcttcaagcaacagaaatttaatctttcacagttctagaggccagaagccagaaaccaaggcatcggctctctctcaaggttctagggaaggacccttcctcgcctcttcagcttcctgtgggggccaccaatccttggtgttccttggcctttatccacaagacaagacgtcactcctatctttgttgtcacgtggtcgtcttctctctgtgtgtctgtccagacttctgtctgcttacaaggacaccagtcccgtcctaatccattttgtccccaccttaactaattacatctgcaaagaccctatctctaagtaaggtttcattcccagataccggggaatgggaggtttggttgtggacatctttttggggttacccaccacagtggagtttctacctttcccatcaaaaaagtgcttggaattgccactttgataatttgatgataactgggtgtggtggcttgagcctgtagtcccagctattcaggaggctgaggtgggaggatttgcttgagcctaggagtttaagaccagcctgggctatatatagcgaaaccctcatctcaaaaaaacattttgatgatatgaaatctaaaattatgaacttgcttgtgaaaatagaatttggcagggcgtggtggctcacacctgtcatcccagcactttgggaagccaaggcgggtggatctcttgagcccaggagttcaagaccagcctgagcatcacagcaaaaccctgtctctacaaaatacaaaaaagttaaccaggcacggtggcacgtgcctgtagtcccagctactcaggttaggatggagaatcgcttgggcctggggaggtcgaggctgcagtgagccatgattgtgccactgcactctagcctgggtgacagtgagaccctgcctcaaaaaaaaaaaaaaaaaaattgctgggcgcagtggctcacgcctataatcccagtactttgggaggccaaggctggcggatcatctaaggtcaggaattcgagattagcctggccaacatggtgaaaccccgtctctactaaaaatataaaaattgggccaggcgtggtggctcacgcctgtaatcccagcactttgggaggctgaggtgggcggatgccgaggtaggcggatcatgaggtcaggagatcgagaccatcctggctaacatggtgaaaccccatctctactaaaaatacaaaaaattagctgggcgtggtggcgtgtgcctgtagtcccagctactcggaaggctgaggcaggagaatggtgtgaacctctgaggcggagcttgcagtgagctgagatcgctccactgcactcgagcctgagcgacagagcgagactccgtctcaaaaaaaaaaaaaattcttttagctgggcttggtggtgggctctataatcccagctactgaggaggctgaggtgggagaatcgcttgaacctgggaggtggaggttgcagcgagccaagattgtgccattgcactccagcctgggcaacagagtgaaactctgtctcaaaaaaaaaaaaaatttgagatgaagtttcagaacagaacattgtaggctgaaaaactccagagttaatagttcaaatgcccracttctgagtgagtaattgttagttcaaacgcccaacttctgagtgagtatgtttgtgtctggtgatggggcatccacgccaggtcttcttttgctttctgaacatttgctcttgacactgcttcttttaattcagtaaactgtgcttttaaatcttccacttaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccaggtaggccacagtgtaagcagagtgtggggaagacctctgtgtgctgggagcatcgcctacaggcccctgatcacagaggtcggggggcgccccagaacccacttctgttctcagtaacgagagtcagctgacggggcaaagctcactcatccaagggtttcttttaaaatgatggaacatgcaaaatgtaataggaaagcaggcagccacctcactgcccagcaccaggcctgtggccgaccccgctcccaggtgggagatggcacttggctttcatctgcctcagctgaggatgaggaggaggagctgagcstggcagagctgcctggaggaagtgtagtcacatcctccatccgaggaaactgaagcagagccaggtggtactgctggggatggggagtgcctccagttccacaccccaaactcctggaaggaccgtgagtgcccgccttcttcaggctcagtgtgtctgagtgcatgcaggcacagctggaaccgccatctccaaagctggctttaggcatgtccttgccagcagcacggcctcccgcaagcttggagacctggctcagggccacagcctcctcatcatcaaagcaagggccgggggcagcggcaccaagtgacagtgagggccaaagaagggttcgctggacctccaggataggctggatctgggctgtagctctctgtggggtctagtgggagagagaaggacygtgggagtttcagcatcaggagaaaccagggggctcctaggcagaaaagtaggggagcagtggcccaaggcatctgtgtgccaggcaccttccatcttgctggtgcttgtggtggtctgtgtgtggcaggcaggggaatggaggcactccgtgcacatctcacctaggctgagaccccatctcactcgcactgccgggcacagggcctctcgctcgggtcctttctaggcagttctctgaggcagcaccaaggttcatgcagaaacacacgcgctgggatgttctgtggcagacagtacatcccgcacccatcagcagcttcaccgaggcgcccactggggagaaggttggtctgagaactgcccacctcagctgggtggattccaggcggggaacctcagagaggacacagctgcattcagaaaccagaggaaaagtgccgtctgggcggaggcagggtgttctggtctgattttgagtcactgtgtcatttccctctggggatttgaaaggagccacacacagtgttgagcctgaggcgggggtggggccagtggcagggtaggccctcatcacagtctctaaataagtgtcacttctcagccctgaactcagctgagtcacccggggcttcccggtgtaggctgtgttaggacgtgcacttcctttgtcatttgaggggaattctcaaaaattatgtcactgagatacagtcagaattgtagggtacacacgagtttcaggagacttttcattcagctctgtagttgttagtgggggttggtttgggttgtggcttckgtgactcctgaccctgcgtggggcagaggttagattsctgtgtccagaatcacctggttgaacccgattgtctgcagacaggacagtgtcatgggctccaaaggaggtaagcagggtgcatggccaggcccaccctgggcagctgggggcccccycactggagatcctctggtttacaatgggattcagcttcctgccttccctgctgtctgtgataatggcaaatctctggcaatgagaagactttatcatgtctggtgtgccaatccctgcagacattatggctttagaatatttacattccaaatatttaaaagacaaacagctcaaactggtaggtgggacgggataaggacagtgtgaaaggtggtgtggcctgaagacctyccatccgggctctggcctgggccaggtggggtgggcctgggcagggagaaggtggtcccttgtccctgctttgcttctctaccaaatgaatgatcactacccgctgcactgggggacgcagtgataatctgtggcctcagcctctgggtctagctttctcccctcttgctgtatgtgacagagtgtcttctctctgtcccttcctcatgcagtcggaacacacagatgggcacacctctgtccagagtgttattgagaagttgcaggaagaaaatcgactrttaaaacagaaggtgactcacgtgagtgtctttcacatttcgtttgagaagaacacatggcttacaaactgtaagtgagggttctttccttggctgatgcccagagtcgccccccgccctctggccactaggacttgatacacacagtccctagagactggacttttttgcttaaaacgacgtacgggacatgtcctgtccatctccatccccctaaaattaatccacaagtcagtaaaggagatgcaagagttagcagcaggaggtccattttctaagacagcaaagctgcaccragtccacctccgttcatgctgcttgcgtacgggtgtcatcgtgctgcctcaggattctctagcgggcctagtgtctgctctctacagaacagggaggggcagcttccatttaagaggaaactctcactcagcgaatcactgctaatacataattcacactgggtgctggcttgagcagctttgtcagctgccttcaccgtgagctttccggctccacctcttcaggttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcaggtgtctgtccctcgggctccggacggcactgaccagatgtctgctggccggtggtggccgaaatcatgggacaggctgggctgaaggcttggtggcactgagtgggcagtggtcackgtgggggtgggagaagcctggtggggcgcttcctccttccttgagcagaaatgtgtgtctcgcctctcttcagattctcgcttacaaggatgacttcatgtcagaaagggccgatcgggaacgggctcaaagtaggattcaagaactggaggaaaaggtcgcctctttgctgcaccaggtgtcctggagacaggtagagtatgagggcgtttttcttcctgcttaggtttagtgtttttgtttctcttctcatgagattagagcctttctgtgtctgccaaggccctgatttgctggtgatgagggttgtggcgagcccctccctgctgtggggagagccacctggcctggtacctgggcgtggtcatggaaagcctccctgttatactgtttagttatggaggaggctggcatggcggcctgtcttagcagaggtggctgtcctcagggcccgtccgtcactgtcatgcagtcagagagcatatctcgggcctcaaagtgtgagctccctacgtgtcctgacctgtctgtgagacgggaaccccgcttaccttgtcatgtagatgtgatggccctgggtgtccagtaacatccccagctcagcctggcacgtggagctgggccttgcagggcaggggcccctcaccccacccctgggctcagtgcttttcctaccatggggtgccttgagggaggcctggcatgaatgggaaccgatgaagttcctcagtgtgtgacccatggcctcttccttctcctcactgacttgtgctctgcaaaaatccaggagaagtttatktagctcctcatcaagtacctaacacacttttggccctgggaatagcctgggccccactcaaagagcttcctctcctggcacagactgaacagtagtgatgcctcttgagaatcgatgcgtcccgggctggagctaggacgtcagccgtgtttcagggtgtgaacagggaccctggggctgtgaggccaccccccactgccctgttccgagcagccactgggcctcagtggtttctgcttctcctccgcatgaagggcacgggagagtcatggtggactatgggactaaccctgggactaagtctgcagcagagggctggacaggtttttctggccttcatgaattcaaggaagcatgtgatttggattgaaggagcactattggtacaatcgtgaggatggtctcaggccgcctcttgaagattttggaccagatgaactggttccagacttgcaggcccagattcttacccccgggggtaaagttcctggtggggcctgcagaccttgtactaagtggcctctggttccctttcaacagtagcctgtggcccctcgagggttgctcagtccctagatggcacagccagggacagtggtgctgaaggcatgggtgataagctgtagtcccactggggaaagtccacattcagacaggaagtggaagcaccaaggcctgctggaatgaagttcccaggcaagcagtgagggccacaggctgcagtgcttcaggacggatgtttggagaacatgtgccagatcatgccaggtggttggtggggccaagccagggacacctcttgctgctactgaaggaccccctgagccccagagtgctcagcacccccaggccccacagaggaggtgcagagtagggttggtactcagtttgcccagctccccaccagaggctctgccacctccactctgtggtggcctgtgggccacgtcatcagggccaccttctcagtcaggtctcctggggccgataggtccaactgaacaggacttccaccaaggggctggggggtggaccacgccagggcctacttcttcatgagcacatgacggagcgtgtgtgtgatcctcagtcattcactgagcgcccccttgtctgggctctggggcgcagcaggaagcaaagtgaggggctgaagttccgctcagggataggtgaagtgcctctggttgctggaacctgagacctggctttgtgaccgtcagcacagcccacgtatatacacccttgccttttctccaggattctcgagagccagacgccggccggattcacgctgggagcaaaactgccaagtatttggccgccgacgcattagagcttatggtgcctggtggctggaggcctgggactgggtcccagcagccagaaccccctgcagagggcgggcatcctggcgcggcccagagaggccagggggaccttcagtgccctcactgcctgcagtgcttcagtgacgagcaaggggaagagctcctcaggcatgtggcygagtgctgccagtgaccgagactcacccgtgcccttgcggcctcctggcccggtgcagctgccctcagggacagggtgggtgctctcagatgccatgggttgagctctactgagagccaaggcccctagaatagttgcggggcactctgatcgttcactttggtccctttggctatggaacaggctgggtcacagggaactgccagtgaggctggaggctggaggtggagatggggtcaggaacatctggcagagggaggtcccagtctgtgtctccatcaggcttaagccagagctatctggtgctggtgtgccagcccytcccccagcctgcctagaaaggggtggctgcctgagggagtcacttgtatggtccccagggtgggagccccatcctgttctatggaataaagcgtcgcctctctgcctcgaaccagtcaaatggagtattgcggctgcacgtcacactagggtggccacccccgccattgcgagccacatgtctgcactgagaaactgcatttcagtagcatttgtcatccagccggaagttaaagcacacttaytttattcacctatttttataataaacgttcttgctgctgtgactgctctgagaatttgtgttggaagctggggtgcagggactgaacagtatttacagcagctggcatgggaaaacactcctgctgttgccttctgccagggcaccaagacaagggggtcagtgggagcctggctgtattagggttctctagagggacagaactaatggaacagatagatatataaaggggagtgtgtcaagtattaactcacacgatcacaagttcccacaataggccgtctgcaggctgaggaacaaggagagccagtcccgagttccgaaactgaagaacttgggagtcctatgttcaagggcaggaagcatccagcacrgagcaagatgtaggctgggaggccaggccagtctctcttttcacatttttctgcctgctttattctggccacgctggcagctgattagatggtgcccaccccgattgagggtggatctgccttccccagcccactgactcaaatgttaatctccttggcaacaccctcacagacacacccagatcaatacttcctawccttcaatcaagttgacactcagtattaaccatcatgagtccaccccttgtctacttgaacccatacatagtcctgagataataatcttcaaataaagacaaaaataaagtcacaattatgcctaacataatacaactatccttcatacaaccggaaacgcaccagtccccaacccaaataatactattacataaaggtaacaatactttactttttgttttttgaaacggagtttcttgttccccaggctggagtgcagtggtgtgatctcggctcagctcactgctacctccgcctcccaggttcaagtgattctcccacctcaggctcccgattagctaggattacaggcgcctgccaccacrcccggctaatttttgtatttttagtagagaaggggtttcgccacgttggcctggctggtttcgaactcctgacgtcaggtgatcagcctgcctctgcctcccagcgtgctgggattacaggcatgagccaccacacccggccaaggtgactgacggtacttaaatgctgatgtgaagtcaataaatcttatgtcacacgataaaggagaaaggaaatgaagagattttcttagtactagcgtatacatgcacaaacgttttttatcaaaaggaggaaatactcacagcaattacagtcctggttcctgcagctggtcatgtggtcatagccgttattgatgcctaccttcttctactacccattctgtattccctttgccttcagcaagcacctcagcagatggtggtttttttcctggtggagtgacccgaaccttcattcctgatttgtagtcctgcctggattgggctgttgtagtttcccattgaccttaatcacagggcattagataatactaagagatgtcctaatggatctcctgtattccatgcatactcttccttacctctgttgtggagtaagagactaattccatcttttttttttttttgagatggagtgtcgctctgtcgcccaggctggagtgcagtggtgcaatctcggctctctgcaggctccgcctcacgggttcacaccattctcctgcctcagcctcccgagtagctgggactacaggcacttgccaccatgcccagctaatgttttgtattttgtgtagtagagacggggtttcaccgtgttagccaggatggtctccatctcctgacctcatgatccgcccgccttggcctcccaaaatgctgggattacaggcgtgagccaccacacccggccgagactgattccatcttgatagtccagatcaatcactccagccaacaccataactcctccttagcctgttgacttaaaggtaggaggagcccagagtgtccaggtggcaatcttaacttctagcttaatggaatagttgtgtctcctggtggcagcgttcctccctctggaactaagacctctaggccagcagaacataatgtcatgggaacagggagcaaacattttgctagtggatcactaggggtgatggcgagtggtgccacttccacttgagtgccttgattcctggacccgtgcatcctggttaagggagaaacaatatcatakcttggatgctgattcagagcatacatggccttctggagaacttggtcccagccctgcaaagtattgtcacctagttggtgttgtaattgtgacttcagaaggccattccaccgttctatcaatccagctgcttcaggatgatggggaacgtggtaagatcagtgaattccatgagcatgagcccactgccacacttctttagctgtaaagtgagtgccttgctcagaggcaatgctgtgtggaacaccctgatggtggatgaggcattccttgagtccatggatggtagtcttggcagaagcactgcgtgcaagataggcaaacccacatcaggagtaagtgtctattccggtgaggacaaacctctgccctttccatgatggaagaggtccaatataatcaacctgccaccaggtagctggctgatcaccctgaagaatggtgccatattgaggctcagtgttagtctctgctgctgccaaattgggcactcagcagtggctgtagacaagtcagccttggctagtggaggtccatgttgctgaatctccatgtgtaatctccatccctgccaccatggccactctgttcatgggcccattgggcgatggcaggtggctggggaaagaggctgagtggtgtccacagaacaggtcatcctacccacttgattattaaaattctcctctgttgaggtcatccgctggtgagcactcacaggggatacaaatatcttcagtttttgaccacttggagaggtccatccacatacctcttcctcaaatttgtcaccaattttccaataatgcttctttcaagcccctgaccattgtcttccaagtcccatccaggcaaaccattgtctacagcccatgaatcagtacataatcacacacctggccatttctcctcccatgcaaagtgcacaaccaggtgcaccgctccaacttctgcccactgggaagatttcccttcactgctgtccttcaggcatgtcctaaaaagaggctgtattgctgcagctgtccacttttgggtggtgccttcatatcgtgcagaagcatctgtgagccaggccctagtcttctcttcctctgtccactgatcatagggaactcctcatgaggccattggtgcaggctgggggagaggaggcagggtggcaggagtggagaccatgggcatttgagctacttcttcatgtaacttgcttgtgccttcaggacctgcttgagctcaatcacatatgtgccacttctctttgatgatggaatgctgctgtgcacgacctactttatggtgatgggtcagaaagcacccagtttatgatgggcagttcaggtcatatggtgacttgatgacccatagtcaaacattcagtttccaccaaagcccagtaacaggccaagagctgtctctcaaaaggagagtagttagctgcagaagatggcagggccatcttctccagatcctacaggcctccgctgtgattcacctatggggtgaaaatcctacaggcctccactgtgattcacctatgggggcctgccaaaggctccaaacagcatccctatctgctactgacgcctcaagcaccattggatcgctgggtcatatggcccaagtggcagagcagcttgcacagcagcctggacctgttgcagagccttctcctgttctggaccccactcaaaactggcagccttttaggtcactagataaatgggctggagtaacacatctaagtgaggaatgtgttgcctccaaaatccaaatagacccactaagcattgtggatcttcttggttgtaggagggaccaaatgaggcgacttatccttcaccttggaaggaatatcttgacaggccccacaccacgggagccctagaaagtttactgagatagaagttccctgaaaaaaaattttttttttttttttgagacagagtctcactctgttgcccagtctggagtgcagtggcatgatctcggctcactgcaagctccgccccccgggttcacgccattctcctgcctcagcctcccgagtagctgggactacaggcgcctgccaccatgcagggcttttttttttttttttttttttttttggtatctttagtagagacggggtttcaccatgttagccaggatggtctcaatctcctgacctcatgatccacctgcctcagcctcccaaagtgcagggattacaggcttgagccaccatgcccagctgaaatttttttttttttttgagacagagtcttgctctgttgcccaagctggagtgcagtggcaatctcagctcactgcaacctccgcctccggggctcaagtgattatcctgcctcagcctccgaagtagctgggactacaggtgcgcaccacaacacccaactaatttttgtatttttagtagacatggggtttcactatgttggccaggctggtcttgaactcctgacctcgtgatccgcctgcctgggcctaactgctttggctagaacctctagcacaatgttgaatagaaactgcaaaacagatatctttgccttgttcctgatcttagggggaaagcatgcggtctttcacaacattaaggatgatattaacagtgaattttttgtagatgtcattcttcaggttgaggaagttctcttctattcacacttggtgaaatgtctttattatgcaaaagtgttggattttgtcaaatgctttttttgcatctattgagatgatcatgcaattaaaatttcgattaatatgattacattaagtatgtgttggatattgaaccacccttacattcctgggattccacttgatcacggtgtatatttcttttcttatattgctggatttggttttctagtattttgttgaggaattttgcatcaatattcatgagataatagtctgtagttttcttgtgatgtctttgtctagttttggtatcaaggtaatactggcctcacagaattagttgggaagtgttccttcttctatttctgaaagtttgaaaaattggttttaattcttctctaactgtatggtaaaatgcagcagtgaagacttctaggcttgagcttttgtgggtacttttccctgttttaaattactatttcaacatcttcactcattataggtctattcagattgtctatttcttctggagycagttcttgtagcttcttcctgtctagaaatttgtccatytcatctgctatggtttatatgttcatatgttagaacttagtgcccaaggtgatagtattaagaggtggggccttctgggaagtgttcaaatcatgagtgctccatcatcatgaaagggattacagcttttataaaagaggttgaagggatcaccttaattcccctttttgcccttctaccatatgaagatacagcaacaaggtgccactttggaagcagagagtgagcccttaccagacactgaatctgttggtgcactttgctcttgaacttcacagcytccagaactgtgagaaataaacttctattatttataaattactcagtctgtgatatttggtcatagctgcatgaatggactaagatatcatctaaattaccaaatttgctggcatataattgttctagtattcctttaaaatcctttttctgtgtggccagttctgattctagtaatttgaatccttccctggtcaatcttgctacagatgtctattttgtttacctttttaaaacttttggttttgttgattttctccattatttttgcatcctctatttcattaatttctgatctaatttttatgattttattccttctgcttactttaggcctagtttgctctttttccagtgtcttaaggtgacaagttagtttattgatttgagtgagatctttcttgtttcttaatataaacattttcaacttctgggatacatgttactatttttcaatttgggaggttttygactattatttctttgaatattttttttgctctttgctctccttttgatattcccattatacataggctggtatgcttaatggtgtcccacatttttctgagactctttattttcattatttttttctctatgttctttggctggcataatctccatcagyctatcttcaaatccacttatttttccttctgctaattttaaaatttaggctgggtgcagtggctcatgcctgtaatctcagcactttgggaggccaaggtgggcagctcacctgaggtcaggagtttgagaccagcctgaccaacacagtgaaacaccgtctcaacaaaaaatacaaaaattagccaggcatggtggtgtgtaactatagtcccagctactgcggaggctgagacaggagaatcacttgaacccaggagttggaggttgcagtgagccaaaatggtgccactgcactccagcctgggtgacagagcaagactccatctgtctctctctgtgtgtgtgtatatatatgtgtgtgtgtatatatatgtgtgtgtatatatatacacacgtaacttttcagattccataatttccatttggttcctttaaaataatttctatattcatttgatgcagccttattatatcattgttttctttctactacccactagtattccagctatgatgttgctcctcagggtgtgtagctttgcgtatgcccacagtcaccctgggatgacagtcattttggtagagttctcttcctctttccctgaccacattcattaaaccactaattgccaattctattgttttcaacaatgccctggggcaccatgctctacaaacaaatccaatcaaattctgactcctttgaagagagagtttctgggaacactgtgtgatattccttctgacccctggatgccttctcccagctcttttcttcagttacctcctgcaaactatctggcctgtagctgagcctgcatcttgtctctcttcccagggtttcatggcctccactgtttctgagtgccttcaggcttgaacctcttcattctttgttgcaaacaaagtcagtttctttgggaagagattaggagctatctgttttactgcctgtttctctacccaggcaaaatctctgagcagggctcagagctgagggtgcagaaaacagtaagcttctcaatacaactgttcactgttaaagtttcctttctaactattgttattgtttcatttcatgactattacaggttgagtatgcctaacccgaaaggttccaaaattcaaatccttttgagtgttaagatgatgctccaaggaaatgctcattggagcattttggatttcagatttttggattagaaatgctcaattggtaagcatgatgtaaatactccaaatccaaaaaagtctgaaactggacacacttctggtactgaggatgccagataagggataagggatactcaccctgtgctactgtgtgagtcaaaaatgtgaggctcccctatggcggccccaccctcccccacagggaagtgatgtcatcaggaaccccaggggctcccatcaagtcagggaccctggagctggatgtcctataagcaccctgggatgctggaaggatgagtggtttccagggaaatagaggaagatccttcctggcaagggcatggccaggacaatggctgggagcctgagggccaaagctagcaggtgcaggtcaggggccagagcgggcagagctgtgaagccgcaggcagggttgccatggaggtgatgggagtgcccagaactgggcatgtgcggtgggcgtctgagggtctctaggtcccagcatgatgcttagtgtgtcggggcacccagagttccccatcaccactcagggctgtgcagttcccctcagcaacaggcatggttcagcacagtgttaaaggctgtccatggggagagcagggcaggtactgggggcctgggcaggcagcttccccatagggcgaggcccgggcctgggcctttccccagccaccaccgcagccagaagaggcagcggctggagtcccgggggcctgcactggggtttcaaggacactactgttgccgtggtcatggcctgacctgcttcactctctgccctatcatcccacgaacaaaggaacgttctcttcctcacacctggaaaaaaaaacaagtgaggaaagttcgtcgtgctgcacctcccctggttggtgacccttttccagctttcgtgcaatctccagagttctaggacctgctgtccccacctcattctcctgcaaaccggtgcctgggtgggggtgccctgggccttgtctcccctgacctgcctcgaagcctcctcaccctcctctgccttcctggttccacagctcgggcccccatcccatctactcacccctgcagggccctcacacaggctctgtccatgaacagcagtccccagttccagacctctcacctgggtggccggtggacatcccagactcaccatccagaactggtctccagtcccacctccaggcacacagcgcaggtcttcacctctttctcctacctgcatcctgtccaccaggaaatcctgtggcctcatcgtccgaatacctccagaagctggctctccctaccctctccccaaccaggccctgccctmttcaccttcactcagagtgaagtcatactctgatagggcacacagagacaggctgaacatgaggctgggagaagtgggagctactgagtgttctaggtagtaagaagtaaccaggatgcagctccttgggagctttctgtctcctgctgcctgctctgcctggcacacagaggatggtgggggcaccaggatgggtgagccgttgcctggagagacctgggacctgctccggggtggtgccctggctccccatggcggacacatcacctacacgccctctcccgctatccccccactcccccagcagaaagaagcagccgaggtctcctgctgtactaatgtattccatctttcaaaaagaaagacatgattttaatattacttaacaatatkttaaaaaagtagccaggcaggcctccgtgttaatacagtcgtacactctataacagayttgatggtgtgagtactgggtgggcttgtttttaactttctcrttctgcaagggatcttacacaagctggctacaagtcagggggatcaaacacaaacagcgcaacgtgtacactcggagacagtagattgtggagaacaaaggaggcctgccccgcccagcccgcctagggtgagacgcaggggcacaggagagctgagtgacggccgataccccggtgaggacacatgacaggacagggcgcaatgcagaggcaacggagccacgtggatgatgcaaactcctatctggccacggcccaggcctccgaggccgcggtggtgggaggacttggcgggaactactgttccaatccgacagcacagagctacaatcgaaggagtctcacgcacagactacacgcacacgagctaacggcgtgggccgagcatcaacttctcggtctggggtttcaggcagcaccagctccgcacagcccttggcaagcaccacggctctggggcgccagcgaggggcgtggctcttggggtggtgcagcctggcctgcctctcgcgtgtccctctccagggagtcctcattcagtgggcagcaaaggtggcttttttcaagctaaaattggaccagttgatagacagtctttgtcgggtctgtctagcagaatccaagcagaacctgcaaagacaaaaagccaaacagtcactgaaggaaacagcccacaaccaagctggtgcttggcaaagcccatcacactcctgttcttgccagaaactcactgcggggtcaggggtttagattctcggtgaggggcacagtgtcaagggtcccctccaggccctgctacaggctgcacttgagaaggggaaaggactcgggaggaggaatgggtgggcggaaggagtcctgagaaagaaaagaaacgtttaatctgagagctgtgagcscccttaaattatcaggcccaggcagggtgtggtggctcatacctgtaatcccagcactttgggaggctgaggagggcaaatcacttcaacttaggagttcgagaccagcctgggcaacatggtgaaatccttttttttttgagacagggtctcactctcttgcccaggctggagttcagtggcagtttcggctcactgcaacctccacctccaaggttcaagcaattctctgcctcagcctcccaagtagctaggactacaggcatgtaccaccacaccggktttttttttttttttttttttttttttgagaaggagtttcgctcttgtcatccaggctagagtgcaatggcacaatctcagctcactgaagcctccgcctcccacgttgaagtgattctcctgcctcagcctcccaagtagctgggattacaggtgcccaccaccacgtccagctgatttttgtatttttagtagaaagagggtttcaccatgttgaccaggctgatctgtactcctgacctaaagtgatccgcctgcctyggcctcccaaagtgctgggattacaggcgtgagccactgtgcctggccacacctagctaatttttaatttttttcaaatggagtctctgtcacccaggctggagtgcagtggcacgatcttggctcactgyaacctctgcctcccaggttcaagcgattctcctgcctcagcttcccaaatagttaggactacaggtgcataccacaacacccagctaatttttgtattttttgtagcttcttccctggccaagaagcttttttttttttcttgacacggagtcttgctctgtcgcccaggctggagtgcagtggcgtgatctcggttcactgcaaccttcgcctcccaggttcatgccattctcctgcctcagcctcccaagtagctgggactacaggcacctatcaccacgcccagctaatttcttctatttttagtagagatggggtttcaccatgttagccaggatgctctcaatatcctgaccttgtgatctgccctcctcggcctcgcaaaatgctgggattacagtcgtgagccaccgcgcccggcctccaagaagcttttatagaaagcagaggcctcgaaaaaattgtatacacatatatcctaaatatcagcttctaattaagtcaactttcaactctaaagctgtttaaaaggattcctgtgtcaggtcttagccaggcaaatagtcaacattcttgtttcttggtttttccttcctgaaactgacaccaaagaggagatctgaagctggccatggtggctcatgcctgttttcctactactttgggaggctgaggttggagaatcacttgaacccaggcgtttgagaccagcccgtgcaacacagtgagactccatctttacaaaaagtaaaaagttagccaggagtggcagtacacatatgtgcctatagtcccagctgctcggggctgaggtgggaggatccttgagcctgggaggtcaaggctgcagtgagctgtgatggtgcccccgcactccagcctgggtgacaaaggtgagacccgtctcaaaaataataaagccttgctgtggtggctcatgcctataatcccagcactttgggaggctgaggtgcgtggatcacttgagcttacaagttcaaggccagcctgggcaacatggtaaaacctcatctctacaaaaaaacacaaaaattagccaggtgtggtggcgcacacctgtggtcctagctactcgggaggctgtggtgggagcatggcttcagcctggtgggcagaggctgagcgagcctgttgccggtggcaggtacctgagttgccggtggcgaatccgtatgtgtctgcagcagcctcaattattgcctcctcagacgaaagaatctgaccaaaggccataaggcagaagaagagactgaggcaagttttagaacaggagtggaagttcattacaaagctctagagcagaaacaaaaggaaggaaagtgcacttggaagaggccaagtgggcaactcgagaggcaagtgccccatccggcctctgatgtagggttctaggtgttggcatacttcagggcctcgcgtcccttctcscaattcctcccttggggtgggctgcctgcacacacactggcctgctagcacttgggagggagcatgcgtagtgtgtttactggagcatgcgcatgctcacctgaggcgatcttcccttcccggtgtaaagtacctggaaggtcacacaccagttaaactccaccattctgtgccttagtgcacatgcttgagcccacttgcccaattcctgagatcttatcgggaagctgctgatcaccagcttcagtttccctggtgctggctatgaccaattattattttagagaggcagtgtgacaactgcctaaccatcacctgatggtcacctgacatccctggtggatggaggaggccctcccctgccctgctcacacctgactagctacccactgtaacaarctgagaatgcgccactgcactacggcctggacggacagaaccagactttgtgctcccaccaaaaaaaaaaaaaaaaaaaaaaaaaagttttggaggkggaacatatttgcttattagaggtctagggtaaccactatttaaagctgtttgtctttgaatgttttaataaactgtttactttctgagtatatggtttcatttagcttaggagaaggctaaacaaaacaacaaaaaacccctatcatattctaaatataaaccagaaatttataatcattcaagggcatacctgcacaaacgactcaaagccaacacacacagacatgcatgagaccaaaattaagaatccctttatggctttaaccaaggtctctgaagagggaacaaaatttcagccccaggcccctctcaagaacagcttaaagaaagtcttgctagctgcgaatagggtgcaagccacatctgtcaggccatattttctaaggtctcagcttctcagctgacagtctatgcacaaatgccaggtggaagatttaaagagacaggaaaatagaaaaacgaaactgcccatgggactagtgccaaaaatgagggaaggtaaacctgtggggttgggctggggaggtagttcatgcttgtaatcctagtactttggaagactgaggtggaaagatactcagaggccagcctgggcaacataaagagatgccttctctaccaaaaaaaaaaaaaaaaaaaaaaaaaattgggccgggtgtggcagctcacgcctgtaatcccagcactttgggaggccgaggtaaggtgggcagatcacccgaggtcgggagttcgagaccagcctgaccaacatggagaaaccctgcctctactaaaaatacaaaattagccaggcgtggtgacgcatgcctgtaatcccagctacccaggatgctgaggcaggagcatcgcttgaacccggcaggcggaggttgcggtgagccaagatcgtgcctgggcaactagagcaaaactccatctcaaaaaaaaaataaataaaataatttttttttttttaattagctaggcatggtggcgcatctgtagtcccagcaatgaactgtgatcaagccacttcacttcggcctgaactgagacttcatttttagaaagtcttttggggtttaaagtctgctcacagattcctctgccccactggcaccatctgtgggctgcggagtagctgtcttcagtaaaaaaggatttatgtcctacctttaggcaaacaaaggagaggtagagagagcccctgcactctgtcttcagctcaacaatacccagtatttgagagagcaatattttagtttcctttagtagaaaagatgacaaatgggtatcccaaatggtcaagagtcataaataatttcaagtaaattcaaattaattcctattagtggttatcctaagctaaaggtatccattgaggaaagaaatctgtagtggctctaaggaactgtaactttgtttcaaatccagtctcagcgggaatgctgctaattccctggatgacagagtgagagactgtgtctcaaaaaataataaataaataagtaagtaagatttacatccttaagtgactgagagcactctctaaaacaaacttccaaatctcttgagggccagggagagaactcaccttcatgcaccagtttaaaactaacagcaattggtcacaatttttttttttttgagacggagtcttgctgttgccaggctggagtgcagtgacgcgatctcggctcattgcaacctccgcctccggggttcaagcgattctcctgcctcagcctccagagtagctaggactacaggcgagcaccaccacgcccagctaatttttgtacttttagtagaaacggggtttcacyatgttggccagaatggtctctatctcttgacctcgtgatccgcccgctttggcctcccaaagtagtgggattacaggcaggagccactgcgcccggctggtcacaattttttttttttttttttttgggacggagttttgctcttgttgcccaggctggagtgtaatggcacgatctgggctcactacaacctcctcttcctgggttcaagagattctcctgcctcagactccagagtagctgggactacagatgtgcaccaccacacccggcttttttttttttttttttttttttttggtatttttagtaaaggtggggtttcaccatgtcggccaggatggtctcaaacccctgaccctcaagtgatccacccgcctcggcttcccaaagtattgggattacaggcatgagccactgtacctggccttggtcacaaatttaaggaggaaaaaaggtctgaattacaaacagtaggaagcagcaattttaaaagcatgctgtgtaatttaggccaaaaaaaaagaagccacaggaggaacggagccaaactgccagtaccgggacccggatcccatgctgtgaagcaaggccagagaaggcagtttcccttttttttccctgaaacccaaatctcttgcctctttagaaagggaagggggttagaaagaacaactcaagtttttaagaaaaaaagaacaaattaggagaggaggtgattacaaaagttgtttatcagggccaggcttggtggctcacgcctctaatcccaacgtttggaaggccgaggcagatagatcacttgaatccaggagtttgagaccaccctggacaacataatgagaactgtctctactaaacattttaaaaattagctgaggctgggcgtggtggctcacgcctgtaatcccagtactttgggaggctgagatgggcggatcacgaggtcgggagatcgagaccatcctggctaacacggtgaaaccccgtctctactaaaaatacaaaaaaaattgccaggcgtggtggcgggcgcctgtagtcgcagctactcaggagcctgaggcaggagaatggcgtgaacttgggaggcggagcttgcagtgagccgaaatcgcgccactgcactccagcctgggcgccagagcgagactccatctcaaaaaataataataataaaataaaaataaaaataaaaattagctgagattggtggcccacgcctgtagtcccagctagtcaggaggctgaggtgggaggatcaagtgagcctgggaggtcaagggtccagtgagccaagatcataccactgcactccggcctgggtgacagagcaagactattgccttaaaaaaaaaaaaaaagttgtcaagaattctcattgctttacagaaattatattgatagtgattggctataaactgttgaactacaggatatgagttatccctatgacaacattaagaggttaatttacagctactttggccacactctatctagagtctatacaatacagcaggtggattactcagcttgaggtgggggaaggggtaggatgtacccgctctcacatttcactgcctctctggtgtgattacttttttttttttttttttttttttttggagacagggtcttactctgttgcccaggctggagtgcagtggtacgatcacagctcactgcaacctcgacctcctgggctcaagcgaccctccccaacctgagcttcccaggtagctggaactactacagtagtgtgccaccatgcccagctgattttactttttgtagagatgacgtcttgctgtgttgcccaggcaagcaccatatatatgtgtgtgtatatacatacatatatatatagtttttaatttaattaaaaaatagagacagggccaggtgtggtggctcacgcctgtaatcccagcactttgggaggcggaggtaggtggattacctgagctcaggagttagaggccagcctggccaacatggtgaaactctgtctctactaaaaacacaaaaaaattagctgggcatggtggtgggtgcctgtaatagaggctactcaggaagctgaggcaggagaatcacttgaatctggaaggcggaggttgcagtgagccgagattgcaccaattgcactccagtctgggtgacaagagcaaaactccatctcaaaaagttaaaaaattcataataaaaaaaccttctcagttgactgaattcctctcttccgtaacccttgataacgatatgcactttctcagcccgcttttctgtttgttgacatgatttctgccaataatgtaaagcttcattgactggaaagcttaaattctttatcctctgtttggtttttgagacagggtctcactctatctcccaagctggagtgcagcggcacaatcgcagctcacacctcaaactcctgggctcaagtgatcctccacctcagcctcccaaagagctgggattacaaggtgtgaacgctgtgcctggcttatttcagataaacaaaatattaataattgcttatttcttaagttttcactataatttaaggttactaaaagctaaaattctgactaacatggtaactcaaagtagagataagcaggaaaacagttctacatataaaatacataagaaaaagtaagatgtgttttggtaaggaaggttataagaaaaacatgaggatgtggttttgtcaaaggaaaaagtgattttgactagtttagaggttatttaaaagtggtcttaagttgaaaaacagatggaaaagaaaataaatgaatatagaaagttgggaaaaggaagtgaatgggaaaattctaagaggttataaaagatttatggaaatcctgtgtggtcaaagctgattgaaattagatggatctgtttaaaagattttactacaattaatagtaatacactgatgcaactggttttctcttttcaataagatttcatgtagtattaataagagataataaaatactttgtcaattatcttttgagtaagctgaaaaaaaaaaaaaagacattctgttggcctcatgccattttcattatgtcttctgactgttgagaaaactgagtctcaggcagcgggtggtggagcacgcctgtggtcccagctacccaggaggctgaggtggaaagatcacctgggcctggtggtcaaggctgcagtgagccgtgattgcaccactgcctggacaatggagtgagaccctgtctcaaaaaaacaaaacaaaacaaacaaacaaaaaacccagaaaccccaaccctccaaaaccagagtctcctatcaaaacataaaggtttttgctttttgaaacctttgaattattagtttggttaaatgaataacttcttttgtgatgatcttattttgatatcaagtgttttaaacctttgatatctgacatacttcctaaaatcaaattttaaattctaaattagtcttttttacttcaaactttttttttttttgagacggagtcttgctctgttgcccaggctggagtgcagtggcacgatctcaactcactgcaacctccgcctcctgggttcaagcaaatctctgcctcagcctcccgagcagctgggattacaggcacccaccaccacatcttgctaatttttgtattttcagtagagagggggtttcaacatctttggccagaatggtcttgaactcctgacctcatgatccacccgccttggcctcccaaagtgggattacaggcatgagccaccgtgcctggcctaaaggatactgttttttggtttgagacagagtctcgctctgttgcccaggctggagtgcagtggcgtgatgttggctcactgcaacttccgcctcctggattcacgccattctcctgcctcagcctcctgactagctgggactacaggcacctgccaccacacccggctaatttttttgtatttttagtagaggtggggtttcaccgtgttagccaggatggtctcgatctcctgacctcgtgatcctcctgccttggcctcccaaagtgctgggattacaggtgcgagccactgcgcccggcctaaagtatacttttgtaagcaaaattgaaacactggaccaggtgtggtggctcattcctgcaatcccagcactctggaaggtttgagaatcctctgagctccagagttccagaccagcctgggcaatgtggcaaaaccctgtctcttacttacttacttatttgtctctaaacttgaatgaaacctgaaaatggttattactgtcacccatccattaggtttaattatggttgcttaaactgtggcttgtttattcaaccacaaacattcgtgaatgcccaacagcgttcttgccttgcagcctctatgagactgatcccctcactcccctaaactggaagggctgactgtgtcatctcccagaatccaaattctctttccctgtccctagctggtcaagccctgagtttgtgatgttaccttctgcctctgctgtcccctcctaactctgacaatcactaatcctgtttccattagtgcatgtgtgaccctgtcccccagccccttctggacacagcagctggaatagaatgctcaagaacatcaaccacattcctgctccaagccattcaaggaagaaatccaatccaaaccactgcacagcttccacaggttcttgcagcatgggcacagagctcacgctgctctctaaggtcccaggcccagtgtgacctggctttgtccctccccacaccacctgcacccgagacacagtggcctctgcatcaggcctgttttgtcgactgcagactacgtgagacatgcacacggtgtctgacacacaggacagccacataaccagcagggagaatcctgagtcacagcacccccaggtcacaaaacctgacamtgctaaccgtggcgccgtgctgtcctctcccaagaggtagtcacagccctagggtttggagtaattagttcaccatagttcttggtaatttcgtgacttctctatgacatcctaaatgttagtatggttgtgctgtgtggcctcatatcgagggaactgcactgtatgtacatggtcttacagcttcttatttcactcaatgttatgtctgtgagagttctccatgaggtgacagtctgttcgtcttcactgcggtatgaacacatggcagtgaacagacagatgctgctgcttgcctcacgtttgccccgcccccgggacatgcaggagaacctctrgtcgtgcacacaagtgtgcagctgtttgtggggttgcacgggaggcacaacttcaattttgctagagtctgccaaactcttttccaaagtaatttaacagttatgctccccggagcagtggttagggactcccgtcgcttcacaccttcctccagcaggagagagggagggctcgctagctgcaaacccatgaagcagcagcacctcctctggtcttgccatggggctccttggtcaggctgaagacctctttgtagtttagtgktcaaaagcttgctgtgkaatcctaatggtttgccttttgttttaatttttttggagaaaggatctctctattgyttargctggagtgaggtggcgtaagcatagctcactgaagcttcaaactcctgagctcaagggatactcctgtgtcaatttcctgagtagctgggactacaggcatgyaccaccatgcctggctttttttttttttttttttttttttttttgagacggagtcttgctctgttgcccaggctggagtgcagtggtgcaatctcggctcactgcaagctctgcctcccaggttcacgccattctcctgcctcagcctcccgagtagctgggactacaggtgcccgccaccacgcctggctaattttttgtatttttagtagagacggggtttcaccgtgttagccaggatggtttcgagctcctggcctcgtgatccacctgcctcggcctcccaaagtgctgggattacaggcatgaaccaccgcgcccggcccacgcctggctaatttttaattttcttgtagagttgtggtctatgttgtccaggttggtctcaaactcctggcttcaagcaatcctcttgcctcggtctcctagcactgggattacaggcatgagccactatgcccggtccttgacagcttttatgatactaacccttcctgtctttggataatgaatctctgtgatttagatcttctttaatgttttccaataaagtttcagtcttttgtatacaagtcttatgcaacttttgccagatttatctgtggatagtgagagattttggtgctattataaatgctcttttgagctacatttccaattatttgtggtgtgggtatagagaaaaataactgttttttttttttttttagacagagtctcactgttgcccaagctggagcacagtggtgcatcttggctcactgtagccttggtctcctgggtttaagggatcctgccacttcagcctcctgagtagctgggaccacaggtgcatgtcaccacacctggctaattattttattttttgtagagacagtatcttgctatgttgctcaggctggtctcaaactcctgggctcaagtgatccttccacctcagcctcacaaaatgttgaaattacaggtgtgagccaccgtgctctgtttaaaaacaaaaaacaaaagcaaataacttctgtactgatcctacacagttagccccttgctgtaagttcttttatatttcctatgtagacaattagatcacctgtaaaattgatttttagttcctcttttatactcctttagcctaggaattacaatttaaggttgaatataaaatactttttttggaaatctactgatccatgatctactaagccatgatcatatggctcttctttaatatattaatgtagcaactaacattagtggattttctagctgggtgcrggggctcacacctgtaattctggcgctttgggaggctgaggtgggcagatcacttgaggccaggagttcgagaccagcctgggcaatgtggcgaaaccccgtctctacmaaaagaagaaaaaaaaaattagccaggcatggtgcatgtgcctgtagtcccggctacttggagggctgaggtgggaggactgcttgaccctggggaggtcaaggctgcagtgaacagtgattgtgtcatggcactcaagcctaggtgacaagagtgagaccctgtcagaaggaaggaagggagggagggagggagggagggaggaaggaaggaggattttttttttttttttttgagagtgtctctctgttgcccaggctggagtacaatggtgcaatcttggctcaccacaacctccgcctcccaggttcaagtgattctcctgccttagcctcccgagtagctgggattacaggcatgcgctacgatgcctggctaattttgtatttttagtagagatggggtttctccatgttggtcaggctgatctcaaactcccaacctcaggtgatccgcccgcctgggcctcccaaagttctgggattacaggcgtgagccaccacgcttggccaataaagtggattttctaatatgaaacactatttgcgttcctgggataaaccaatttgctcatggtatactgctttttaaaatacactgctcgatttggtatattgtttcttttttttgaaaattacactgatgtaggtatgagaatatttttgagacggagtcttgctctagttgcccagattggagttcaatggcgtgatctcaactcaccgcaacctctgcctcctgggttcaagcaattctcctgcctcagcctcctggagaatattttctttaggatttttgaatctaatatgagtgagataaacctgtgatttttcattttttctggtattgttttgggcagattttggtatcagaattttacttgtctcataaaacaaagtagggagtattcacttgtgtgtgtgatgtctcactcatttaaattcactggtagagtttgctcaagactggataatccattctttcaaagtctgaaagtttggtagaattctcggtaaaactgttaaaatgtagttttctcactgagacttacagctattgttttcatttctttagtagttactggaccattcaggctatttttacctcaggttgattttgcatttcatagttttaaagtcaattgtaatgaagttgttcccagtgttctcttattttaatctctccagtatctgtagttatttcctccttttcacttatatatttacacacttaaaaaaaaaaatttatttttgagacagggctctcgtcacccaggttggagggtagatgcacaatcttggctcactgcaacctccacctctcaggctcaacccatcctcccacctcagcctcctgagtagctgggactacaggcgcatgccaccatatctggcttactttttttgtattttttgtagagacaggatttcaccatgttgcccaggctggtcttgaactgacctcaagtgatccgcctgtctkggcttcccgaagtgctgggactacaggcatgaaccacagcacccggacaaaactttttttttttttaattactgacattttcaaacacacacaaaaacagatagtatagcataatgaacatagccatcacctgactttgatarttatcaacatcttaattcttcttccatctaattatgctattttttgtgtctttttttctctattattcttaatctgtctcctaaagatttatttggtgttttcaatcaatcatattttagctttgttgatcttctctaccaaatctttgttttctatttcattatctctcttatctccttctttatatattctttggtttrttctattgttcttttcctaatttctcaagtgaaatctttaactcattatgtttcaggatttttaaaaactaatttaggcaattatagccttacataaacagctctaaaaagttaacgtttttcgatatcccgcaggttttcatatgcaatgttttaattatctttttagktctgtgtatttaaaaattttgacagtctgggcgtggtggttcacacctgtaatcccaggactttgggaggccaagggggggtggatcacctgaggtcaggagttcaagattagcctggccaacatggtgaaacctcgtctctactaaaaataaaaaaattagctgggtgtggtggcaggcgcctgtaatcccagctactcggggaatttttttttttttttttcagacagggtcttgctctgttgcccaggctagagtgcaagtgccgtgatcatagttcactgcaacctcaaactcctaggttcaagtgatcctctggcctcagcctcctgagtagcttggactacaagtgcatgcctggctttttttttttttttttcctgagacaaagtctctctctgtttcccaggctggagtgcaatggtgctatgtcggctcactgcaacctgtgcctcccaggttcaagcaattctcctgcctcagcctcctgagtagctgggattacaggctcttgtcaccacgtccaggtaatttttgtatttttagtagagacggggtttcaccatgttggccaggctcgtctcgaactcctgacctgatcaagtgatctgcctgtcttggcctcccaaagtgttgggattacaggtgtgagccaccaggcgcagcctctagtccagttttgttgtttttattataatacaaatgcacgcttaatcacacctgtaatctcagcactttgggaggctgaggtgagtgcatcacttaaagtcaagagtttgagacctgcctggccaacatagcaaaaccctgtttccaccaaaaatacaaaaattagccaggcgtggtggcaggcccctgtaatcctagttagtcaggaggctgaggcaggagaatcgcttgaacgtaggaggtggggattgcagtgagcccagatcacaacattgcactctagcctgggtgacagagactctgtctcaaaaaataaaaaaaatgaaataaataggctgggcgcggtggctcacgcctgtaatcacagcactttgggaggctaaggcaggtgtatcacctgaggtcaggagtttgagaccagtctggtaaccacggtgaaaccctgtctctactgaaatacaaaaatcagcttggtgtggttgtgggcgcctgtaatcccagctagtctggaggctgaggcaggagaattgcttgaacccgggaggcagaggttgcagtgagctgagatcgtgccactgcactccagcctgggtgatagagtgagattccctcttaaaaataaaataaataaaattttgttgccattaataattcacatagtagttaaaacattatagaacaagcactgataaaacttgcccatcaggaaaacagcaagtatgtaaaatgttacttttcttctcaaaagcataccactccagtgtgttcaaccatcagcatatgtgagggtcacccggaaggctgtcaagaacgtagatgccggccccttcccagaatctgatccgacaggtctaagtaggggcctgtatccccaggagacgctgctggcccaggacacctggagagccaccgcctcagaagcgcaacagccagttggcggggaagggtgggggggaagccactgccatcaactatttttctagcatgtgagggggagcagaagtgattgtgtgagtgttgggagtatgggaggggtgtgtgtggctggcctgtcctactacaaggctcttcagaagccatgttgtctggcttgcttgatgtaacttcgtccaagacaactagaagtgccatggaaagacagaaaaccaaacatgtatggcaagcacacagtcaccacggtttcagacacagcctccacatttaccttttgaaatattccacttccctctctgtctcatccatatccacactgtctaggtcaatatctttaggtagaaagacatcatctgtaaaacaaaagagaagcagcaagtcaaattacagcagcaggctatcttatcagaacggaagaaatcatttgtcttcgctcaatttaaacaacttcaaaaattgtaaacattttttctaaaatgagattttagaggacagatctctttggtgtgcttatgaacacccaggtctgacctggaaactgcagaactcacatgtccactaagcaaagcaactgtggcttcaggtcccgttagaagacatgtttgccagaacctagactccccatgtgactggtcattatatgacaggcagcccatcagagagccctttagcaagaagattcccagaaatctaaytcgcacgcaagcccagggactgccctaagtctccgttggagtcaggcagagcacagctgccagcagaagctgcccaggggrcaggcccatgttaaggaaagggctgtccctcgaatgtgcccttgacaggaagaggacccagacatcaaccctacaggaaggtggttctcccaggcattcatctcacccatatgacatccagagatttcatcaaaaacttttttcttttttttatatgaagtctcattctgtcacccaggcatgatctcggctcactggaacctccatcttccaggctcaagtaatcctcctgcctcagcctcctgagtagctgggatcaaacgtgcacaccaccatgcctgtgtaatttttatatttttggtagagacagggtttcaccatgttgcccaggctggtcttgaattcctgggttcaaatgatccacccacctcggcctcccaaagtgctgggattacaagcgtgagccactgtgcctggccaaacactttcaagttgttccaaacaaaaaccaaggctacatttcatgctgcaattacacaaccatctttgaaaacaggcaggatagcagggaaatcattgattgagaattactcaatttcctagactctcaggcaagtttgagaatttctacttctctgttctgttctggtcacttatctaattcaatcgtgaatacattcccggaggcttatgtgagccttaagtatcaaagagggtccagcagcacacatctgggctggggcggggttgggggggtgcagtgcacacagcattcagcctcatcgatgtgaacaaagaggacaggagccactgacatttctttgttaaaggtgagtctccatttccctgcagccctcaacacgggacaatttttcagaacctttaataaacactccatttctttctaccactggggaatttccatggtagcatgaggcacgttttactcgcataatagcagctaatatttttgacaactcacacagcaccaggcaagtgctttcaagtgtgtttgttcacagacatgtcacttaggagtctctctctagggacctgctctatgacagccttggctatctcggatcccaactgtatccctgagggcacacagcggggtggaggccacaatcactggtgccactgggactgggtggtctaggaatgaaggctgggtgtgttcagggaaaggcctgggaaagtcaacctttggtaatctacactcaggaggaagggaaagattaggttaaaggaaacgcagccaatagctcaatcctggcacagaatagcggatgtgactggagagtgaggacagcccccagccacagcaggctccacatgtttgtacagagaggtgcttcagggcatgggaaagcattctgagtctcgatttttaaaaactcaagcagcagaaaggaagcacagaacaccgtctgctgatgcaggaaactgatgcacaagcaagggtgagagagggccggagcatttacagatgtacaaaaagtgaagatctaagaaagcatgatgtcagcagccgcccacaagaagttctagaagaaaagagctccaacttgaggaggaaaaagagctggcatgtctgctggaagtgctgtcataatagatttctaataytctcttttcctgactagaactagaataatcagtctataaaatcttggtgtaagaaaaacaggaaacacaactttaaccaatttggtatcaggaaaaaatttttttacaacaaccacactatattaaacaggagaaatcagttgatccaaggattttatatccaaccaaactatctgttcattgacaacacaacaggtcaaagtttacttctccagaactcagagaattctgtggccctactcaaggccactgcctgaggatgagcttcaccaacctgaagacacctgggaacactcagcagaggcaagcgggagccctgttgtagtaaattgtgtacctaagaataccgtgtgttctgacagagcagaaacaccaccaacaaaaaatgggaagaggagagacagggagacaggaaagagaaaacacaaagaatggaattcactcactgcctgctgtggaggcaatgagtgggtgtcagaggaccccctaatgccaacacagcaggccacgagggggtacacagggaacccaggcccaaggagcatgagtggggtatgcaagtctataggaatgcactaggaaaaaagcacccattttcctaataccccaatttttttttgttttctgataaggagtctcgctctattgccaggctggagtgcagtggcacgatctcagctcactgcaacctccacctcctgggttcaagcaattctcctgcctcagcctcccgagtagctgggactacaggtgcgcgccaccacgcctggctaacttttgtatttttagtagagacagggttttcaccatgttggccaggatggtcttgatctcttgacctcatgatctgcccccctcggcctcccaaagtgctgagattacaggcgtgagccacagcacctggacaattttttttttttttttttgaagcagagtctagctctgtcgcccaggctggagtgcagtggcacaatctcagctcgctgcaacctccacctcccaggttcaagcaattctcctgcctcagcctcccaagtagctaggactacaggtatgcaccaccacacctgggctaatttttgtattttttagtagagatggggtttcaccatcttggccaggctggtcttgaactcttgacctcaggtgatctgcctgcctcagcctcccaaagtgctgggattacaggcatgagccaccacgcccagccccacaattttttttttaaataaaaaagcaaaaaaccccacaacacattttaaaaaaacccaaaaaacaaaacagtaaatagaaaatacagaaattataaaataatgacagggttgagaccaaccacatagttatatcactaagtgtgaatgggcttaactgactgaaaagaagattttcaatttggctcacaaagcaagcctcaggtttgcttcacacaagagaacgtcctaaaaccaaggcactcagaaaaaggctggaaacaaagggccaaggacaaggctgtctcgtcaggcaaatgggccgaaggagagcaggggcagcagtcacaacgcagacagagcaggacttaggccgcaggcacaaagcacgaccagaaggtggccgcttctcaacacaaaaagccacaagtaactaaaaatatataacaggaatgtgcaccaaacaacacggaaacaggagatgcaagaaaacacagaaacatattaataataagccacagaagacaggccatgaggacacaaaataaggatatacagaagactaaacaacagaattaatgtatcatggaggtgtatacatatatgtatctccatatgtaaatacatacgtacatatatatacacacacacacagtgaactctataccaagacccaagaaaatacacttctatcaagtacacatggaggagttacaaaagctgacatacactgggcctcagaaagtatcaataggttttgcaaaacaaaagcaatattctctgatcacaatgaaaaaaacctgtaaattattaacaacaacaaagtttctcctcttggaaatttaaaagctgcctattacactatcgagtgaaagaaaaaagacgcatggaaattacataatttcttttttttggagatggagtctcgctctgtctcccaggctggagtgcagcagcaccatctcagctcaccacaacctttgcctcccaaattcaagcgattcttctgcctcagcctccacagtagctgggactacaggcacgtgccaccacgtccagctaatttttgtatttttagtagatacagggtttccgaactcctgacctcaagtgatctgcccgcctcggcctcccaaagtgctgggattacaggcatgagccatagcgcccagcccagaatttctttaaaaaaaataatggaggctcggcgtggtggctcacgccagtaatcccagcactttgggaggcagaggcgggtggatcacctgaggtcaggagttcaagaccagcctggccaagatggtgaaactccgtcgctactaaaaatacaaaaattagccaggcgtggtggtgcatgcctgtaatcccagctactcgggaggctgagacaggagaattgcttgaacccaggaggcagaggtggcagtgagccgagatcatgccactgcactccaatctgggcgacagagagagactccatctcaaaaacaaaacaaacaaacaaacaaacaaaaaaggaaaaattatctatcagattccatgggatattgttaagaaaaagatcagaggaaagttccacgtgctgaacacttttatcaataaaaatggaagaaaaaacaaaatgaactgaatttctaaattaaaaagttagaaaaaaccccaagaaagtaaaacaaaagaaagcacagtggccgggcgtggtggctcacgcctgtaatcccagcactttgggaggccaaggtgggtggatcacaaggtcaggagatcgagaccatcctggctaacatggtgaaaccccgtctctactaaaaaatacaaaaaattagccgggcgaggtggtgggcgcctgtagtcccagctacttgggaggctgagtcaggagaatggcatgaacccgggaggcggagtttgcagtgagccaagatcacaccactgcactccagcctgggcgaaagagcgagactctgtctcaaaaaaaaaaaaaaaaaagaaagcacagaaagaaaataaagacgaaagcagaaattaacaaggtaggctgggcacggtggttcatgcctgtaatcctagcactttgggaggcctaggtgggcagatggcttgagaccaggagtttgagaccagcctggacaatctggcaaaatgctgttcctacaaaaactacaaaaaaattagccgagtgtggtggtgcccacctgtggtaccacctacttgagaaggtgagtggggaggatcacccgagcccagggaagttgaggttgcagtgagctgtgagtgtgccactgcactccagcctgggcaacatgagtgagactctgtcttaaaataaaaaataaaaaagaaagaaaggaggtaaagaaaaacagtaagctaggcacagtggctcccacctgtaatcccagcactttgggaggccaaggcgggtggatcatgaggtcaggagatggagaccatcctggctaacatggtgaaaccccatctctactaaatatacaaaaattagccaggcgtagtaacacgcgcctataatctcagctactcgggaggctgaggcaggagaatagcttgaacccgggaggtggaggctgcagtgagccgagaacacgccactgcactccagcctgggggacagagcgagactctgtctcaaaaaaaaaaaaaaagaaaaaaaaaaaaaaacaaaagaagaacagtaaacctaaataataaactcagatgattttaaaaaactaacaaaatacataaactattaacttaagcaaaatagggagaaaggaaaaatacacaaactaagaaatgacaggcgaaaataatcattgcaaagaaatttaaaactatgactagactaccttgcagacatctatgcaaataaatttgaaaatctagttgaaaagaataatttactacagaaagatggtttaccaaaattaacctcactagagatagaataatttccagagaggagagaagactgctagcaaggaccacagaaaacacaccaggtccagggggcttgcaaagggatttctatcaaacctttaaagcctggatggtcccaatgtgaattgttccagatcactgaaaatgtaaaaaacaagaaaatttcctgtgttttgttttgttttgttttgtttttgaggtggagtctctctgtcccaggctggagtgcagtggcgtgttctcggctcactgcaacctccacctcccgggttcaagctattctcctgcctcagcctctcgagtagctgagattacaggtgcgtgttactacgcctggcaaatttttgtatttttagtagagacggggtttcaccatgttggccaggcttgtctcgaacgcctgacctcgtgatccgcacccctcctcggctttccaaaatgctgggattataggcatgagccaccgtgcccagccaaaaacttcctaattctttttatgaggcaagtataatattgatactcaaagctaatacagacagaacaaaaacggaagtcacagacccatctctcctaaaaataatatagatgtaaatatattaaataatgtaaacagattccaaaacaaaaggatataccataatcaagtgagctttattccaggaattcaagttcagttcaatacttaaaaatcaaataatgtaaaacatcgtattaatacatctaaggagaaacatcatggttatctccacagatgctagaaaacctttgaagtttaacacccataacacccattcctaatgaaaaacactcaagagatgaggaatcgctggatttttttttaacattaaatttttttaatgtggctaattttaaataattatcttataatatataaaccttaaccctaaagccaacatcttacttaatgtggaaacaccagagacatttctgttaagatcagaaaagatgcagttaagtaaaagacaacaattagaggcgtaagaattgaaaaagtagaagtaaaactttctctatttgtacacatatataatagaatgcctggaaaaccccagagaatcaacagtaagactcaaacaataaaattcagtaaagtaaaatatataaagttaacatacaggcagggcgagggggctcacacctgttaattccagcactttgggaggccaaggagggcagatcacttgaggtctggagttcgagaccagcctagccaacatggtgaaaccccacctctaccaaaaatacaaaaactagctgggcatggtggtgtgcgcctgtaatcccagctacttgggaggccgaggcaggaaaatcgcttgaacccagaaggcgtaggctgcagtgatccaagatcgcgccactgcactccagcctgggcgacaagaatgaaactccatctcaaaaaatagataaaaattaaaaaaaataaaaaataaaaaaataaagttaacatacagccgggcgtggtggctcacgcctgtaattccagcattttgggaggccgagatgggtggatcacctgaggtcaggagttgtagaccaacttgaccaacatggtgaaactctatctctactaaatacaaaaaattagctgggcatggttttgcttgcctgtaattccaactacttgggaggctgaggcagcacaatcgcttgaacctgggaggcgaaggttgcagtgagccaagattgcaccattgtaccccagactgggcaacaagagcgaaactccatctcgaaataaacaaacaaacaaacaaaaatcaatagctttcatacacaaataaataaccagttagggcagcactatccaatagaaatacaatctgaggctgggcacagtggctcacgcctgtaatcccagcactttgggaggctaaggcaggaggatcacttgaagtcaggagttcgagactagcctggccaacatagtaaaacctggtctctactaaaaatacaaaaattagttgagtgtgctggtgcggcacctgtaattccagctactcgggagggtggggcatgagaactgcttgaacccaggaggtggaattgaacctgggaaataaagtccgcagtgaggcagaggttgcagtgagccgagattgcgccactgcactccagcctgggtgatggagtgagactctgcctcaaaaaaaaaaaaaaaaataagaaatataatctgaaatctgagtctgagccacacacaaaagattcttctaacagccacattaaaaaaaattttttttaaagaaacgggtgaaattaattgcagtaatatatttaatatatccaaaatattatgatttaaacatgtaaccaatattaaaaattatactgagatattttgcattcttttatttacactaggttttcaaaat

SEQ ID NO: 17863 - DNA, 12198 bp, Homo sapiens
cttaaacccaggaggcggtgagccaagatcccgccattgcactccagcctgggcaacaagagcgaaactccatctcaaaagaaaagaaaaaaaaaagtaaaaacaacacctaggaggtgttactattcttactttatagatcagaaatatgctttcaataattcttgtttatttatttatttttgagacggaatctcgctctgtcaccctggagtgcagtggcacgatcttggcttactgaaacctatacctctagggttcaagcgattctcctgcctcagccttccaagtacctgggactacaggtgtgtgccaccatgcctggctaatttttggtatttttagtagagatgggtttcatcatgttagccaggatggtctggatctcttgaccttgtgatccgcccaccttggcctcccaaagtgctgggattacaagcgcttgtaatcccaccacgcctggcctatttttttaaacatttgaaagtacaacacacagaaagtataactttaaggtggcataaaaactaggtgttagaatttttatctcaaccaccaagccaagctgacatttagaacaaataactggccttgtatctgaaaacagagaatactgaagtgtttgatatttccattatccctagtttgctgcaacatgttacttttcatttgatagaggtcaaaaataaaattcaattgatacaatgatttaaggatgctaaaacctgggctgtattgtttaaaaacaaaatttataacgtgaataaagaaaaaaaatatgttactagaataaagcaatgagatcatgctaccactgctccatcttcagaaatttatagttgtgaaaatcagccactgtcttgttttaaaccaggtttaatgactatgtagtagtcatcatcaagagtctgcattctatagctcaggctctcccctagccatacttggagatttaggagagtcaaagagacagataaaattttgacaaagacaatgcaatctaacgaaagtcgccttgacctaaatcagcaaacagcaaatgcttcatcattcattgtagttttacctcttgaggaagttctagtttagaacggtcagttccttcttttgactgaaggcccatcagataagggacaggagcatcaagaaaatgtagcagagaagcaggtagaatgggcacataaacatgttgccattgaaatgggaacaaaagtgtggtgatgccttctgccacagtcatcaggcgttgataatctgcacagaacaaggaaaaaggaaagggaagagtccaagtaaaaacacaatcacttcattaagctggaaaatgtggatcttaagaaaaaaatttctgcgttaaaagtaaatatttctttatgatcatacagaaaataggtcagttctattccactataattaaagaattaaatggtttcatttgaatagttttaagggggtgtgggtaggtgggaaacatcacactctttgcttcttaaaatcatgggtagacgaacttatattctcttaaagtgtggaggaatcaagaactaataaaactgctcttggcatttatcccactaaaaatgtacaagatacagtgtaacattgttattatttttgagatggagtctcgctttgttgcccaagctggagtgcaatggtgcgatcttggcgcactgcaacctccacatctcggattcaagcgattctcctgcctcagcctcccaagtagctgagattacaggcgcccaccaccacaccaggctaatttttgtatttttcgtagagatggggattctccatgttggccagggtgatcttgaactcttgacctcaagcaatccgcctacctcggcctcccaaagtgctgggattacaggcgtgaaccaccgcaccaggccagtgtaacatttttgatcatttttttatacatgaatgcttacacaattcccatttttcttttttcttttgttttgagacagtctggccccgtcgcccaggctggagtgcagtggcatgatctcggctcactgcaacctccatcagaggcttttttcttacacagtatatatgactgtggctatagctttggttagctgattatatttattttagcctttattttgggggtacaagaagtcaaacagatacatgcattcatagttacactttctatgtctaacccctagccacaaaactatcatatctgggtattctcgagttaacagaaaattaaggattagtgtttttgttatgttttatttacatgaactcactagtttatcaaaattaaaagctccccacaatagtaaagcagccttttaaaccactctgcaaaggctgctttatacttacatatgtccacaagtccgatttaaatgtttggaagtagatatgctttagaattcagattttttaatttagaaaagcagtatggtgcatataccacatatatgaactatctagggcagtatcctataattaaatacattaatatttctgcagcaaaccatatatgtcccagtaggacagataatcaaagaatatgaatagggtcactttggttcaggtctggttttgctgatgaatgagttacaaaaagaatgtttggttttcagaattttttggatttgtagaattgaggataatggattgtgggcttgtaataatcctttcacagaacccactgtgaacaaacacagtaaaatctttgggaggaagaatttaggggagtctttttaaaaaggttaagaaaatgatcagatgttacttgagtcacatcaactcaaagacctgaccaagcataaacaggatgttttccatttaaattttttgtgtcattttataattttaaatgactacctttttggtaatgaatcatcagttatccacagcccaagtttacttaaaattttccttatttgattcataaagattcaaattttaggtgaaaatctgtttataggaataacttctagaacaaacaccaggtggcctaaaaggtaggggtcagtcatacgagcacaaagagctaacctaattacctggggtggatacacacattttacagccaaggcccactgaagaagctaggctgagacagctggtactctctgtgcaggtgaggcgggtagtagaggagatcagaaaatcagttcctaccactctgctaggataatcaggcagatgtttgaactgtaggcaatatgggtcttttatcccaggggcgggggcggggtgaggatgaaaagctgacctgaaacccctgaggtcggctggatggcccctagaagtagaaactgtgccctaatcagaactaattgaagttctgcactatcacaggactccattatggcacttggcccccgtactgtctctcctctctgtgggtttcctaaggacagagtggcatccactttctctgattttacccataaagcatagggcccacttcacacccagtgctgactaaaatttactgataactactaaatgttatgttttttttcctcttaagttcaacagaatcctaacaaaatacaaaaaaaggccgggcaggcacagtggcttatgcctgtgatcccagtactttgggagaccgaggtgggtggattacctgaggtcagaagttagaggccagtctggccaacatggtgaaaccccatttctactaaaaatacaaaaattagcagggcatggtggcaggcacctgtaatcccagttacttgggaggctaaggcaggagaattgcttgaacccaggaggcggaggttgcagtgagccgggattgcactactgcactccagcctgggcaacagtgagactccgtctcagaaaaaaaaacaaaaaacaaaaagccaagcacagtggctcaagacctgcaatcccagcactttgggaggccaaggcaggagaatcacctgaggccaggagttcaagactagcccgcccatcatggcaaaaccctgtctctagtaaaaatataaaaattaggcatagtggcacatgcctgtaatctcagctacttgggaggctgaggtacaagaatcacttgaacccaggaggcagaggttgcagtgagctgcgatcgtaccactgcactccaggcctgggtgacagagtgagattctgtctcaaaaaaacaaaaaacaaacaaacaaaaaacccaacaacaacaacaaaaactcaccaggagtaggcagagacagtaatttacagttatagactatgaagaccaaatccagagaaatctccttagattctgctctgtggccatcatttcaaccaaggattggggccttttatattcttgtaacctcagtatctaccacagtatctgacatataatagaggctaaaacaatatttttgaacgaatagatgatgatgggataagaatatatataattttgctagatatctataacttaaaaagacatgcttagattttattccatccatgtgttgtgagtgttctatgtctattcttctttccagttctgtattctcttcaagactggttgaagtaccacacacattattaattttttttttgagatcgagttttcactcttgctgcccaggctggagcgcaatggctcaatcttggatcactgcaacctccacttcctgggttcaagcgattctcctgcctcactcagcctcctgagtagctgggattacaggcacacgccaccacacctggctaatttttttggatttttagtagagatggggtttcaccatgttggccgggctggtctcgaactcctgacctcaggtgatccacacgcctttgcctcccaaagtgctaagattacaggcgtgagccactgtgcccagcccacacgctttttaataatgcaattactcagcagaaataagacaattctttttaactgaatcaagaaataaaaggcagagttttcttctttaagcattttttttaaacttaaatattttaggaaagtctttttataattgatactcaaagtgatgaatgtataaaagaagttattttaatatttaagacaggcctcagcaaggcacatgaggctcttcatgatttggcccttgtctgcctcattccttatcatcactccatatgcagtaagaccacttgcttgcagtccatgttttcacaggccttgtgccccttgtatattgttttcctctgcccagaatgtcccttcctcttgcactgcctgactaggttccactttttcctcaggcaattgcttctttggaaagccttccctaacacttcttattatcaccagagtactatctacatgcttcaacagtaccctatctttatttccatcccaggaattattcatctcactgaaacattacaattctatcataattctctcttcatggtctctcttccccaataccccatcatctcctagagagcaatatatgtatttttctttttatttatttatttttggagacagggtctcactctctcgtccaggctggagtgcagtggtgcgatcttggttcactgcagcctctgcctcccaggttcaagtgattctcatgcctcagcctcccgagtagcttggattacagctgtgcaccaccacgcctggctaattttttgtgttttttgtagaaaggggtttcgccatgttggccaggctggtcttgaactcctgacctcaagtgatctgcctgcctgcctccgcctcccaaagtgctgagattacaggcatgagccactgtgcctggacatatctgtatttctaatctcagaattgttaacattcaacatatgacctactacatgatgagtagccagtaaacgtgctttgagaaattaatatgttaacatctaaggcatgtaaaatgaaataaaagtagacattaaaaaattatgcttgactatattatacaataaaaacatactgtcaaaaatgtgcctagtgatggctctggcacagatcccaaggtggcaatggcctctgctgcctcagcccctgccatgctgtccaccagcatcactgtggagaataaggtcagcycctcaagggcaacagaggggtctaggtctggacctgtggctggcggcacaggagccatggtggtgcagaccagragctgtgtctagcaaggcttatgccctgccaagcactgccaatggagatgtgaagctgctggtggtatccagcaygcctctggtggacttcctgatgtagctggaggattatacacctatgatcctggatgctgtgactgattattttttatttttgagatggaatctcgctctgttgcccaggctggagtgcagtggcatgaacttggctcactgcaacctccgcctcctgagttcaagtggttctcctgcctcagcctccccagcagctgggattacaggtgcacaccaccatgcctggctaatttttgtatttttgtagagacggggtttcactatgttggccaggctagtctcaaactcccgacctcaagtaatccacctgtctcagccttctaaatgcagggattacaggcgtgagccatgcgcctggcccaatgtgactgagcattatctgaattatgttggctttgaggtctcagacacatgcataatttggcttatctccctagtttcacagaaattcatctcaggtattgccaacaatgacctacggcactagaaaatgaaaggcacagcctctggcagctcctgaagtaagagcaaagactaatcatggagtacttgacccctgtcctcagtatgacatcaatgtggagccaccacaccacctaagccacccaacctaaacatgtttgtctgtaacaagcttcactgtgaccaaaaaatgtcaaagaaagggctaattgtagattaaacacaggtaaagagagaattcataaagcaggagacagatgtggagaaattacccagaatgcagcacagagacacacagaaaattggaatgaggctgggtgtggtggctcacgcctgtaagcactttgggaggccaaggcgggcggatcacaaggtcaagagatcgagaccatcctggccaacatggtgaaaccccgtctctactaaaaacacaaaaattagttggtcatggtggtgcacacctgtggtcccagctactcgggaggctgaagtaggagaaccacttgaacccaggaggcagagtttgcagtgagacaagattgcaacactgcactccagcctggcaacagagtgagactccatctccaaaaaaaaaagggttgagagataatggaagattgagcaagacagattaacatgtttaaggctggacacagtggctcatgcctgtaatcccagcactttgggaggccacggcgcgtggatcacttgaggttaggagttcgagaccagcctgaccaacatggtgaaaccccgtctctactaaaaatacaaaaattagctgggcatggtggcatgcgcctgtagtcccagctactcaggaggctgagacaggagaattgcttgaacccaggaggcggaggttacagtgagcagagtttgcaccactgtactccatcctgggcaataaagtgagactctgtctcaaaaacaaaacaacaacaacaacaaaaaaaagtttcactagaatttcaggaggattaaaaaaagatacatgaatgcaatatttacaaagatagttgagaattttccaaaatgggtaaaggacattaattcttaaatttcaggaaacataatgaaccacaagcagaacaaataaagcctcattcagataaatcagtcaaaatatcacacaccaaagacagaaaatcttaaatataaccagagttgaaaagacagatttctggctaatgagtaacaatgagagtcattcattagaatgacattagaggtgatggctgacttctcaacagcaatacaggaaaccagaagatgatagaatattatcctcagagttctaagagaaaaaaacttttaacatataatttaacatccaatgaactatttaagatgatagaatattatcctcagagtactaaggaaaaaaaaaaaacttttaacatagaatttaacatccaatgaactatttttcaaaaacaaggacaaaataagatctaatagagaaagctatctcaggaaaggaacttctaagaacacatgttaggaagaagactgatctcaaaagaaatctctaagatatgaaataaaatgtgaattttcaaaaaataataactgaggctgggtgcagtggctcacacctataatcccagcactttgggaggctgaggcagaggactgcttgagcccaggacttcacgaccagcctggacaagacagtgagacccccatctctacaaaaagaaaaaaaaaaagtaagaaaaaaattagcccagcatggtggcgtgtgcctgtagtcccagctatcaggaggctgaggcagtaggattgcttgagcccaggagttcagtcgcatcactgcactccagcctaggcaacagagtgagaccttatttcaaagaaaaacaaaataaggtcactatgagtaaatttaaacaaaaccaagtgtatagaataaaaatgtctaatttgagggattattaaaactgaacaatcataacaagtaagccacaatgggcatggagttaaagcattttatagttatctgtgaagattctataacataagagtaactgttcatgttgaaatctcaaaatttatcattaagaaaaagagcatataacatctaaacagaaaaaactgcaatgagaaaaaaatttaaatcaattcaaaacatcaaaaacagagagagagagaaaagcaagacaaatggccaaaataaatgaaattttaaaaattcttagaactagccaggtatgatggctcacacctctaatcccagcactttgagaggccgaggtgaaagaattgcttgagcccaggagttcaagaccagcctgggcaacatacagagaccccacctctaaaaaaaatttaaaaattggccaggtgtggtggcatgcacctgtagtcccagctacaagggaggttgaggtgggaagatggcctgaccctgagaagttgaggctgccataagctgtgatcacaccactgcattccagtctgggcaacagagcaagaccctgtctcaaattatttatttatttatttatttttagaattcaatgataatgaaagtatcagatactaagacttgtgggatgtagctaacacaggactcaagtgcttaagatactggttttggtgggcaggtggggagaaagaaaggtttaataagcccaaaaaaagtagtagaaagaagtgaataataaaaacaaaaccataaattaataaaacagaaaacaaaggtacaacagaagataccaatgaaagtaaaatctggttctttaaagagtaatagggctgggcacaatggctcatacctgtgatcccagcactttgggaggccaatgcaggaggatcgcttggacccaggagtttgggactagtctaggcaacacagtgagaccctgtcatttcaaaaaataaaaaaaaaaattagccaggcatggtggcacacacctgtagctccagctacgtgggaggctaaggcaggaggattgcctgagcccagggaggtcaagactgcagtgagcctagatcgtgctactgcactccaggatgagcgacagggtgaggccctgtctcaaaaaaccaaacaaacaaaaggaagtaatataattgacaaacttcaggtaaaaataattgggggaaaaagagaatgcacaaacagtattaggaatgaaaaggaggacaaaactacagatataacaggggtcaagaaaacaaggaaatattaagactttttgctaatatattgaaagcttaataaaaattttcttagagaaaatagcaaggaacaaaaatttattcaagaaaaaaatagaggtggccaggtgcattgcctcaggtctgtaatcccagcacttgggaggccgaggcaggtggatcactggaggtcaggagttcaagaccagcctggccaacgtggtgtaacttgtctctactaaaaatacaaaaattagctagctgtggtggcatgtgcctgtaatcccagctactcgggaggctgaggcaggagaatcacctgaacctggaggcaaaggttgcagtgagccaagatcacgccactgcactccagcctgggtgacagagacagactccatctcaaaaaaaaaaaaaaaagaagaagaagaagaagaagaaatatagaggagcttctggactggcaaatacattaaggtgctgggtaagtccaaggaaagcatagcagttctgcacccacccctacaccttttgcacctctcttccatttggctgtttctgagttgtatcctttataataaaccagttagcaataagtaaagtgctttcttgagttctgtgaatcattctgggaatttatagaacttgaggggttgggggatggtgttggggaacccctgattttgtagtcatccaagaaaaaatgtatgtggcctggtgctacggtttggacatggtttgttggccccaatgttggaggtgaggtgtttgggtcctgggggtggatctctcatgaatggctttgtgccattctcatggttgtgagtgagtagtttttcactcttactttccatgaaaattggttattgaaaagagtctggcatctccctcctctctcttgcttccttcctcttgccatgtgattctggctccccttcacctcctgccatgagtagatgcttcccaaggccctcatcagaagcaggtgctagcacatgcacagaactgtgagccaaataaacctcttttatttttctttgagacagggtctcgctctgtcacgaggctgtagtgcagtgacataataatggctcactgcagcctctaactcctgggctcaggtgatcctcgacctcagcctcccaagtagctgggactacaggcatacactaccatgtctggctttttttttttttttttctttggagatggagtttcccttgttacccaggctggagtgcaatggtgcgatctcggctcactgcagtctctgcctccagggttcaagcgattctcctgcctcagcctcccgagtagctgggattacaggcatgcaccaccacgcctgggtaactctgtatttttagtagagatgaggtttctccatgttggtcaggctggtctcgaactcacaacctcaggtgatccacccacctcggcctcccaaagtgctgggattacaggcgtgatacactgtgcccggccttatttttaatttttttgtagagacggggtttcaccatgttacccaggctggtcttgaactcttgggctcaagagatctgcctgtctcagcttcccagagtgctgggattacaggtgtaagccactgcaccaggccaaacttcttttctttataaattaaccagcctcaggtattttatagtaacacaaataaaccaagacacctgatacctcatttgtggctggcatcagaagtgaggacagtcttgtgagaatgaactcttaaacctgtggagtctgacattcagttaggaatgaattgaactgttgggcatccagttggtatcacaaattgacaggtgttggggaggaaagactctctcacttggtgtcagaaaaactgagatttgttataacagcccaggctcatggaaacctgtggtttgggaagagggacaatgagagggtggggaattaggaacctttaattcctgggtggccactcatgggatggagcagtagctgtgctgagaccatttactgaaggtaaaagtaactaatggaatttagagatgaatccacctcccagggagtgggattcactggatatataaggaaatgcaaaccaacagaaaaaagttaaatataaaatcccttggttattgttctatgtaaaagctaaaatgaaatttaaaagagtgctaggtcaaccttgatgctggaccaagctcagatttctgctggtcagggcgtgacaactagcctcaaagccactcccaacgggaaaaattatgtggaaaccgcctgggcatttcctcaccaacacccttaggtattctgtagtttcttggttttgtggttcccccatgtggagtacctttctggtgaccagagatcttagagacactctttgttgtttccacataattttgt

SEQ ID NO: 17864 - DNA, 152165 bp, Homo sapiens
  misc_feature (1)...(152165): n = A,T,C or G, or insertion/deletion polymorphism (see Tables 1-2)
aactgtctcaaaaaaaaaaaaatcaaaataatgagatagagtatgttaaaatgtctagctcagtgtctggcacacagaaacaatgagttacatatattgaatactttctatgttctagggactgtgctaagcactctacatgtattatctccttcaaacttcacaataacttaattttgatctgcactggacaaataaggaaattaaagctagagtaacattaagcagattgtcttatagatactaaaagaagtgagatttgaacccaggtagtgagagtctggaggttgtcccctttatcagcacaccaaaccaccccaaaacatactggttgaaaaaaaaccaaaattgaataaaatttttgtaagaatttggatcagtccttgtcaatcaaccaaaatgagtagaattttaggaaatgtaaagttttgaaactttacaaaagtttttgaaaatgagtaggatgcaataaaaactggacataaatcttttggctcttttttgtttgtaaatagatttgtgagtacaattttatttatttatttatttatttatttgtttgtttgtttgacagggtcttgctctgttgcccaggctggagtgcagtggcacaatctcagctcatcaaaacctccatctcctgggttcaagcgatcttcccatctcagcctcctaagtagctgggaccaaaggcatacgtcaccatgcccagctaagaggtacaatttatatatattaaaatgtatttgctagccaggcgcggtggctcacgcctgtaatcccagcactttgggaggctgaggcggacagatcacctaaggtcaggagttcgagaccagcctgaccaatacggtgaaaccctgtctctactaaaaatacaaaaattagccgggtgtggtggcgtgcacctgtaatcccagctactcaggaggctgaggcaggagaattgcttgaacccgggaggcaaaggttgcagtgagccgagattgagccactacactcctacctgggtgacagagtgagactccatctcaaaaaaaaaaaaatgtatttgctgtaagagtacattgggttttgacaaatatatctgtctgtgaaagcactaccacaatcaaggtacaacattttcccattgctccggaaagctccctcctgcccttttgcagtcaatttcccaccacatcacctctggccccaggcaaccactgatctgcttcctgcccagtctagaatttcatatgagtagagggatacactatggactcctctgtgcctggcatcttttgcttagcatatttttgacagccatgcaccttgtggcatgtatcagtggttcattcctctttactactaagtagtgttcccttgtatgaggataccaatttaattctccattcatctggtgatggacatttggcttatggattagtcaggagatagaaaccagtaatttgaacacgaaaatttattataattgttagctagtaaaaagtggttaacaacaacaaggggtaaaagagggttctaaggtggctcaaacctgtaatcccagcactttgggagactgaagcaggtggatcgtttgagcccaggggtttgagacccgcctgggcaacagggtgaaaccctgtctctaccaaaaatacaaaaaactagctgggtgtgattgcacatgcctgtgggtggtcccagctctttgggaggctgaggtgggaggattgcttgagccagggaggtggaggctgcagtgagtcgagattgtgccactgccctccagcctgggtgagtgacccgccacccccccaaaaaagagggctgtaagggatcgagaagtagcaaatacgatgaggagaatggactctccaaaatatttaagtcgtgttaaggagaggagaggttatttttctcttttgatgctatgacaatccttgtcaacaccgttcttcaccaccacactccagccacatataaacaaccaagaaagaagggattgattgctaatgtaactatttagagcccaaaacattcattggaccacattttactggtagtcagagtcaccatgtgccaccagcttagcagtgctatcaatctctcattcctccacttccgcagaccgtggcaggactcagctatcccaagcatgccatgccgtccatttgaggctttaccagtaagtcctttggagacagcagatcattgctcagatttttgttcactgagctaatttacttctctgtcattatttcagaggacaatctgcatataatgatacatagctaattcttgagtatcctttcaacttcgtttcattgtagcttaatgcagaatatacttacacagtgtcatcctgaagtgataattaaaaaagtatacggatattttcaaattagtgtttaattttgtaatgtgtgactattttcctaaaagctttaggaaagattttaggaattctatttttatgagattagtatattttaattgcatgcattgtttgttggtgattcaatttttttcaccttaaaaatattaatgtggggcttacaaactcataaatcagttactggtcaaatttaaaaaaaaaatgacgtgccttggctagtgcaaacagtaaatcagtttttttactgtgtttgtttgattcgcttggaatctaacaaacattctgtaagaagttaccaccgaagacaggagaaacagatacctggcacttccttccttactaatgaaatgttatgcatttcagtactttctacgtgaggaaaagcaatattgcataagagtaattaaagtgttcacaattaggtccatactctggtttctcttcagatcgtatacgtcttttgtcttttactaaagatttccgtggaagggaacaattctgagtttttgactaagttttgttttgttttgtttgagacggagttttgctctgttgcccaggctggagtgcagtggtgcgatcttggctcactgcaacctctgcctcttgggttcaagccattcttctgtctcagccccccaagtagttgggactacaggcactcaccaccatgccaggctaatttttgtatttttaatagagacagggtttcaccacgttggccagtctggtcttgaactcctgacctcaggtgatctgcccccttcggcctcccaaagtgctgggattacaggcgtgagccaccgtacctggcctgaccaagttttgaggccttgcatatgtggagcttatttttatttttatttattttttaatctttattttattattattttttgagacagagtctcactctgtcacctggagtgcagtggcatgatcttggctcactgcaacctctgcctcccgggttcaagtgattctcgtgcctcagcctcccaagtagagctgggattacaggtgtgcaccaccacacctggctaatttttgtatttttagtacagacggggcttcaccatgtggatcaggctggtctcgaactcccgacctcatgtgatccacctgcctcggcctcccaaagtgctcggattacaggtgtgagccaccatgcccagcccaggacttattttttaaaaaatgttacagatattaaagtttgtatatttttctggtagaatcaacaacctgttatcacctagataactgctcttctttcaacactcaaatataaattgaggggctaaataggaccagagttctgctagataccagaaaagtgaagaaccacagagtccaactcttgctctgtggagtttacaacacagctaagaagacacagaaaagccattacaagtgtttttgaagaagtacagggtgcaacatgacctaaaggtcaattacccagactgtggctcaccctgatttcttgattcttcttgtattttcttttcttttcttattttttttgagacagtcttactctgttgcccaggctggagtgcagtggcgcgatctcggctcactctaatctccgcctcccaggttcaagtgattctcctgcctcagcctcccgagtagctgggaccacacgtgcgtgccaccacactggctaattttttgtatttttagtagagacagggcttcaccatgttggccaagatggtctcggtctcctgacctcgtgatccgcccgccttggcctcccaaagtgctgggattacagacatgagccactgcacccggccaattcttcttatattttactaattattattttattgattttttttttttttttttttttttttagtagagacggagtttcaccatgttggccaggcttgtctcaaactcctgacctcaagtgagcctctcgccttggcctccgaaaggactgggattacaggcttgagccactgcacccggcctcattttatttttatagagacagggtctctcactattttgcccaggttggtcttgaattcctggactcaaatgctcctcctgccttggcctctcaaagtgctgggattacaggcctgagccaccatggccagcctctttcatttcaaaattgaagaaagaaagtgaagatacaagctacattaaatgatggtatgcacgcacatgtatcttctaggaagaacattattcagtcaaataatcgaggttctctcaggcaacctctctggaaggtttgcttgtatgtctagtggtagatgccccaaatccccaaagaagaaagcagggagtggtgtggaaggggttgccatgtggagatgaattgcattcagttttctatcttttaagttttatttttacttacatggccgggcacagtggcttattatgcctgtaatcctagcacatttgggggccaaggcgggaggatcacttgaacccaggagtttgagagcagcctggtcaatacagtgagaccctgtctcttaaaaaattattttttaaataaataaatgttatttttttacttagatggagacagagtctccctctattgcccaggctggtcttgaactcctggtctcatgtgatcttcctacctgggcttcccaaagtgttgagtaaattacaggtgtgagccactgagcccagccagttttctttcaaaggaaaaagaactggttgtcgagttccttccgagaaggcaaaagacagctgagcagggcaagaaagccgtgcctttgggaggagcagagttcatggtctaattcctgttgctttagcctccgattgttacttgcggggagagccgataacatcggatgggtacagggctgcggaactggagcgccttggctatttacactgacctggaaaatgtcaggataaatgacagaaggcgggggttggtgactgcactccttctagaagtctcaacgctttgtgggtattgagttgtgttttttccccctcacggttgacttgtcactaagtcactaaggatggcctgtaaatggggtgacggctgggggaagggaggaccttaaagtgagacaggcacccccacacaggtcacagtttaaaagacgatggttcagaccgttatgcgaaatgatctcagagcggctgttcaccttccccaaagctgcattaaaagaaataaggatgggtgacaacccctttagaagacagacccccacactgaggctagccctcttatcggctggccagggcgaggaggggtgtgtgcagggtcgccctcgatgccgcagccggggccagtgggcacgaatgcggccccacgccaggcttggcctccgaacccgctaggcgcgcgcgcacggtagaagcgcgcgcctccgtccctcgcgagcgcgccccccacccctctccgtcgcacgcgccgagccccggcgcccccgcccgccccgcgctcccacagcccgagcgccgctcagctgacccgcgggcgccagacgcggcggctctcagctcgcgagcgcagctgcggctgcgagggcctctcaggccgacactccccccgcgcccctcccccacccggccgggctccggacccgccgcgcgcgagcccgcggccgcttcccccgcgccgagcgaggaggcaggctgcggcggcgagaggcggctgcgcggccatgggcgcgccagtgtcgccctagggcgggcgcacagaccacagccggagcggtggtggcagcctccgcagaaagccttcccgggcggcggcggcggcggcccctggagcagcgcggccgggatgagcgggagctgcgcggcgcccggcccgggctcgggctcctccccggccgcctgccgcttcgcgcactacttcgtgctgtgcgggatcgacgcggacagcgggctggagcctgacgagctggcgggtaaggccagggctgcggcggcgctgagccccctcaggggcgcgggggacgctgtggggacgcgcgggaggcggggtgcaggctccagacaaagtcagctcccggtggcgccctcccgccgctttctggccgaactggcgctcgggcgcgatttaatgacattgttatttattccgcgtgcgggctttgcggctgcgcccaccggggctttcgcctccaggcgctgggttattaataacaggcgcgggggtggccccaagggcacggaccccgcctggcgcgccggccccttcgcytgcagccgcactcggaggcggccggtgagtcaccgggcgcgcrggctgccccccgaccgccgtgcctgcctcccacccgccagccacccggccccggccgcgaagtttcggccccgcacgtgacgcggctttcgggcctcttcgggagasggggagtcggactcagctcggctcccgccggggtagcgtccgcggaggagccggtggccgtgcggagcgagcgcggggcggggaccggtcggactctgccctctgcgccgcctgccgctctgcggtgccggccaagtcaccttttggaatcctgtggatttggccgcgtctgggagctggcagggacctttggacgctcgggacccagcaccgcgctttgttgacactgcctacactgttcccgagtttaaattcagttgggtgcaccgtgtgttagtgcctggttttcccggaggggtaccggtccttccgcttgactcatttgatggcgcagtgcggggctgtgctgggcaaacgacgccgttaaaaggggccgctaaagggcgatgggcgggggcagggcagcggagtgcgcagtgtcgagaggaggccggggagaaacaactgatttcatttttcacgcctgttcctttctgcttgcctccgcgggatctgaatcttgatttgttgttgttgttaaatgggtgagagaagtgacatctaccgcctgaactttgtgttaaagacttaggtcatagcctttcagaacaacttcctttggacaaataattccttattgattgcactaacgtaaatttttcgcttttcctttggtgggggtggggagactgggaagaatatattaaataataaacaatagtaaacaaaactgttcagccttaaaatacagyccccatcaacccacgtcttggctatcttcttcttaactcagcttcagagcaaaacattttctttttttcatattcttcggaggtagaaacacaaaacattttcaacaaaaactgtaagtctagttttagttaaaaaaaaatttggagagataatagaataccaagtttttccgtatgtgtaattatgtaatcacattgtttcttcaactaagatttcatgtacatgttaagaatggctttgttaaaggatatgaagaaaaaatgtctgcagagagatttggagagattcttctcgagattggtgaaggaatattgttatttttctagactcctttcttccctaaagatcctaaacatttgtggcaccagggtcacttggaggccttctgtcagtgatgactaatgaaaggaaaaaagcctgtatttttcttttccgtttgcctactgaagctaaaactgtaccttttaggtgtgacctaggactctttaggcacagagagaatgatgttaacaaaaccatcaattagactttaatgcatttttaagaaacaaactatgatgtctctttttgcaaaactgtgtgagtgtgggtgattgggatttctgcttctcataatatttaatgtattcaggtaataatgtattttgccttgtaatatttcagtatcattcatccaacagttttgaaagcatctatctgtagtcggttttttaggcactggggacagctgtgaagaaagcagtcagaaatccctgccatcatggagcatacgttcnagtgtaaagagataatgaaaatacaatcatctctccrtaaccatgggggatggattctagagtgtcccccacaccaaaatcctcggatgctgaagtctcttataataaaatgttgtagcatttgtatataacctatgaacattttcctgtacactttgtcatctctagattacttacaatacctgttacgttgtaatgttatgtaaatagttgttatactgtattgtttagggaataatgacaagaaaagaagtctgtacatgttcagtacagatgcaaccattgtaggcctaactacattttcaatctgtgcttggttgaatctgtggatgcggagtccacgtgaagtgccgactgtatatagttctccagatgttaataagtgctatgaggaaaaataaagcaggggagtggatttagggacatgccagcagagtggtgggatggtggggttgtgattttaaataagatggttagggaaggcctcacagggagggtgacatttgaacagagccttgaaggacatgaggaagcaggccagatggatcacctgggggcacagcattgcacgcagaagaaacagcaagtgcgaagaccctgagtgggacagtcmctagtttgtgctggtaacagcaaggagtccagtatggctggagctgagggagagggagagtagtaggtaagatcaaagagaaagggcaggggagattgtatagggcctcatgcagtttttaggcttttaactctgagatgggaaagtattggaaggttttgagcagagtaatgacaagatctgatgtgccttctaaaatgactgttgtggctgccatgttgggtagactatatyagggcaggggtagaggcargagaccagttagggagctctttcagtatttgaggtgagaggctggatgctgtggctcacgcctataatcctagcactttggaaggccgaggcaggtggatcacttgaggtcaggagttcaagaccagcctggccaatatggtgaaaccacatctcacctgaaaatacaaaaagctgggcgtggtggcacatgcctgtaatatcccagttactctggaggctgaggcaggagaatcgcttgaacccaggaggtggaggttgcagtgagctgagatcgtgycactgcactccagcctgggcaacagagggagactctgtctcaaaaaaaaaaaaaaaaaaaaaaaaaaaaaggtatttgtggtgagagaagttgttggcttggtgaascagcaggaaggactcagattctagatagatgttgaaggtaggcccaacgagatttgctgatgatttatatgaatatgtatgaattctatgaatatggtagtcatattcaaagaagtgatcaaagatgactccaagattttggggctgaacaattataaacttctctcctgaaataggaagactgatggagaatcagactggaaatcagttcagttttggatgtattaagtttgatgtgtccattagacattcaaatggagatgtcacatagacaagacatctcttgggggaagatctggactgtaggtataaatttaaagccatgaaattacttaagggttgagtatagatagaaaagagaggaggacacgcaaatgattgagccctggggccattctagcatgcataggtggggaggatgaggaggaggaggcaaccgaggagattaaggagtgtggatagtgacatggcaggaaaacaggagaatgtcatatcatgttctcaactaagaattttcttgactatttcygtagagcaacatttggggatcatgaaactgtgttaggcaaattagccagaaggtagtttctgttttgctgcattaatttcaaagttaatgatagtcaagtttctattttgccttgctggagctgatctgtctttatcacactttcttagcaagttgtcaccgtgcctctagaaggtcttaattgacttctattaaacataaattctaccagttgcttcatagactttcttaacatacgcatattcctagaattcacactctgcaggtggtgggacattgaaatcaaagacaacaacagttaaatagactaagaccttataataaaacttatcaaggcttcaaatggtttttagaccctcctagtaaaaccaagcttaaacagcaatggaagagacttctttcatctcaaatacgtagaactcttaatagctgaaaataatttaactatatacataaaaatatattttaaaatggaggacttagaaactttatggtgatgtccacatgtatatactgatatactcatattacctgtcgtcctttctgtaccacatcgaagttcttgtgcttctcctacccactgtatattttcaagaggtactttgcccatgaacaaaacgtcctttgggagaaatgtttaaattccctttaaatattaaagataaggaaaaggtttcaaaacgagattctttattgcatgtagaagaaaggaggtataaatggaggtaaatcatgcaattagttgatgtcagggaaggcagacatcattttgaaatcttattttatagcttttatttcctttaagacctggctgtaggagtacacatggcttaatttacagcagtcaatcttttgagcaatgggaaaatgaaggacatgataaggccttgattaagtaaaataaatatacaagccctctaagagagaagggactttgcctctttcgtagtaccttatatacagtacacagtgtttaataagggaatgaatataagtttacatgagtctacaaattatgtgatgaccagaatattcttaaagtgttcccttggtagcctggattcagccctcctaatagttgtcgaagtctgatggatgagatctctgccatagaactttgtttagatcttttccttagtgtctctctctagctatttttagctttggttgtgttgggtgtggttttcaaaagagcgtagagacggtggagaccatgatctgaattcaaataagcagaacatttagtcaagactgacagaatatcatgtcacgttagttmttgaagggaccttagacatatttatggtaaagagactgaggctcagagattaagggccctctcagattacatttgatcagcagtagacacctgactagtgcctggtggttccagtccactatgctccatagttattctatttaaactcagaaaaaagatgagcttgactcattcaacaagcatttcaggattgcccttattccagactgaatgtcatagtcaagactgtgctgaagtgtgttttttaaaaacagtggccgggtgtataggcttaattgggatagaagctgccgtgatccaaataccattgatactgtgtcaattgttagctttgttgacatccttggctcacaataggttcttgggagtttggaaggtctgccccgggtagctcaggggctggggaaggagtagtacagggatcagccttcattttaatgaggccaaagaagattcaagatctggttgctgtgtgctagtttggctctttgtccccaaacctcatgttgaaatttgattcctaatgttggaggtggggcttattgggagatatttgggttatgggggcagatccctcgttaatggcttggtgccctcctagaggtaatgggtgagttctccctytatgagttcccacaagagctagttgttaaaaagagtctggcaccactcccctaccctcttcgttcctctctcttgctatgtgatctctaattggctagccttctgccatgagaggaagcagcctgaagctctcaccagaagtagatgctggcgccatgcctcttgcgtagtatagccgccaactatttcttttctttttctttcttttttttcggggagggtgggtggggggtgtgggacagagtctctgttacccaggctggagtgcagtggtgcaatgttggcttattgcagcctcaatctccttgggctcaagcagtccttcacctcagtctccctagtagctgagaccacaggcatgtgccaccatgcctggctaatttttgtattttttgtagagatggggttttgccatctctacaaagatgttgcctaagctgatctcaaactmctgagctcaagcagtccacccatccttggcctcccaaagtgctgggattacaggcagtgagccaccatgcctggctgcgccatttctttatagactacccagcctcaggtattttctttatagcaacacgaaaacagactaagacactgtggtataatgatcatttaattttggaaatctactggaaataaaactctttatagtgaaattggcccaagagtgagtgaagctaaattctctgtgataaccccaaggctcaggcttatggcccattttgttaatacaggacacaccagcatagacaactgggaagacaagggaggggaagagggtgagacatagtgtctttgagggaggagagaaagggaaagaaaaggggacagggagagagaaaggaggctggaggagtacaagttctgtttgctgctaaggtgttaagacagactgtyctaaaattcctgtgcacatccttttgcttgtatttccactgttggtcacagatactctcagagtaataaaagtaaatatctagaatacaatgcattgttagtcatgatttccataaagcttcatacggaagaaaacaatttcctcttctataatttactgaatggtagagatggttctatacaggatgctttaggaaacgtgccatatgcctgatccttagcatttttgtttaataatgacctaaattttgtttttggtaaaaccataactagctattatattttggattatttaatgttaaatgcttacagtgtgtcagattctggagtacatacgtaagyggtggccactgtcctataagaatctrtgatgaaatagtaaaatagctaacatttatagagtgctttccacatgccagacactgtgctaaattcktgttgttgttgttgtttgtttttgtttttgtttttgttttttcccagacacagtcttgctctgttgcccgggctggagtgcagtagcgtgatctcggctcactgcaacctctgcctcccaggtttaagtgattctcgtgcctcagcctcccaagtagctgggactacaggtgcgtgccaccatgcctggctaatttttgtattttttggtagagacggagtttcatcatgttggccaggctggtcttgaactcctgacctcaggtgatcctcctgcctcggcctcccaaagtgctaggattacagttgtgagccaccccacccaaccactgtgctaaattctttatagtcagtacctcattcagtctggacaacaaccttaggaaataggcattcttttctctctctctctcttttttttttttttttaaaagactgagtctcactctgtcgcccaggctggagcgcagtggcgctatctctcctcactgcaatctccgcctcccgggttcaagcgattctcctgcctcagcctcctgagtagctgggattacaggcacacgccaccacacctggctactttttgtatttttagtagagatggggtttcaccatgttgatcacgcttatctaaaactcctgaccttgtgatccacccaccttggcctcccaaagtgctgggattacaggcgtgagccaccacgcctggcctgttttctcttttgtacacaggaggaaactgagtctagagaatgaatactttacttcagttcctataataagtaagaagcctggattgaagatctgtctgacataattcatccatacccataacatccatacccataaccactatatttgctgtctccctagtaacatatgctgtatcatacagattgtaaaatctaccagaatatagatcccaaatgggtaaccttatcgtcaagtgaaattatcttcttattcctctatatgggaaagatattaaaggcgacactatcgggcaggcctttatgacctgacctagcttgtttcttctttggtcagcactagtaatttctcttgcatgcatttcctcattcattcatcacagatttagatttagaagattatatatttaatgatatttttgcttttgtcaatgaatatttttaaagataaggtgttactgtataaaggcttttactatgaaatataccacttttaactttttaaaaaacctctttgctcttcttactgggttttatcatttcttagcataaataatttgtcattaggtgagtttatagttttttaaaggaatgtatgaatgcttgtgaaaccatagctggcagggcagtgagtacagcagttagagctgaatgcacagtcagaagctgagattccattcctggcctgtcacttatgacagccgcaggcatcagtgttctcgtctgtcttgaaaagggttaaatgagatgaatgatttctaactaccacccttggggcctgaaattgtttttgagtaaaaaaactaagtttatctgttaaaaaaaaattaatcctaaatgtcatagaacaagaggacgagtacacaccacatgtatagtcagccctccatgtgtgtgggttccacatctgtggattaaaccatcatcaaattgaaaatacagtgttccaaaaaaaataaaaaccaaaaattgtggttgcatgtacgtgttttttgttctcgctattgttccctaaacaatacagcataacaaccatttacatggaatttgcatcgtactgagtattataactaaccaggaggtgacttaaagtgtacgggagaatgtgcgtatgttatctgtacgtactacacgattttatgtaaggggcttgagcatcctgggagtcttggaaccaatcccacacagatactgagggataactataccacatgaggagcgattaagtaattagaaaatcagccaccaggaaagggagaaamtcaattagtttatacagttccctttccagaaaagctactttttttttttttttttttgagacagagtttccctgttgttgcccaggctggagggcaatggtgtgatctcggctcaccgcagccagcgcctcccaggttcaagcgattcacctgcctcagcttcccgaatagctgggattacaggcatgtgccaccatgtccctctaatttttttttgtatttttagtagagacggagtttcaccatgttggtcaggctggtctcgggctcccgacctcaggtgatctgcccgcctcggcctcccaaagtgctrggattacaggccactgtgcctggccgaaagctacaatttttaagaagcattttgaaatcttaatgtcaattaatggactcccaattattatctacatggacttttaaggacccaggggttcctgtttgaaattactgtactaatctctagattattactgtagtatggatgatactgccagttcccaaatatagtcattgagatcttagaataatttttttctacttaaaattctctaataacttcctttgtatttagaataagattcaaacttttaggtatttgtttataacaaataaatattacatttatttgtttatttataacaagagtgagacagggtcttgctctgttgtccaggctggagtgcaatacttcaatcacagctcactgcagcctcaacctcctaggctcaagtgatcctcctacctcagcctcccaagtagcttggactgtaggtgtgcaccactatgcctgactgattaaaaaaattttttttgtagagatggggtctgtgttgcccagggtggtcttgaactcctgggctcaagggatccgcccatcttggcctctcaaagtgctgggattacaggggtgagccactatgcctggcctatgtgtggattttaaaaactctaaaatggaccaggcgcggtggcttagccctataatcccagcactttgggtggccgagacgggtggatcacttgaagtcaggagtttgtgagcatgctcaccaacatggcggaactctgtctstactagaaatacaaaaattagctgggcgtggtggtgtttgcctgtaatcccagctactcgggaggctgaggcacgagaatcgcttgaacccaggatgtcaaggttgcagtgagctgagattgcgctgctgcactccagcctggttaacagagtgagaccctgtctcaaaaattaaaaataaaataaaataaataaaaacagtaaaatggaagctagagttttcttaaaaatgagaagcttgagattgatgaaaaagcaagataatggataaatgatttctaaaaaaaggtatctaacagctttgtgaagggctaataaaatttctttcaactataaaatgtattagcctattcctttcctcttcaaataagatacggtaaataaaattaaccatttttaccaggtatatgcaagcaagcatgcaggtaccaacaaggctttgatttttttttaagcaaacatgtcttatttatttataarctagtgccaagtgatgagcatgtaaatgatgggcagtatttatgaaatttcagaaagtggttgtactaaagagcacttgtagcttcagttgtggttttaaaggaatatcttaggaaactgcatttacagatttgttcttcatggcacctacatcagctttgggcacagtcagtcagtacagttctctttgtttcaataaagtttaatcctatatatatatttttttatatatatttttttctgtttatactctcctattgtgctttacaatgcactgttctacctaaggcttgactttttaagatggcaccatgtaaggtcctcttggccagagattccaaaaatttttgatatgggactgtctttccccattactcttctctcttctctcttctctcctccctccctccctccctccttccttmcttmctcccttcctccctctctcccttccctcccctcccctccccttccctctttctctcactctttctctctttctccttttctttctcagaatctcgctgtgtctcaaaaaaataaataaataaataaataaacccaggctagagtgcagtggcgcaatctcgcctcattgcagtatctgcctcctgggttcaagtgattctcctgcctcagcctcccaagtagctgggactacaggcactcgccaccaagcctggctcatttttgtatttttagtagagaaggggtttcagcttgttggccaggctggcttcaaactcctggcttcaggtgatcacccccctcggctacccaaagtgctgggattacaggcatgagccactgcgcctggcctccattacttttcaaacaaaatgcagcgatgactggttgagtgtgaggaggtaagaactcagaattctaggaatgaaagtattagtattttatctgctgctgagacagcacatcctgaggatagaagaggccgcaagattagctttctcagatgttctgcaccttttccaagaatctatgactttactaactttatttgaaattaactcttgtaactatttttactaacatgggtttcttgggttaccttttatttttctgttagaaacttgtgtatatcactcatgcagaaagctaattttgaaataatgctttatttaaatgactttcaaagatatgtgctagcattattaagtcagaagtaatcccaggaagtcacccttattctatgatgctatgaaaatagctaacatttatgaggcatgaactgtggttggtgatttataaacgctaattctcacaataacttgaaaatatgacttttctcatttgatagatgagaaggatgacattcagtgagttgcccaaagacaggaaaggccatagcttggattccatcccaggctgtctggctgcaaactagccttttttcctacgccctgctgcccctctgagtccttcagaccagctgtcctcaactgctgggtggtgacacattaatgggcctactgttcatgagctaggtcacaagtaattattaacagtagtagacatactgaggttatgatatatattttaaaataagtggaatggattcaaggtcttccctctaatgatattatttttattcagttccattcctgtatgcttttactgggtgggagagaaaggtggcattatatgcatcaaaccagtaattgtgcatagccccatacataatgggaaatctattttatgctactggtaagctaccgttactgatgagctatgaatagtttccacatattaataaagccttttaggaatatcactgcagaagtagtcagtctgtttgctttactttcctctagaaaactattttgtgcattatctgaggacacccatgggagtgtgtgtctcaacacttttgctgatctggattgtttctagatacttttctcaattatacaatgtgacagtgttttggaaagagtatttataaattacaataaaaaatgatccaaaaggtgatctgagctaaagacgaacaaacaaaaatgtgatggagttaataatgttagggttgtagttttttttttttttttttttttttgagacagcgtmccactttgtcccccaggctggagtgcagtggcatgatcttggctcacttcagtctccactttctgggcttacgcagtactcctgcctcagtcccccaaatagctgggactataggtgtgtgtgctaccacgcctggctaatttttgtattttttgtagagatggggtttcactatgttgccgaagctggtctcgaactccagagctcaagctatcagtctgcctcrgcctcctaaagtgcttaggtttacaggcgtgagccactgcactggaccctgtagaattttttcattcagttctgctgtgaagactgaagtgctgaatcyttaaatatagtttgtggacctctagattttaaactgtgaaacccagtttaaagattttttttttttttttttttttttttgagacagagtctckttctgtcgcccaggctggagtacagtggcgcaatctcagctcactgcaagctctgcctcccaggttcacgccgttctcctgtctcagcctcctgagtagctgggactacaggcgcccgccaccacgcctggctaattttttgtattttttagtagagacggggtttcaccatgttagccaggaaggtctcgatctcctgacctcgtgatctgcctgcctcggcctcccaaagtgctgggattacaggcgtgagccaccgtgcccggcctaaagatatttttaagtttaaatatttttaagtttaaatctatttttatagattcccagagaccttctgatgaaaatccacttaattttgcttaattttttcctgtccatgcctggagaatccaggtttctgctttgtagactatattttcttgcccctcccttctcttcctcttttctagtacaacatactctgtcatttatttaaacaggaaattatcctatagtttgagaaaacatcaatgtagaagtgataatgtaaattaagtaaatttctgatcatcttaattcctcagtacagcttgacacaagattgctcatagaccaggcttttgtactttttttctctaatcccttcttcaaagatcacccttattttcaccttggtcctcatgatgccacctcttattgctcttttggttgtccctttttgagaaaaacctgtagaagaagaaatattcttttgacaaaaaagttcttgtatcattatgtaaaacctcatagtgaaaaagctcgctctttttttttttagaaataaggtctcactctgctgcccaggctggagtgcagtggtgtgatcatagctcactgcaggcttgatctcccaaactcctgggctcaagtgatcctcctgcctcaacctcctgagaagctgagaccacggctgtgcgccaccatgaccagctaattaaaaaaaacattttttttttgtagagatgggttcttgctttattgctcaagctggtctcgaactcctgacttcaagtaatcctccctcctcatcctacaaaagtgctggrattataggtgtgagccaccacgcctgacctgaaaaaactcttggaaatgtctgtctgaatcttccatttaccttcatttctagcagaaactgggaaatttctttttttcttttttcttttctttctctcttttctctgkctctttcttatctttcattattattacttttttttgagatggtgtgttgctctgtctcccaggctggagtgcagtggcatgatcacrgctcactgcaacacactctgtctcccgggttcaagcgattctgatgcctcagcctcccgattagctgggattacaggcgtctgccactacgcttggctaatttttgtattttttagtagagacagagtttcaccatgttggccagactggtctggaactcctgacctcaaatgatccactcaccttggcctcttaaaatgctgggattacaggtgtgagcccctgtgcgcgcggcctcattcttcttytttttttttttttttttggagacagagccttgctctgtcacacgggctggagtgcagtggcacagtcatagctcactgtaacctcaacctcccwggctcaagcagtccttccacttcagcctcttgagtagctgggactacaggcatgtgccaccatgcctggttaacttttttctttctttctttctgttttttgagacagtcttgctctgtctcccaggctggagtgcagtggcgtgatcttggctcactgcaacctccgcctcccgtgttcaagtaattctcatgcctcagcctcccaagtagctgatattacaggcatgtaccaccgtgccctgctatgtgcctggttaatttttaaatttttttgtagacatggggtcacactgtgttgcccaggctgtctcgaactcctggactcaagctatcctgcctgggcctcccaaagtgctggaattacaggtgtgagccaccacatccagcctgaaactgggcaatttcttatatctcacatcttttcgggtttagtaccttttatttccagtatctgttcagttttcttcctcttccttctcttgtggtcctttgagaaaacagggacaatctgctagtctaaggatattctttctagatattaaatttatatcaattttttattgctgtagatcaggactaaaacagcaaaaaggaattgtttcctttgggcagagatgtgacttgcttttgaagggggaagtgggtagtcacaatctactcttacgtaattccctgatgtagtcctcctttgttacaagaatcagcaccaacattatcaattggaattctatgagaatgacatactaactttaataagaatacattgagcagtaggaatttatggctggttataggtttaaagcttgtaggtgatttacttttagaaccacagtgttttctatttttaggttaagttatcctcaacttcaactctaacttttaaggaaatataaatggctggggtaacaagataacagattgtttaaaactatttcctatctcctgtctcaagtgtatgtattttcttaataaataaacttttgtcaggatttcaaaatattcttgctcagctcgaggaaaatgaactttcacactggacttaacttgttttgtgccattgttcaccagaacaatgactgtgatttcacagttaaaacacaggcattggtacccttgaggtgactatgtgaaaataggttattttgtttggtcattctcactcctgtctggcagtgcttcattttttcactggcagctctagctacaatctgattttaattaaatatgtgaaagctgtgtgtactagaatgtaaaatcttgtatattcttcatagtgaaggactgacaggacccgtttacagtgaaccacttgtaaatcatcttgtttctggtggatggrgccaatggggaaataattaaagtattgagtgtatggagaggatagaagttggtagaaaacaaaaacttaagaaccatactggtgattccaaaattccccctccacctcccttttattattttattttttattttgaggcagagtctcgctctgtcacccaggctggagtgcggtgacgcaatctcagctcactgcaacctccgcctcccaggttcaagcgattcttctgcctcagcctctcgagtagctgggactacaggcatgcaccagcatgcccagctaacttttgtatttttagtagagacagggttttgctgtgttgcccaggttggtctcgaactccagacttcaagagctccacccgccttggcctcccaaagtgctgggattacagggagccaccgcgcctggccacctcccttttaaattattattattattattattattattattttttagagacagggtctcattctctcacccatgctggagtgcagtggcgcgatcacagctcactgcagcctcgatctcccgggctcaagtggttctcttgcctcagccttccgagtagctgggaccacaggcacatgccaccacacctggctaatttttttttttatttttgtagagacaagatctcaccgtgttgtccaggctagtctcaaatggtccttgcctcaaatggttcttccaccttggcctcccactgttgggatttcaggcatgagccactgtgcctttttttttttttttaagagataaagagtctccctttgttgcccagartggagcacagtggctattaacaggccatcatagctcactacagcctcaacctcctgggctcaagggatcttcctgcctcagcctcctgggatagctgggactaatggcgtgcaccacggtgcctggccagaattctctttatctctttgatacctctatcaccytctctgccacttagaacacaaaatttgtggttagartagaagtggtagagggatagccagcaaatgccctagaccccagagcttctgtagatttaattgtccattgaagaatcatggagtcattataagagtctcttgcacaagtgttgagcctacttaatgaatattgaacgaaattacattcacttttccctggaatgaaayctctaagcaagagtaaaaatttagctttttctgaatgtgaacataaggccatgaagtagacataccttgttgaatcattatggggcagaggcccagatatgaaatgtctgttgacatgtatgcacattcagtatttatttcagtgccttattgaactctattgaataggtcaggtgacagcttttatctgaacatcagtctttgagggacagttgaagcactggtatatgtgtgagcgagagattggtgtttttttcaaatgtagaagaggtaactkcttacattttttgctcttaaaagtatattatttcataatattcaaatttgccttgggatttaaagtataaattgtcattttagtaacacaattgaatattttttaatatctctgaactaatgagatacagttttctttcaagtgtgggaactattttgtaccctgttccctgacctctgccttttgaccctgtcactttgtgatgagattatagataggcctttgagcttttctccagtctgctcaggtttccttacacagcaacatataaagctttaaggtcctttaaaagatgctcttagaattaaagagaacattcagatttaattggcatgagtttcgtaaatattttttctttaaaaagtctttttcttccttaatgctttcctgtcccccaaatctatttaattatgttttctaaaatggtatatttcgggagaggctaacaattagagctttctaggataaggaaatccaagagagattcaactgtttattccctatttgttgtctctaggtatgagaagttaaaatccagaattagagggtgtcatacaagagcaggagatttttttcagagagaatcagtgctttaaccttcttataataagcactttttagataacaccttttagatactttttcagatgcctaaaatagagtaggaagagaaacaaggacagagaaaaggagactgatttcattggctatgtgttaataactcgtgagttttttttttttttttgagaaagagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtaaattaagcattggccaccacccctggataatatgatattaataggaaggaagggggttttccaagttggacaggcggtcttgagctcccgtcctcacatgatccacctgcgctggcctcccaaagtgctgagatagcaggcatgagccactgcacctggcctggcaatatgtgcttttaaaaaattgtagcttttggctgggtacggtggctctcgcctgtaatcccagcactttaagaggtcaaagcgggcagatcacctgaggtcaggagtttgagaccagcctggccaacatggtgaaaccctgtctctactaaaaatacacaaaaattagccgggcgtggtggctccccagctactcaggaggttgaggcaggagaatcgcttgagcccgagaggtggaggttgcagtgagccgagaacgtgccatggcactccagcctgggcaatgagtgaaactccgtctcaaaaaaacaaaaaaaaaaattgtggcttttaaattatttttctaaaaaagaaagagtgaatggataaaatggagttttctaattcaggtgtttacttttgagagatagaaattaaatccgtagttcttgcaactttttttttttaaacccaaatcctttctacaattagtaattaaagtgaaatgagaaaagaaagagtagctttgaatctcactcagttgcttaatgctaaaataatctattaaaatttttttttctatggaaaggggaaaacactagtgacaaataagatgggaagacaggaagaagctagttagcagaagaggcaactcagtgacaagataaactcttgatctctatcttactggtccgatttgtgtgttgtcacgtagaatgaaaatatgtttagacggtataagaaacctctgatggaaaaatctggktgtctccctgcaggttgctaagaaagagtgatgtttcagggaggctgagtcttgaagcagcagcagcagatctgacacttgtccttcacagctcctttcctgtctcccatagtaagggctatgtaaacatttcatgatcagtgctggyacttgcagccgagaatgcggagaatgcttgcagtttcccttttcatgcagcagaatgataacagggacaatcttttgattgtcttattatgttttggcttttgttgcttttaaaattyccagtttgtgttgctgtaagggaggtaacatttctcaccctttctgtaaatgagtttcctgccaaaacctacctgtgartttcaaatgtttagaccaatcaaccaaccaaagaccttgagataacctaagaaggtataacctaagaagggacagttacacagtaattgggaaaacttctgcaaggacagatgtgcatttctcattttctttaaacctatcaatttactgaaaatgaatatgatttttgttaataatgacagtgccaaaaaaaattactaaaatctttttgagtaaatgaaaccaaactcctaaaaaaagaaaactttttttttttttttaaagagaattttggctgggtgcagtggctcacgcctgtaatcccagcactttgggaggccgaggcgggtggatcacgaggtcaggagatcgagaccatcctggctaacatggtaaaaccctgtctctactaaaaatacaaaaattagccgggtgtggtggcgggcgcctgtagtctcagccactcgggaggctgaggcaggagaatggtgggtgaacccaggaggcggagcttgtagtgagccaaagtcgtgccactgcactccagcctgggcaacagagtgagactccgtctcttaaaaaaaaaaaaaaagagagagaattttgattagttcttatctggagatatattgcttataatttttttctcttggtttttttgtttgtttgtttttgagatggagtattgctgtgtcacccaggctggagtgcagtgttggcgatcttggctcactgcaacctccacctcccgggttccagtgattctcctgcctcagcctcctgagtagctgggattacaggcacccgccaccatgcccagctaattttttgtatttttagtagagatggggtttcatcgtgttagccaggatggtctcgatctcctgaccttttgatctgcctgcctcagcctcccaaagtgttgggattacaggcatgagccaccgcaccaggccattttttggtaattttttagaatgagttgaattgagatgaattttagttgttcctaagtactgtgtactgtgactggcagtggctcttaactgttattttttgagacagagtctcactctgttgcccaggytggaatgcagtgacacaatcatggctcactgcaacctctgcctcctgggctcaagctatcctactgcctcagcttcttgagtagctggaatcacaggcatgtaccaccatactcggctaatttttttgtgtgtttttaatagagacagggttcaccacattggccaggctggtcttgaactcctggcctcaagtgatctgcctgcctctggctcccaaagcactgggattataggcatgagccatcgctcccagctggcattggctctttaaaatttttgggaggagaatataacacagtcacaaaataatgtaagggggcaaattgtggaaaagaaggtctatttatgcccagctcactgctcctactttttgtttccagagccagatatatatgttacacacataaaagaggtatgtaggccaggcgtggtggctcatacctgtaatcccagaactttgggaggcaggtgaattgcttgagctcaggagttcgagaccagcctgcgcagcatggtgaaactccatctctaccaaaaatacagaaaattagctgggtgttggcagtatgcgcctgtggtcccagctactcggtaggctgaggtgggaggaccacckgagcctggaaggtggagatttcattgagcctagatttcaccactgtactccagcctgggtgacacagtaagaccctcgtctcaaaaaaaaaaaaaaaaaaaaaaaggtatgttgctgggtgtggtggcatgtatgtacctgtaaccctagctacctgggaggctaaggtgggaggattgcttgagcccaggagttcaagaccagtctgagcaacataccagacccttgtctcaaaaacaaagaggaatatagattagcccacttcaacattttatgaagtggtgggagatgacttgggaaaagaggttgaatcagcctttggagttctctatcagttagaatgctgtggtttataggtcaaagaggagataaaggaatttggctggttcacaaaatttaaaaggagtttttgggggcatgtgttcagggtgtaatttgaacgtggctccagcttcatttcactgcagctgtttaggcgcaacctttatgcactgttgacttctcttcwggtggcttccctcagagttattaagtggcagcagaagttaagagtttgtattcgcacatcacaccttccttagaagagatttaactttcctcctctagccttcactcctgtcaggaaacaaaaatatgggtgtttgctgtggcctgtcctttaacaaatcagtgtggcaagtaaaatgggattaaactgattactgagactaatttgggatgaaaactatatagctagttcacagtagaagagggagggaagtggctgctgggaaacattcccaatacaggttgagtatcccttatccaaaatatttgagaccaaaagtatttaggattttgtgttttttcagattttggaatatttgcatatacataatgagatttcttaagggtgggacctaagtctaaacatgaaattcacttatatttcatatgtaccttattcatgtagcctgaaggtaattttatacagtattttaaatgattttgtgtacccatcacattagttcaggtatggaattttccacttgtggtgtcattagcagtcaaaaaatttcagattttggagcatttcatatttctggattagggatgctcaacctgtattctctacttgttgaatgctagactataaagatggccctctgaaggacagaaaagaggccagttgtggtggctcacatctgtaatcccgtactttggaaggccgaggtgggaggatggcttggcttgagcccaggagttcatgactagcctggtcaacaaagcaagaccctgtctctacaaaacaaaacaaccccctaaaaatagaaaagagccactgaaaggtgttttgttgttgttgttttttaaagaggtggaatcttgctctgtttgcctaggctggagtgcagtggtgagatcatagctcactgcagccttaatctcctgggctcaagcagttctcccacctcagcctcccaagtagctgggactgcaggtatgcaccaccctaaaaggttttgaacaaaggagtggcttgctcaaaactgtagccttaggaatatcactctggatggaggatatagcatggaattaaactgggacgagatttgaagtggggaaaccaattaggatgcttttttttttttttttttttttagacagagtcttgctctgttgcccaggctggagtgcagtggcacgatcttggctcactgcaacctctgaggaggctgttctgtaagacaaattagaaggcaacattctgaattagaatagtagtggtgggagtaaagaagatgggggatggataggaaagataggacacacaagtaaattgaatttggcaacttctttttttttttttgagacaaggtcttgctctggcacacaggctggagtgcagtgatgctatcacagctcactgcagcctccatctcctgggctcaggtgatcctcccacctcagctttccaaatagctgggactacacccacgtgccaccacacccagctaatgaatttggcaactttattgtatgttgggtttgtcaacctaaataacaaatarggataggctctctaaaagaaaattatttttattttgaaataaggtgttgcaataggaatatacatgcgatagtaaactgtgtgttctttaacattgtggaatttgtatagcttaccagtttgaatgtctgcaagtgcttgcactgggttctaacctccgcctcccaggctcaagcagttctcctgccttagcttcccaagtagctggtagaacaggcacactccaccgaacccagctaatgttccagtcatctggtactaccatagaaaaatgtttaccaattagctgtatagaagaatctgatgttgaactgcctgctattggttgataatgcttgtatagtacttactatgtagcctggcaggatgtaattgcacaataaatattagccacattttcatcatcataattaattggtttaaaccttgggcagtttgatgatgaaatttaaggtattcctggaactctcctttagatattttttctttaaaaaatttttaaaaaattattgtagatacctggtcctgctatgtggcccttgctcgtcttgaactcctggcctcaagtgatcctcccacctctgcctcccaaagtgctgggattataggcatgagctactgggcccagcctatgacatgttttatcgtagaatatgcacctaattttaatatatatatatctgttttaccatgttgccttttaatctcttaatttaataacaataataaaagtattgcttgaattacacacacacacacacacacacacacacacacagtttttaagagagaggttctcactatgtttccctggccggaatgcagtagctattcacagatgtgattacagcacactatagcctcgaactcctgggctcaagcaatcctcctgcctcagtctcttgagttgctggaactacaggtgtgcaccaccatgactggcttcaaattatattttttaattttttttgagacaagagtttcacttctgtcacccaggcttcactgtagtggtgtgatctcagctcactgccatctccaccttctgggttcaagcgatccttccaccctagtctcccaagtagttgggactacaggtgcatgccaccatgcccagctaatttttatatttttttttctagagatgggrctttaccatgttgcccaggctggtctcaaactcctgggttcaagcaatccacctgccctagcctcccaaagtgctgggattacaggtgtgaacctctgtgccaggccactattttttagtttttatagccagtcaaatatggtccctagtttgcagctggcaatcatgtttagagacgttaaatgaattacctaagtttgcattgctagtggcagaattagaaccacaacagagattcttctgggtccaaatccaggcccctttaactatagagaacagtctcagagaaacttaatcattctcatgtgtaaaagagcccaccttttaaatctgatagagagcagggcatttatatacttaaaaggaacattaataaacctattatatgttaacctaaatcacattctaaatgaaaacaagactaactttgggccttttatgcatgaaaattacagattttgttggttgtgcatctgttttaggagtagactatctacgtgtaagcgaccagaggcatccacataagcaagatgtataaattgcttaacaggactcaacgtgagtgtaaaaggactcaatagatttactcctttcttttctttcgtttttttgtgagatgatctcagctcactgcaacctctgcctcctgggctcaagcgatctttctatcctagtctcccaagtagttgggactacaggtgtgtgccggcrcacctagctggtttttttatttttttgtggagacagagttttgccatgttgcccaggctggtctcaagtgagccacctgccttggcctctgaaagtgctgggattacaggcatgagccactgtgcccagctaatcccttaatagatgcagtagtcgaattggcaaggttgtgaataccaggaaccaagaatcattgagggtcatcttgaggctgactgccacattgattaaatctgttaggatctataatcttcagcagtggttttaagtagagcatactaaagcaatagtagtgtgcaggattttgatgccatctccgctgaaggaaataatacaatctgctatctttagaattgcagtatggcatgggctggttgtggtggctcacacctgtaatctagcacttagggaggcagaggtgggaggatcacttgaggctaggagtgtgagaccagcctgggcaacatggcaaaaccctgtctctaaaaaaaatacaaaaattagcaaagggaggtggtgcctacctgtagtcccagctactctggaggctgaggtgggaggatcacttgagcctgggagttggaggttgcagtgagcagagatctcgccactgctctccagactgggtgacagagccagaccctgtctcaaaataataataataataataataataataataataataataatagaatgaaaagagaggggtggtagtggaagggaactgaaaagtgcatgataaattatgtaaggaagcattaggctttggtcagaaatgttgttagccagctgcaagtgaacccatctggcacactttttcattattcttctgaaatattcatggactcttaacagttcctaccttgtttgcactagatcctcacatactcttaccttctggcagccagwctatrgttgcagtgggttgctcttgttttgtttcttgttgctgaggatgtaatcaataaagagtagatactcaaggtaaagtttatggatactcaaattcacttacaaataatggctaatcactacattttattatgctttaatgtgtatatatataatattttatctctgaattatgaatctattctagtcattaaatagtaacattcattttcttttcttttttgagctggagacttgctctgttgcccaggctggagtgcagtggtgtgattctggctcattgcaacttctgcccctctgggcttaagcagttctcctgcctcagcctccctagtagctgggattacaggcatgcactaccatgctcagctaatttttatatttttggtagagatggtgtttcaccacattggccaggctggtcttgaactcctgacttcaagtgatccactcacctcagcctcccaaagtgctgggattacaaggatgagccaccacaaccggcccactttcattaaagaagttttttttwaatttagagagcatatgattaaaagttgacttaaatttttttatttgcaaaaggcatttgcatgtttcttattggtttccaagagatctcttgaaatcatttaggaagtagatgaagagagacagtaaataatccttttatttttaaaaattaaattatcttcagatcattgatagtaggtttatctaggattcaaaaatgtttctgaaaattggtcttacaaactcaaagttcgtaagactgctttttgcactgaatagtaacttgagttcacttaggtgttcctgcttctgttttaggaagaaactttgctgctttgtctttacaattaaagtatgatcttcttacattaactctctgctttacacaggaatggaatcctcagtttttgtttttgtttttacccccaaaggaggttagcagttggagttcattaaaaaatgctgagattttacctagttgagtgatagatttagattttagaaagagtaggatcagtctttccattttttgtagattaacactgtgatggcggtgttgaaaaaggtgggctgtttgtgttataaatttgtatgatacggattttcatgtttaagtccagtcttcctttggcttctcttcttttagctttgactccattgtctgctttggctttgcaaggtgaaaaaacatggccccagggtcagtgcttcccagaaacctagctgactttgatggtcagtagaactcatttgccaccttttaaacaaaaagtttgtagactttgcaggctctccatctgtctcaccaagctaggtgcagttattgtgcagaaagtttgcttaggggcagaggaagccttatctacgtaagtatttagaatttgttaaaaaaaawaaaaaaggaaaaaggaaagcagtttatagatgaatacttaaatagtttcattttgtacaagtcacctggttttgttcccatgtgtkaggaagaaatgagttggacagaattagaagtcttgtcactgaagtaattaaagttattacagagcagcttttttagattagaaaggaagaagctagaaattagtcattggttgctttcattatctattatttgctttcattttatttttcttacaaaactgctatcattacacagatcgtatacaactacaagccttttattttattttattttatttcatttttttttttaaagacagagtttcgcctttgttgcccaggctggcgcgcaatggtgcgatctcggctcaccgcaacctccacctcccgggttcaactgattctcctgccttagcctccctacctggtagctggaattataggtgcccgccaccacgcccagctaattttgtatttgtattagagatggggtttctccatgttggtcaggatggtcttggaactcctgatctcaggtgatccgcctgcctcggcctcccaacgtgctgggattataggcatgagctgctgcgcccggcccatttattttaatttaaatttatcctttagaaagcaattctgtagtatgaaatgtgtgtactctttacctgtgggtacataaattgccatttttatttattggacttttgggtrgtaatgaggtagggctggccagatagtattaatatgatttctaagcatgtctttctgacttctagacttgaagctacttgagggaaacagtttagcataatagtttatcatctctaaaatagggaagtatttaatttataatggtggctaagttgatgaatgagataatgtacagagtctggggtatatgggaagtacccaattaatgtaacctgttatttatttatatttgtagtccttcagcatctactacagtgcttgcacttaatagatgctcactgcaactttgttgaatgaatgatgtggcttaaacttacggagaaagttccagaatatatagccattgtcagcatgattgatgaatctattacaaagggaaaaaatgctcatgtgtttgatatttatacctcattttgactgtagttactacactcttaatgccatactagctcctgtcacaggcctgacaaatagtaggcgctcaatgtatgtttgaataaattattgattttttgttcttcctggaaawggcaatgttttctatttgtcactttatgttatgctaaacaggtttgagttttaggagtcctctttactataaattgaggtggttagatgttggctaatcaggtttcaaaatatgtatatatatattttaaacgtaagcatcaagtctcaagtaagccccttttcctagagatgaactgttgcaggcatgtggagcataaattgttgttgttgttattattattatttgagacagggtctcactatgttgcccagactgttcttgaacttccgggctcaggtgatccttcctcctcagcctctcaagtagctggaattataggtgtgtgccaccacgcttggcttaggaaattattgtgaaatgtatttgtgtatgctatgcttgagctgggatatattttcttgctgtttctcttttgcgatatgtggataaggaaatgctttgctgtgctttaaattgcgggctttgcccccttgagatgcgtacatgagtatggtgcagctgtgtatctgtgactcggacagatcctgagtatagatcctttttggtaactgatctcctcttttcttcatcccttacatacggagttctctttttaaatccctgaacataactgggatcttgacaaaggttccagcaaatctcctattctattttctcgtaagaatactccctctgatcttagtactttcttccacggtctctgctaggtgaaatgagctcactaagcatagtttactctctctttttggtagtaaaggagctggttgcaatattaaacaaggtgttcagggtagccctcactgagaggtgatctttgaacaaagacttaagaaagtaagggagttagccaagtagatatttgggaaaagtatcccaaagtaaacatcaagcggtcacctggtgagttcgagtaaccctaaagagtctggaggagtgaacaagaggaatgaataatagaaggggaagccacaggaggccccatcatgaagggccttatgttgttgaaaggactttggtttttactctaagagaatggggggagccattgcctgatttgaacagggtagagagacctctgacttagttttaaaaggatcatcctggcagctrgctgtattaagactaaattgtgtgtgtgtatgcagggaggttcaagggtagaagcaggaagatctgttgggaagcctgcagtaatttaagtaagggatgatggtggtggctcaggccacatagtagcagtggagatagtgagatgtagtcaatttctggacatatttggaagattgaaacaataggattttgttatcaaaaggcggggtgtgagagaaaggggatgaatcaaagatgactctaaaggttttaaacttcagtaagttgaagaaaaatggaattaccatcaacttaactggagaataccatagtatgggttgcataggttggaggagggttggcacagctcaggaatccatttttggacattctgagtttgagacacctgtaagatattctggtcaagtaggcagttagacgtatgagtctggagttaagagagaagactgagctggaattatacattatggaggcaaaatatttaaatccttgagtttagataagatcaccaagggagagaatgtggatagagaagaggaagagggccaaggatagttcatggatgttctaacagtaagattggatcagtaagcacatttacaacattttaggggaaaaattactaagtattttttgaatatatggagaatagaacagtaaagaaggaaggcagcagcagcactaagagtatctcttttttcttcccttttttccttccgttgtaaaattcctaaaaaatttccatgtggtaatagactcaaggtcagagtgaacacacagctaacscttttcttggtggattaatgccttgattctatttctttcactgttgtttttcttttttcttttatttcttctttcactattttattgaaattcttaaatccatgattaaacttcaagtgtataattgctaaacagatattaataagtgctgtcagattcttacatttccattacactttaattaagctaaacagtataggcaaaacwttcctaatgttaataaaaattaaagatgtaaattctgaaaatcatcagcggttgaacataataggattttaacatttttcttgtgtttttactctttgtctggagataactccaaaatatttgtgtttcagctactttacatgcttaagcagtacatggtaatgaatgataaatacctggtctagttgatggaacatccttgccaatactttgaattagattaactaattctggactataatatggcataggagacagtgtcctcttttattcttttattctgtgtttccagttttgtaagcttgtctttgagtttgatttgttgaggaaaaataacttagggagggtagcttaatttgccatgagttcatcgtttcctccactaatgtgaaggtttaactaaaatagaccgaagactgactgtttttccctactctcccatgagaattttctatcagtacgaggatggtagaaagtttacttttcatttttcatctggggttagaacttatgttccaagtgacatatttaccagtgaattaaggtgtatttgattatatgatctatatttgaagggacaagtatattttctttctttcagctgtttttcttttcgtattacaaaaaggtaatgcttccaggtgctgaatagatgatagtcaagagtcttcagtcattcctagagaggagatgaaatggtgttagttgcatttgttagtaaaaatcatttatctggctatattcctgaagaaccacagaatttcaaatgctaaaataaactttcatttgctaaatggatgcatagttaatgcttagtcatgagattgattcatgtttgggttctactactgaaattaagccagtcctttaggaggaggcaagcaaaggggagttgattcagtgttgtgtaaagtgttatccatcagtatgagtatttttcatgttttattcatgagtaatagattcaaagaagttttaataaagtgcccaattttatttgcataggtcagaataaactttgtaaataagtttgtgatacctgggtacaaactaaaaggctaggaatgaagttatttgggtcttatgcctaaagtttaggagttccaggaaaatttttctgttaagccctggaggtctacatgtttctgtagatcaaagaggtgagaaccatttctcttattgtgctgttcttgtagttgcactgtaataatctttcatggaacaactgagaactcatgtcattgtggagagtcaccagtgcaattgcctcttgctccaagcccaggaaaaagaaaacaagggggttggggggtgggttctgattcatatatgtataaggaaattaagaacaccatctatgaggaattgctgaaaagaacaataaaactgtctggtctttgatacacgtctacattattttagaaagggctcagtgtctgagtatctctagcgctgttatcaaggtagtgaactcctaagactagtctatgcgattgcttttgtttggggtttttagacttttttttctaagagacgggatctcttttgcccaggctttagtgcagtggtgagatcatagctcaccggagcttcaaactcctgggcttaaccagtcctctcgcctcagcctccaaaatagctgggactactaccatgcctggctgaagggttgggagacttcagagcagcttcttgcctgcattggttttgatgtggctaaagtggtgagcatttctgtgtctttttttttttttttttttttttgccaccacagctccccagtttctctggttttaataggttgtatattgttcccacstttcagccctttctttttctctcttctccttttccctactctctaaaatacctaaagggtagtagtcagataggttattttttttcaattgctaaacttcctattcaccttatgccttgaatttgtacgtttactttttgcctttaaaaacaaagttcgagatcagcctgggtgacatggtgaaaccctgtttctacaacaaatacaaaaattagcctagtgtgctggtgcatacctgtaatcccagctacttgggaggctgaggtgggaggaggatcagttgagcccaggaggttgaggctgcagggagccatgagcatgccactgcactccagcctgggtgacagagcgagaccctgtcttaaaagaaaaaagaaaaaaatgaatatgaatataactatatttttaaattctgatatgcattttatagaaaatttaagcaatacaggaaaatgtaaagaaagtaaaaatgaacagcamctcaactgtttagagataactactaatacatttagtagccattatgtctctctactctctatgcctgtataattaactttaatatatattgtttgattttaatatttgtatttaatgtcttactaatcatatgtagtaaaatcattatggatgctgtcttaacctgtttaaacccaatgatatattgtggagataattccattttatatctacattatctagaataccatgtactttacacccttatttacaggtatatccttatttacagattctcttactatagattctgaggttgttttgatttttttgttattttaagcagcattgaggagaacctcctagtgggaaaatctttgcacacatttttaatgattccttcaagtcacatttctaaggaaactgctgggtcaagaggcatgcatatttcttttttttaatcatattgccaatttactcatctgctagtattcttgaaggaatataaacagttcggcagtatttttacacttcagtgtgtattttgttaagaaaacagacctgactgaaagacctagaatcactttattctgtaaacaataggtttcttttcttgttttctatttttattttttatttaaagtagaatagagatagggtcttgctatgttgcccaggctggtcttgaactcctgacctcaagcctagcaaacagtagttttcttaatattgttctgcaaagcctctgaaattcccagatgtcataaagttctcttttgaaaattaagaatggccttttagctgggcatggtggctcacrcctgtaatcccagcactttgggaggccgaggcaagtgaatcagctgaggtcgggagttcaagaccagcctgaccaacaatgtgaaaccctatctctactaaaaatacaaaaattagctgggcatggtggcaggtgcctggagtcccagctacttgggaggctgagacagaactgtttgaacccaggaggcggaggttgcagtgagccgaggtcatgctgctccactccagyctgggtgacagagtgagactgcatcttaaaaaaagaaaaaaaaggggggaggagccaagatggccaaataggaacagctccrgtctacagctcccattgtgagcaacgcagaagacgggtgatttctgtatttccaactgaggtaccgggttcatctcactggggagtgccagacagtaggtgcaggacagtgggtgcagcgcaccacrcgcaagccgaagcagggcgaggcatcacctcacccgggaagcgcaaggggtcagggaattccctttcctagtcaaagaaagcagtgacagagggcacctggaaaatcggctcactcccaccctaatattgtgcttttccaacgggcttaaaaaatggcacaccaggagattatatcccgcacctggctcggagggtcctactcccagggagtctcgctcattgctagcatagcagtccgagatcaaactgcaaggtggcagtgaggctgggggaggggcacctgtcattgccaagttagttgtttgattaggtaaacaaagcggccaggaagctcgaactgggtggagcccaccacagctcaaggaggcctgcctgcatctgtaggcgccacctctgggggcagggcacagacaaaaagacagcagtaacctctrcagacttaaatgtccctctctgacagctttgaagagagtagtggttctcccagcatgcagcttgagatctgagaacgggcagactgcctcctcaagtgggtccctgacccccgagtagcctaactgggaggcaccccccagtaggggtggactgacacctcacayggccaggtactcctctgagacaaaacttccagaagaacgatcaggcagcagcatctgyggttcaccaatatccgctgttctgcagccactgctgctgatacccaggcaaacagggtctggagtggacctccagcaaactccaacagacctgcagctgagggtcctgtctgtwagaaggaaaactagcaaacagaaaggacatccacaccaaaaacccatctgtacgtcaccatcatcaaagtccaaaggtagataaaaccacaaagatgggaaaaaaacagcasaaaaactggaaactctaaaaatcagagtgcctctcctcctccaaaggaacgcagctcctcaccagcaacggaacaaagctggacaaagaatgactgacgagttgagagaagaaggcttcagatgatcaaactactctgagctacaggaggaagttcaaaccaatggcaaagaagttaaaagctttgaaaaaaaattagatgaatggataactagaataaccaatgcagagaagtccttaaaggacctgatggagctgaaaaccaaggcacgagagctacgtgacgaatgcagaagcctcagtagccratgtgatcaactggcagaaagggtatcagtgatggaagacgaaatgaatgaagtgaagcgagaagagaagtttagagcaaaaagaataaaaagaagtgaacaaarcctccaagaaatatgggactatgtgaaaagaccaaatctacatctgattggtgtacstgaaagtgacggggagaatggaaccaagttggaaaacactctgcaggatataggaaaacttccccaatctagcaaggcaggccaacattcaaattcaggaaatacagaggacgcgacaaagatactcctcgagagagcaactccaagacacataattgtcagattcaccaaagttgaaatgaaggaaaaaatgttaagggcagccagagagaaaggtcgggttacccacaaagggaagcccatcagactaacagcrgatctcttggcagaaattctacaagccagaagagagtgggggccaatattcaacattcttaaagaaaagaattttcaacccagaatatcatatccagccaaactaagcttcataagtgaaggagaaataaaatactttacagacaagtaaatgctgagagattttgtcaccaccaggcctgccctaaaagagctcctgaaggaagcactaaacatggaaaggaacaaccggtaccagccactgcaaaaacatgccaaattgtaaagaccatcaaggctaggaagaaactgcatcaactaacaagcaaaataaccatctaacatcataatgacaggatcaaattcacacataacaatattaactttaaatgtaaatgggctaaatgctccaattaaaagacacagactggcaaattggataaagagtcaagacccatcagtgtgctgtattcaggaaacccatctcacgtgcagagacatacataggctcaaaataaagggatggaggaagatctaccaagcaaatggaaaacaaaaaaaggcaggggttgcaatcctagtctctgataaaacaaactttaaaccaacaaagatcaaaagagacaaagaaggccattacataatggtaaagggatcaattcaacaagaagagttaactatcctaaatatatatgcacccaatacaggagcacccagattcataaagcaagtccttagtgacctacaaagtgacttagactcccacacaataataatgggagactttaacaccycactgtcaacattagacagatcaatgacacagaaagttaacaaggatacccaggaattgaactcagctctgcaccaagtggacctaatagacatctacagaactctccaccccaaatcaacagaatatacattctttgcagcaccacaccacacctactccaaaattgactacatagttggaagtaaagcactcctcaacaaatgtaaaagaacagaaattataacaaactgtctctcagaccacagtgcaatcaaactaggactcaggattaagagactcactcaaaaacactcaactacatggaaactgaacaacctgctcctgaatgactactgggtaaataatgaaatgaaggcagaaataaagatgttccttgaaaccaaggagaacaaagacacaacataccagaatctctgggacacattcaaagcagtgtgtacagggaaatttatagcactaaatgtccacaagagaaagcaggaaagatctaaaattgacaccctaacrtcacaattaaaagaactagaaaagcaagagcaaacacattcaaaagctagcagaaggcaagaaataactaagatcagagcagaactggaggaaatagagaccaaaaaaacccttcaaaaaattaatgaatccaggacctggttttttgaaaagatcaacaaaattgacagaccgctagcaagactagtaaagaagaaaagaagaatcaaataggcgcaataaaaaatgataaaggggatatcaccaccgatcccacagaaatacaaactaccatcagagatactataaacacctctacgcaaataaactagaaaatctagaagaaacggataaattccttgacacatacatcctcccaagactaaaccaggaagaagttgaatctctgaatagaccaataacaggctctgaaattgaggcaataatcaatagcttactaaccaaaaaaagtccaggaccagatggattcacagccaaattctaccagaggtaggtacaaggaggagctggtaccattccttctgaaactattccaatcagtagaaaaagagggtatcctccctaactctttttatgaggccagcatcatcctgataccaaagcctggcagagacacaaccaaaaaaagagaattttagaccaatatccttgatgaacatcgatgcaaaaatcctcaataaaatactggcaaaccaaatccagcagcacgtcaaaaagcttatccactatgatcaagtgggcttcatccctgggatgcaaggctggttcaacatacacaaatcaataaatgtaatccaacataaacagaaccaaagacaaaaaccacatgattatctcaatagatgcagaaaaggcctttgacaaaattcagcagcccttcatgccaaaaactctctataaattaggtgttgatgggacgtatctcaaaataataagagctatctatgacaacccacagccaatatcatactgaatgggcaaaaactggaagcattccctttgaaaacaggcacaagacagggatgccctctctcacgactcctattcaacatagtgttggaagttctggccagggcaatcaggcaggagaaggaaataaagggtattcaattaggaaaagaggaagtcaaattgtccctgtttgcagacaacatgattgtctatctagaaaaccccatcrtctcagcccaaaatctccttaagctgataagcaacttcagcaaagtctcaggatacaaaatcgatgtgcaaaaatcacaagcattcttttacaccaataacagacaaacagaaagccaaatcatgagtgaactcccattcacaattgcttcaaagagaataaaatacctaggaatccaacttacaagggatgtgaagggcctcttcaaggagaactacaaaccactgctcaatgaaataaaagaagatacaaacaaatggaagaacattccatgctcatgggtaggaagaatcaatatcgtgaaaatggccatactgcccaaggtaatttatagattcaatgccatccccatcaagcaaccaatgactttcttcacagaattggaaaaaactactttaaagtttatatggaaccagaaaaagagcctgcatcgccgagtcaatcctaagccaaaagaacaaagctggaggcatcacgctacctgacttcaaactatactacaaggctacagtaaccaaagcagcatggtacgggtaccaaaacagagatatagatcaatggaacagagcagagccctcagaaataatgccgcatatctacaactatctgatctttgacaaacctgagaaaaacaagcaatggggaaaggattccctatttaataaatggtgctgggaaaactggctagccatatgtggaaagctgaaactggatcccttccttacaccttttacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaatgaaactaaagagcttctgtacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaacaagtgggcgaaggatatgaacagacacttctcaaaagaagacatttatgcagccaaaaaaacacatgaaaaaatgctcatcatcactggccatcagagaaatgcaaatcaaaaccrcaatgagataccatctcacaccagttggaatggcratcattaaaaagtcaggaaacaacaggtgctggagaggatgtggagaaataggaacacttttacactgttcttgggactgtaaactagttcaaccattgtggaagtcagtgtggcaattcctcagggatctagaactagaaataccatttgacccagmcatcccattactggstrtatacccaaaggattataaatcatgctgctataaagacacatgcacacgtatgtttatagtggcactattcacaatagcaaagacttggaaccaacctaaatgtccaagaacgatagactgtattaagaaaatgtggcacatatacaccatggaatactatgcagccataaaaaatgatgagttcatgtcctttgtagggacatggatgaaactggaaaccatcattctcagcaaactattgcaaggaccaaaaaccaaacaccacatgttctcactcataggtgggaattgaacartgagaacacatggacacaggaaggggaacatcacacactggggactgttgtggggtggggggaggggggagggatagcattaggagatatacctaatgctaaatgatgagttaatgggtgcagcacaccagcatggcacatgtatacatatgtaagaaacttgcacattgtgcacatgtaccctaaaacttaaagtataataataataaaatttaaaaaaaaaagaaaaaaagaatggccttttatgattcctcagagatctagaaccagaaataccatttgacccaacaatcccattactgggtatatacccaaaggaatataaatcatcctgttacaaagatgcatgcatgcgtatgttcaytgaagcactatctgcagtagcaaagacgtggaatcaacccaaatgcccatcaatgatagactgggacctgggagccattatcctcagcaaactaacacaggagcagaaaaccaaacactgcatattctcacttacaaatgggaggtgaatagtgagaacacatggacacagggaggggaacaacacacactggggtctgttggaggttgggatgggggaagagagcattaggaaaaatatatttagtgcatactgggcttaatacctaggtgatgggttgataggtgcagcaaaccaccatggcacacatttacctgtgtaacaaacctgcatatcctgcacctgtaccctggaacttaaaataaaaataaaaattaaaaaaaatagtcacattaaaaaaaaagaatggccttttatggaaacccataggacccaagaaagtaataattttctaaagaatagaaaattagagccatatagatagcgtaattaaaataataatatttgtttcagaataattttaaaaattgtaaccttaagttttatgcacattttttaaaaaatcaggattccttttcttagaattaaggaaaaagtcagtgccgttttacgataacaagaagacttggttatcattgctgataggggcagatgctacattttatctctcatttctaaactttcttactaaagtcagaatttaaaaatgaacttggccaggcatggtggctcatgcctgtaatcccagcacttygggaggtccactcggaaggatcacctgargycaggarttcagaaacagcgtgtacaacaaagcgagacttcgtgtctctaaaaaaatttttaaagaattagccagrtatagtggcaggtgcctgtaccccgagctacccaggaggctaaggcaggaggatcacttgagctcaggggttcaaggctgctgtgagctatgatcgtaccactgcaccccagcctgggttgacaaagcaagacccagtctctaaaggaaaaaaaacccttggctttcagtagtactctgtttattgatgttatgccaaaaggaaccagttttcagctgtacccaataatatattctctgcatatggggactgtagttctgaccttagaaaaatacatagccattaattaattaaattggtctccttgaaagcacacttgttgaaaggtctgtccttttacccaaaggaggaagaggtttgattaatttacagattctgctctggtgtataacacaacatttgagaaaatgtcaggttctcatgagttgaaaattatacaggaaatttatttatttattgttgtttgacaaaacgagtatgatctaaacatttatttgtttattgaactaggttcaggagtccaagaggtcttgtgatgtagtcaagtttttaaagtggcagtatgtcttgccaggaaaagaacctggtcttagatactgtgggttctgcttctggtgagagagtcgcttaaattcttttttttttcttcttcttttttttttgttttttgagacagatgttgcctaagctgctgtgcagtagagcgatcacagctcackgcagccttgacctcctgggctcaggtgatcctatacctcagctttccgaatagctggggctataggtatatgccaccatgtctggctaatttttaaaactttttttgtagaggtggggtttcactttgttgcccaggctggtcttgaacttctgcgctcaagtgatcctcctgcctcggcctcccaaagcactgggattacaaatgtgtcccactgtgcctggctggattctaatgtgaactatattagatgttaagtttaatattttaatatttttaatatcttacgttttaagcgaaagaagacaaatgcctttaaaactttttagaggctgggtgcggtggctcacaccttcagtcccagcactttgggaagccgaggttggtggatcacctgaggtcaggagtttgagaccagcctggccaacatggtgaaaccctgcctctactaaaaatacaaaaaagtaaccaggcttggtggcaggtgcctgtaatcccagctacttgggaggctgaggcaggagaattgcttgaacccggtggtagaggttgcagtgaaccaagatcgcaccattgcactccagcctgggcaaccagagcaaaactccgtctcaaaaaacaaaacaaactttttagtttgaggccgggtgcagtggtttacgcctgtaatcccagcattttgggaggtggggcgagtggatcacgaggtcagaatttcaagaccagcctgaccaatatgatgaaaccccatctctactaaaaatacaaaaattagccagcttggtggcatgtgtctgtagttccagctactcaggaggctgaggcaggagaatcgcttgaacccaggaggcagaggttgcagtgagccaagattgtgccactgcactccagcctgggtgaccgagactctgtctcaaaaacaaaacaaaaaactttttagtttgctagccggaaattttcatctaatcatgtctaagatttcttttaaaatacttcaatgcctgctccctgtcttaaaaagttgggaggggagtagataaaacaagaatagtaaactattgataattattgaagctgggtagtgagtacatgggagttcattatacttttccctttttctctggccttagatatatgtttaacaatgtgtatgtaaaaaaaagaaaagtaacacaacaataagtgcaaatctgctgagattgcacacaggcacaggttcctcagtgttaacttgtctgataggaagcaacatggcagtgacctcagagaaactctagaggaaaaaagcgtaatggctaatgaagcatatttgctggaaagagagaaaaactcagaactgtcattccccatgtgtgactctttgtttctgttaaacatagcagatatgtctgtgccaattaaacttgaatgttagtatgatatttttagaaattcatgttgcggactgtaaactcaaaataaattttggttgcggttgtcgaatgtatcaaacaaatattaccatatttttatagaacaaggaaacttagtatacagaaagtacacttccaacaaatgtttttcactcctccctgggtcttttagatgtggggttataatgttgcttttaaatgcagaataattttatactcttggaaataaaaattktttgagatggagtctcgctctgtctcccaggctggagtgcagtggcgtgatctcggctcactacaacatctgcctcctggttcaagcgattctcctgcctcagcctcctgaggagctgggattacaggcgcgtaccaccatgcctggctaatttttgtatttttagtagagatgtggtttcaccatgttggtcaggctggtctcgaactcctgacctcaagtgatccactcaccttagccttccagagtgctgggattacaggtgtgagccaccgcacctggccaaaataaaaactttattcccactaaatatgtattactcagggaggagttgraaagaaatataatggagaaagaatttaagagagctttgttttggtaaagatttggggaaatgttcagaaaatggttatagaacgacaccgtgcttaataaataacattttgaaatgggaaaaacaaatatgctgtaacataaagccaacttacctagatttgttattatatgggtcatatatatagcatatatatatagtttctaatttgagaaagaatttttaaaatcacagaaaatgcctggttattaaaactagaaagcaaagaaaaaataacttgaaagtacaaacactagccatacagtgttaatatttcactgtatttcctttccatttttaaagcttttgtgtagattttcttgttaccttacatattcccccacttttttttttttttttttttttttttttttttggagacagtgtcttactctctcacccatactggagtgcagtgttgtgatcctgactcactgcaacctctacctcgagtgatcctcccacctcagcctcttgagtagctggaactacaggcatgtactaccatacctggctaatgtttgttttattttgttttgtagacatgggtttcactgtgttgcccaggctggtgtcaaactcttgggctcaagccatccacctggcttagcctcccaaagtgctgggattacaggtgtgagccaccgcgcctggcccatatatccttttatcctgatttttcactaaacatttgaaatatgtacttttcattattatatatccttttcattactacatacattttagaggctgtataatattacattytgggtatgccttaatttgcttaacattcttttgtcatttataatttttcactgttaaaaccatgctgtcaaataccacatgttcacatttgtaagtggaagctaaacattgggtactcatagacataaagatggcaacaacagaaactggggactattagatggaggagaaaggaaggaggggaatggttgaaaaacgggtattatattcaatacttgggtgacgtgggaacatttgtaccccaaacctcagcattatacaatatacccaaatagcaaacctgcacctgtaccccctgtatctaaaataaaagttggaaaaagaaataaaaatagataaataggaaaggaaatgaaaaaacatgctgctaacatcatctttttgtacgtgaattttttagtttttttggattctttttcacaggataaaatcccaaggatgtaggctctggctctgataaggactttttagtttattatgaatggactgagaagcttctgtgtgtctgtggtgggggcgattgtctaaaaactgattccccttccctttgtttttatgcttttgattttttcaagaaactaggttattttccctgtagaatgtcccatattttggattctttgtttattgtctatttcttggtggttaacttgttgctctatctcctggatttcttaagaactttcctctaaagtcttaattagattcaggttcaacattctttgggggaaagaataaatattttattagtggttttatatagttcatagtgcatcctatcaggagggcataatgtctgattgtctcaagctgtagatattttcattagtttattcttgcctttccacttttggtggtgttccttttgatgcacaggagatttaaattttttttgtagttgaattaatattttcctttttatttcattgtaatttcagtttcactctattcatattcatagatttgatagttattggctgggcatggtggttcacacttctaatcccaacactttgggagactgaggtgggaggatcacttgagcccaggacctcgagaccagcctgggcaatacagggagaccccgtctctacaaataaaataataaaaattagctggatgtggaggcacatgccagcaattccatctgcttggaaggctgaggcaggaggattgcttgagccctggaggttgaggctacagtgagctgtgcttgtgccactgcactgcagcatgggtgacagagtgaaaccctgtctcaaaaataaaaattaaaattaaaaatgtgacattgataatatcttctaaaatattttttatgaattaacttttaaaatgtattttaatgtgtattaaagttacttattacatatttaattaattcattcattaattttgagatggagtctcactctgttgcccaggctggagtgcagtggtacaatctcagctcactgcaacttctgcctctcaggttcaagcgattcttgtgcctcagcctcctgaatagctgggaatacaggcttgtgccaccatgcctgactagtttttgtatttttagtagagacaggttttcaccatgttggccaggctggtctcaaactcctgacctcaagtgatctggctggcctcccaaagtgctggaattacaggcgtgagccattgtgccggccatatttagtaaatttaaatcactttttatatgttgtttgtatcttatggatagagagtagatagagatgtgatatacttggaatttattttgctgtagggtaaggatctgagtagattatttttcaaaaaccagccacatgttccagtctgtgtttattgaataaacattccctttctgttttctaattttccttttattacrtgctaagtaattacatatactagtgtctgtgggctttctctttttttcctagcaacttgtttrtatgctgctatacttttgatgattgtcataacgttataagagaatttctaataggactaacctttttctaatttctcaccttttttcaaaatggtagcacagtatgtttgatcttaaacttccgtaacagcctagtgggtttttttccagataaaattttataagtcacttaccttataaaaactttgaaaaggtatctatgctgacaagcaaggagcataaattacttttataaaaagtcagatcttagtagcaggtactgtcaaagaagcaagctaatgacttggagtgtaaggagtgataccacacacatcatcttactcctaacattttctgttacaaaacatatggaaactctacgtagcagttttgcatctttatgaaccatttggtatgaaatctctcttgttttttgagacaaagtctcactttgtcaccaaagctggagtgcagtggcccggtcaacgctcactgtagcctcaacctcctggagtcaagggatcctcctgccttagcctactgagcctcccaggtagttgggactacaggcatgggctaccatgcctggctagtttttgtattttttgtagagatttaagtgttgtctaccaaaaaaaccttttttgtctcactacaacatttttttcagtaccatttacttatttgagacagggtctggctctgtcgcccaggctggagtaatggtggcacagtcttggctccctgcaacttccacctcccaggctcaagccaccctccacctcagcttcctgagttgctgggactgcagttgcatgccaccacactgaggtaatttttatattttttcatagagatggggttttgctatgttgctcatgctggtctcaaactcctgggctcaaagaatccacccgttttggcctcccaaagtgttgggattacaggcatgagccaccgtgccctacccatttttaaaaaattttaatttttgtggatacatagcagatgtatatatttatgggttacatgagatatttttatacatgcattcaatgcataataatcccatcatggaagatgaggtatccatcccctcaagcatttatcatttgtgttacaaacaatccagttatactcttaattattttaaaatgtacaattacattatttttttcctatagtcaccctgttgtgctagcaaatactaggtcttattcattctgtttttttgtgcccattaaccattcccactttcccccatcctaccttctacccttctcagcctctggtaactatccttctactttctatgttcatgagttcaattgttttaattttttttttttttttttgagacggagtctcgctctgttgcccaggctggagtgcagtggtgcgatctcggctcactgcaacctccacctcccaggttcaagtgattctcctgcctcagcctcctgagtagctgggactacaagtgcccaccaccacgcccagctaatttttttgtatttttagtagagacagggtttcaccgtattggccagactggtcttgaactcctgaccttgtgatctgcccgttttggcctcccaaagtgctgggattacaggcgtgagccaatgtgcctgaccagttgttttaatttttagctcccacaaataagtgaaaacatgtgaagtttgtctttctgtgtctggcttatttcacttaacataatgacttccagttcaatccacggtgttgcagacaacaggatctcattctttttatggctgaatagtgctccattatgtataagtaccacattttctttatccattcatctgttgatggacacttaggttgcttccaaatcttagctattgtgaatagtgctgtaataaacgtggaagtgcagatatcgcttcgatatactgatttcctttattttgggtatatacctaggagtgggatcactggatcatatggtagctctatttttagttttttgaggaacctccaaactgttctccatagtggttgtactaatttacattcccaccagctgtctacaagggttcccctttctccacatccttgccagcatttattattgcctgtctttgtataaaagccattttaactgggatgagattatatctcattgtagttttgatttgcattcctctgatagtgatgttgagcagcttttcgtatacctgtttgccatttgtatgtcttttgagaaatgtctattcagatattttgcccatttttgattggatgattagattttttttcctgtagagttgcatgagcttccttatgtattttggatattaatcccttgccagatgggtagtttcaaaatattttctcccattctttgggttgtctcttgttgatagtttcctttgctgtgcagaaggtttttaacttgatgtgatcccatttgtccatttttgctttggttgcctgtgcttgtggggtattactcaagaaatccttgcccactccagtgttctggagaggttccccaatgttttcttttagtagtttcatagtttgaggtcttaaatttaagtttttaacccattttcatttgatttttttttttatatggtaagagatacggggtcaaccttcattcttctgcgtaaagatatccagttttcccagcaccattgactgaagagactgtcctttctccattgtatgttctcggcacctttgtctaaagtgagttcactgtaaatgtgtggatttatttctgcattcyttattagactgtttcactggtctaatgtgtctgtttttatgccagtatcatcctgttttggttactctaactgtagtataatttgaagtcaggtaataaaattcctcgttttgtttttttcctcaggatagctttggctattctgggtcttttgtggttccatgtaaattttaggtttgtttttttctcttcttttcttttttttttggtgggggggttggggggcgggacagagtctgactgtgtcgcccaggctggagtgcagtggcacagtcttggctcactacaayctctgcctcccaggttcaagcgattcttgtgcctcagcctcctgagtagctaggattacaggtagtcgccacctcacctggctaatttttgtatttttagtagagacgatgtcttaccatgttggccaggctggtctggaactcttggcctcaagtgatctgcccaccttggcctcccaaagcactgggattgcaggcatgaggcatcacgcctggcctagaattgttttttctacttttgtgaagaacattattggtatttttatagggattgcatgaaatctgtagattgctttggggagaatgggcattttaacaatattgagtyttccaacccatgaatatggaatgtctttccagttttttgtgtccttttcaatttcttgctccagtgttttagttttcattgtagggacttttcacttatttggttagttcctaggtatttaattttatttgtagttattgtaaatgggattactttmttgatttcttttttagattgtttgctattggcctatagaaatgctagatttttgtaggttgattttgtatcctgcagctttactgattttgtatgagttctaatagttttttggtggagtctttaggtttttccaaatacgagatcatatcatctgcaaacaaggataacttgactccttcctttccaatttggataccctttatatctttctcttgtctgattgctctagctaggacttctagtaccgtgttgaataacagtggtgaaagtggatatccttgttgtattccagatctcagaggaaaggtttttttttttcctcatcrgtatgatactagctgagagtctgtcatatatggtgtaattatattaagatatgtttcttctataccaagtttttttaaggtttttattatgaagggatgttgaatgttatcaagtgctttttaagcatccattgaaatgatcatatggtttttgttcttcattttgttgatatgatgatatatcagattgattgatttgcayatgttgaacyatccttgcrtccctgggataaatcctatttagtcatgatgaatgatctttttaatgtgttgttgaatttggtttgctagtattttgttgaggatttttgcatcaattttcatcagtgatattggtctgtaattttttttcttttaatatgtaatatgtctttgattttggtatacaggcctcatagagtgagtttggaattattccctcctcctctagttttcagaatagtttgagtaggattggtattcgttctttaaatgtttggtagacttctgtagtgaagccatcaggtcccaggcttttctttactgggagattttttattatggctttgatgttgttgcttgttattggtttgttcaggttttggatttcttcatggttcaatcatggtaggttgtagtatctaggaatttatccattttctctagattttctcatttattggcatatagttgatcatagcagccactaatgatcctttgaatttctgtggtatcagttgaatgtktccttctttatctctggttttacttagttgtgtcttctctttttcttagtctgtctagcagtttgtcaattttttttttcaaaaaaaaaaaaaccttttgtttcattgaagttttgtattttttttgtttcagtttcacttatttctgctctgatctttattttttgttttgttttgtattttgagatgaaatctcactctgttgcccaccctggagtgcagtggcacaatctcggctcactacaacctccacctcccaggttcaagctatcctcctgcctcagcctcccgagtaactgagattacaggtgcacaccaccatgcccggctaatttttttgtatttttagtagagatggggtttcaccaagttgtccaggcttgtcttgaactcctgacatcaagtgatccacctgtctcagcctcccaaagtactgggattacaggcgtgagccactgcgcctggcctgatttttattatttcttctactaatttggggtttggtttgctcttgcttttctagttctttaatatacatcattaaatagttgtttrtttgaggtttttttcttttttgatgtaggcacttatagctataaacttgcctctcagtactgcttttgttgtatcccatagcttttcgtatgttgtgtttcctttatcatttatttcaagaaaattttcaataattccacttattattgatctctagttttattctattgtggtcagagaagatgctttatattatttcagttttttwaaatgttttaagacttgttttgtgacataacatatggtccatccttgagaatgatccatgtgctgaggaaaaagaatgtgtactctgcagctttgggatgaaatgttatgtatgtatctattaggtccatttggtctgattagktccatttggtacagattaagtctgatgttcattgattttctctctggaagatctgtccaacgctgaaaatgggatgttgaagttaccagctattattatattgggrtctgtctctctttttagctgtaacaatatttgctttatgtatctgggtgctccaacactggtatatggatccagtgttgggtccatatacaattacaattgttacatcttcttgctgaattgccccctttatcattatatagtgaccttctttgtctcttcttatagtttttgtcttgaaatctatttcgtctgatatacgtatagctactcctagtcttttttgatttccattgtcatggaatgtgtttttccatccttttattttcagtctatgtgtgtctttgtaggtgaaatgtgcttcttgtrggcaacagatcactgagtcttgtttttttgttttttgtttttttaatcccttcagccactctgtctttttattggagaatgtagtccatttacattcagtgttgttattgatgagcaagggcttattccttccattttgttacttattttctggttgttttatgggtcttgtcttccatccttcctccctgtcttccttttagtgaaggtaatcttctctggtggtatgattttaatttcttattttttattttcagcgtatctgttgtatgttttttgattagaggttaccatgatgcttgcaaatactatcttataacctattattttacactgatagcctaacactgtttkcataaacacacaagcaaaaagaaaactaataaaaactctacaccttaacttcatccccctgctttctaactttttgttgkttttatttatatcttattgtactgtctgtgtcttgaaaagttgttgtagttatttttgatttatcttttagtctacttaaaataagagtaatttacacaccacagttacagtgttattctgtgtttctctatataattactgttaccagtgagttttgtaccttgagataatttcttaatgctcattagtgtccttttctttctgattgaagtacacctgttagcatttcttctaggctagatctggtgttgatgaaatccctcagtgtttgtttgtctgggaaagtctttatttctctatgtttgaagtatattttagccagataaattattctggggtaaaagtttttttccttcagcactttaaatatgttatgcaactctcttctggcctgtaaggattccactgaaaatctgctgccaaatgtattggagttcagttgtatattgtttcttttctgttgctgcttttaggattctttctttatccttgacctttgggaatttgattatgaaatggcttgagatagctttctttgggttaaatctgcttggtgttctgtaatcttcttatatttggatattgataacctttcctaggtttctgctattatttctttgaataaacttttttttttaaatacatcttctattcctatctctttttctgcctcctcctgaagaccagtaactcttaggtttgcccttttgaggctattttctagatcttgtaggtgtacttcattcttactcttttttcttgtgtctcctctgactgtattttcaaatagtctgtcttcaggctcactaaatctttcttctgcttgatccttctgctattaaaaaactctgatgcattcttcaatatgtcagttgcatatttcaactccagaatttctgcgtagttcttttttaattatttaaatctctttgttaaatttttctgatagaattctgaactccttctccntgttatcttgaattttgttgagttttctcaaaacagctatttgaattctctgtctgaaaggtcactgtattagtccattctcgcattgctataaatatctgagactgggaaatttataaataaaagaggtttaattggcctatgtttccacaggctgtacaggtaacgtgattctgacatctgctcgacttctgggggtgcctcaggaaacttagaatcatggtggaagtcaaagtgggagcaagacgtctcacatgattagaagcaggaggaagaggggcggagagctgctacacacttctaaacaaccagatcttgcgataactcactatcrggaggaacagtaccgaggggatggctctaaaccattcrtcaaggaccaccctcatgatccagtcgcctcccaccaggccccacctccaacattggagattataatttgacatgatatttggtggggatacagattcaaaccatatcagtcacatatctctgtttctccaagattggtccttgctaccttgtttagttcatttggtgaggtcatgttttcctggatggtcttgatacttgcggatgtttgttggtgtctgggcattgaagagtcaggtatttactgtagtctttgcagtctagactttttttttacccactcttcttaggaaggctttccaggtatttgaacttgggtattgagatctaagccgtgtctgccttagggggcaycccaagcccagtaacctgtggttcttgcggatttgtagagttaccaccttggtagtttcggataagacctggatgaattctctggattaccaggcagagactctggttctcttcgcttactttctcccagacaaactgagtcagagtgtgtgtgtgtgtgtatgtgtatatatgtgtgtgtgtgtgtgtgtctctctctctctctttctctgtgctaattcacctggaggtggggtggggtgacagagtcacccctgtggctaccaccactgggactgtgctgggtcagactggaagccatgagtatatctttatccctagtgttcattaagtagcctgcagtggacacttaggtccctgagctgatagcacaagaggcagatgttcatgcagtgatggcggatggctggacacccctgcacagtacttgcaagtggtaccagagtggcttctttcttacctcagtgtgatgcagatatcaatgcccaaacaaaagcctttttttttttttttttttttttttgagacagagtcttgctctgtcrcccaggcttgggtgcagtggtgcaatctgcgctcactgcaacctccacctcccaggttcaagctatcttcctgcctcagcctcccaagtagctgggactacaggcacacgccgccacacccagttaatcaaaccaaagcctcttgacccctttgcatcttgctgctgggaaaggagacagcaaagataacctagaactcctcctgatgaaccattacatcaaaccagggctgaaaaacaacttcaaagaaacggcatttgatattgccaggaggacaagtatctatcactccttctttgtaatggtggaaggctatacaaattcttcacctcagtcttaatggttctagtaattttaggtgtctaagtaccagtggctccttcgtgcaagatataaaatattcccataagacaaagttgatttaaaacgtcttactacaaaaattcagtggtaaggtagttactattatgttctttaaagtgaaatgcctgacctgatatcagaatgtatttgaaagatgtttggatatatctttaattatttttgtggagctcgtgatttttatcagagataattttaacttgcctagacctaaaaacttgacatgactttgggaggccgaggcaggcagatcacttgaggtcaggagttcgagaccagcctggccaacatggtgaaaccctgtctctactaaaaatacaaaataaaagtaaaaataaaaataaaaagctgagtatcgtggcacatgtctgtaatcccagctacttgggaggctgaggcatgagaatcgcttgaacctggaaggcagaggttgcagtaagccgagatcgcaccactgcactccagcctgggccacaaagtgagactcagcctcaaaaaaccgacaaaaaaaaaacttgacacaagttgaacagaaactgattatttttggtgctgatccaagagaaatgtatttttaaatactgtacatcctggatctttgttgagtatttartatattgatatatatttttataaggtgaggtaactcaaaatttaagtcttaaatattgatgcagtcatctgtcttctctacattaccatagccagttactttcattttaaaccagaagaactaacatattagtgacttgaatcttcataagttaaaggaaaaaaaaaaaacactaaaaagcctagatgtttgtcttttagacaatagataatttttaggaaagcagttagctaggtgtttcatccatgaatgttgtatactgcctcccctaccacagttcacacaattctgtggatagtcctccctggtcaacctacatgtgatctttattctaatggtgaatcagtatgaccttttagacatgcatacaactacattgtggtcaaagagatcatagtgtatctgccatccaactgcttttacctgcctaatcctgctgatttgggcactgcttacataatctcttgagttcacaggaaatgttgattttccaaggtctttgttttatagaaaccttacaaagcaaagtgataagggaaaaggaattctaaaagtgaggggatgattattatattgaggctgaaaccacacagtggctcaggcttaaaaacagtatggatagtgacaaaaagcataatataaacattcaagaaaataaagtataagttttaacaacaaaaatgatttctagattacttacaatagctaatacaatgtaaatgccatgtaaatagcatgtactgtattttttatttgttgtactgtattttttgttgttgtattggctttttaaattgtttttttttcttcaaatattttcaatccacagttggtcatatcttcagatgcagaactgtggatttggagagcctgctgtaataggagggcaaatttaagcattcatattttaacaatatttaatagctcacaatatttaatgtgagcttatttacatgtagtttctttaatcagatcaaaaggatgattatccaatgacttgtgcaagctcttagtctccaaagcttaggaaagaactgcaggtgatgtagtccaagtcaatgaaataagcctcagaaaaccgatgcctacaaattgtgacttgttaaaatcagagtcctgtttataatgtctgaacccagaacttgatcctaggtcttctggtcccacgggaaccttttctctcattgtacaaaataattcagccagtgaaataatcatcaacatatctgagatggaacatgctttcatttcaaaccagatcctcttccagccttccgtttttgaacaagttggtaccacaatctaactagttgccaaagccagaaacttagaagttctgaatactttatttttcccaattcccccatatctaattttatcctcaataacttatcaggtaccatcaattttatctcctgtataggtctcaaatctacctgcttctctctatcattctcccacctccctatttcactactatataactcactaattttctcacaggtctatcctgaccattctcccatctgtgttctccatagtgaagccagaatgatctttttagaatgagaatttttccccctccctgcctggtctcttctacaccacttaaagccacctcagtgatttttccattgctgttatattgaggtctatgagcctaaatatgttagcaagccctgcccaccctcttktcttaaacctcccctctcttcctgtatctttgccctccagacacattgggcttattttgattttggaatgcttcttacctactccccctatcccccagtctttgcctaattaatgactaattattctttaagtcctaggtcaggcatctgtcactcagggaagtctctgacatcccagagtactccatgccacccctttattttaatcaacattaagtaaactgtgcttctttcttcagagaattatctcagtttatagccatgtagtcataattgcattcctttgattaatgtcagtcttctccccaaactggaaattccatgagagcaggcatttgttattttttgtcccctggtgtatttttttattttctattwtatttccagtacacagcacagtgaaatggctccataaacgttacctgagtaagtgaagtaattctctgtaaggtctggctgaagaccttcatgtctccarataagtagcctacaagtatctctctattctgattttacttytaggccagttccagcttttctgttgtagtgagtagaatggagatataagctcagtttctgctgggcggatcaaggaagttgcagggtccgtcagtatttaagtgaattttgaacttaatgagattcttcaattcattctggaaggaatgtaattctgggttgactatagccacaatagcatgatgccaggaatcaggacttaaaagacttttcttatggaagtaacttctgactcaaaccctaaagtaaacctatagtgcttactgtcagtccaaggagttcatctcagaaaaaaaaatcattttaccatagtatatgtgaattaaatgagttaatacaagttagagctggctgggcacggtggctcacgcctgtaatcccagcactttgggaggctgaggcagatcccttgaggtcaggagttcgagaccagcctggccaacatggcraaacactgtctctactgaaagtacgaaacttagcgggacgtagtggcatgcgcctgtaatcccagctacttgggaggctgaggcaggagaatggcttgaacccaggaggcggagattgcagtgagccgagactgcrccattgcactccagcctgggtgacagagcgagactccgtctcaaagtaaaaaggaaaaaaaaaaaaagttagttctaagaacagttattaactcgtagtaggatataaaagtgttaggtaatgtgtgtagagccaaagagactttgagtcaacattatgcctaatattaaatgtattaagaacattttaattcaggaaagcatgcatttctttgaacactgcataatgaactgtgttgaaaataattacttagcctgtttctgcttcccttttgtgtttcggacctttctcaattttacctattcttattataatttaaaagcccttttgagatccctagagtaaaataggagatgaatcttggctgattactagaaatagaaagattttagctgattacctcactggcaactttgatagcagcaacttaaacttgagatcccaggcttgggttcctctaaggcttaaagctttcagaagtaaatgtacttattttgttaaggaaattctttggagactcttttcattaaataattttcattatgtctgaacatggctttaacttgccaaatttcccttctttgtttagtataattatttttaaagagcgtgaaaatgtgtattctatttttaaaatttaatattttttcagtgctgacatattcaactrtgatttattttgattttcaggtctttagcaatgttaattcaaacctgagagttttaaactatgttggaataatggataccattgagaatatagtaaaatgttttgaaccttctttctagaaaaatgtttgcatattcaaaatattgtatacagtgtttcacttttcacaaataatcctgaaactgattmatatattgtttttatttttatttttttcgagatggagtcttgctctgtcacccaggctggagtgcaatggcacgatcttggctcactgcaacctccacctcctgggttcaagccattctcctgcgtcagcctcccaagtagctgggactacagtcatgggccaccacgcccagctaatttttgtatttttagtagagacagggtttcaccatgttggccaggctggtctcgaactcctgacctcaagtgatctgcccgccgctgcctcccaaagtgctgggattacaggcatgagccaccgcgcccggctgcatgtattttttttaaatgttgctcctctttagatatgtgactagtatattttcatttagttaacatgtccagttgtattcagtttcattaaaattgatttatagtgctatggtgtttaatttgtataacacaaagtttctagatccttcttctggaagcagtaataaaataaaaaagtgcagttgtgctaagtgcatttttgggagaatgcagcattttaagccatggctattcatatggcaattatagcagtttttatcactctgtgttttaaaaatgtaagagattcttaataaaaactgatgtgattttgtgttgggcattttttaaaggatgttttyttttttaaaaaaaattatttttaaatttttatttatttatttattttgagactgggttatgagactggccaatttttgtatttttggtagagatggggtttcaccatgttgcccgggctggtttcgaactccagggctcaagcgatccccccaccttggtctcccaaagtgaggtgtgagccaccgtgcccagcctaaaggatgttttcttgagtgatggctgttgaattattttggtaggacttggaatgcttttgtggaatgtttaagtggaatattggttctaagtttcctatctcagggatcctggacctgccatttgattagctgcatacatttttaaattgaggggaaccagaaaatcttccaagatctttgagtgctgtggactcctttggatgcagttttcttagagaactgctgggtccatccaatcttaggatgactgaggttataagattttctctagtttttttctgccctgtcaggcatcttgtgatttcatagattgctgtcatcatcttctcccttggttatctcatccaatacctcatgccttttttcttttctttttttttttttttttgagacagagtttcgctctgttgcgcaggctggagtttagtggcgctatcttggctcactgcaacctccgcctcccgagttcaagcaattcaccctaccttagcttcctgagtagctgggattacaggcacccgccaccagacccagctaatttttgtgttttttagtagagacggggtttcaccatgttggccaggctgctcttggactcctgacctcaggtggtcgcctgcctcggcctcccaaagtgctgggattacaggcatgagccaccgtgcctgaccctcatgactttaatatgatccaatatcagctctttacaaatgagtcctaaatctacctctctagctcagacctccctcctgaaatccagacttaaatttatctgactgctgtcttaacatctccagttagaattggcatctcaaaatcagtatgttcaaaactggattcctattgtttcctcagaaatgtaatcttccctttgtcagttgacagtgcagtctctcaaaagccttgcacgctttctttattactctctttgtatcatactccgtgtttggtctgttcgtattattgcctcacccttcaaaatatatccagaattcaaatacatctcactatctccgctgctacaccttggtcagagatacttttacctcttaggtagattaaatgtcaggtcgtaatacctggaacctgaatgttacattatttggaaaaaaaatatctttacagatgtgattcaggatcttgagatgcggagattatcctggttggctctaaatgctatcacatgcacccttctagagagaggcaaagggaagtttgacacacgcwggaggaagtgatgtgaagacaggcagagtttggagtgatgcagctgtaagccaaagaatgcgcatagcaaccagaacttggaagaaacaagaaatgaattttcccctagaccgtctggagggagttcggccttgctgacaccttgatttcagaccagtaatactgatttctgacttctggcctccagaactgtgaaagaataagtttcaagccatatcgtttgaggtcatttgttacagcagccattggaaattaatacattctcctgtttaggatttcagtcaaggttgttcattatgttcggttgttatggccttgttaatctaaaataatctccctcaccttttttgtttttcatgacactgactgtttttaatttaaagagtctaggcatattgtcttgcagactatcccacgttgtggaattacctgattgtttcctcataattagattcacattaaacattttttccaagaataccatataggtgatgttgcataaagcctattattaatacaactgtcagagtgatttttttttttccccaaatggagtcttgctctgtcacgcaggctagagtgtagtggcatgatctcagctcactgcaacctccacctcccgggttcaagcagttctcctgcctcagcctcccgagtagctgggrttacaggtgygggccaccatgcctagctaatttttgtatttttagtagagacagggtttcaccatgttggccaggctggtctcgaactcctgacctcatgatccgcccgcctcggcctcccaaagtgctgggattataggcatgagccaccaygcccagcctggagtgattctttcaaagcgcagcattcctctgtttgaaagtctccagtgacttcccatttgttcagaggaaaagccagatccctcatatgatctggccgcccgtaacctctggagctttctctcctcttcactcattatattgcttttgtcttgctcttttccagacaatctgagcatgytcctgtcttatgatctttgctttagctgttctggttgcctggaaagctcttccccccaaggatcttttggctcactgtctcacctccttcatgtctgcctaaatgccctgtgtcagtgagtcctttccagatgactatttttaaaattgtgattctccacctgcttcccagtgctgatccctcaatgctctttactgtcatgtttttccatatcaccctctctcataccgtgtaacttatttattatgtttattgtttattgcctgttttccctactgaactataagcaccatggtggcaggaatctttgttttgttcccagagtcatcccagaatgttatgttcatagcaggcacaaaatagtttgttgaatggatgaatatgaaaatactttagattaatatatccttctttgccttaattcacagtagagtcacaacagtattttgaaataactttggatttgcggaagagttccaaagacagtgtagaattcctgtttacccttcacccagtttctccaaatgttaacgtttcacataaccatggtacattcatcaaaactaagaaattaacattggaataatactrttaactaaactccaggcttcatttggatttcgtgaatttttccactaataccctttttstgttccactgtccaatccaggataccacattgcatttagttatgtctctttagtctcccctaatctctgcagagactacttcttaaaggattcttgtggattatttgctcaagtgaatatttcttttatttatttatgcctcagcattcacatcgtgaatatttctaaaggaaggaaaggttgtaaaayttaggagcactagaatatatagctacagggcattgttgaactttagacaagatcataggatttgacatgttttctgggtcaaatgcagagtttatctagygtcttctcttctgccatcagagcttcccaatcctttcatgttgtcatttgaagaggtgaatcctagcctaaccattaactgtttgtgacattttaatgggtaaatgtaaatatttctgtagtaaagacgtgttaggtacctaccctgtgtaatgaactgtatcgaattcctccttgtgaagggggatgtaaagaaatttgagtaagttttttactagcctgggttctaatataggtaatatataactaacagactgtaataacaactggtttgayagcacagaggaaattattaatgttaactgggtgaggtgagaaatagggagaagatcacatttaaacttgcccttaaagtattaatagaattttttaaaaaatttattcgagacagggtttcacttccactgctcagattggagtgcaatggtgcaatctcagctcactgcagcctctgcctcctgggcttaagcaattctcccacctcagcctctggagtagctgggaccacaggcacttgctaccacacctggccaatttttatatttttctgtagagaaggggtttctccatgctgcccaggctggtcatgagctcctcagctcaagccaatccacccatctcagcctcccaaagtgctgggattatagtgtgagccaccgtgcctgacctcatagaatttttttaaatggctttattgagatattattaacgtatacatatcaaatgcaccatttaaagcaaacaattcaattgctatgcatatattcacagagttgtgcaaccattccacaataaatgttagaacatcttcatcagccacaaaagaaaccccatacctgtgttcactccccattctccccttcactcagctcctggcaacacatattctttatatgtctgtaaatttgcctattctggtatttcatataaatagaattgtacagtatgtgtctgacatctttcactttgcatattttcaagattcatccacattgtagcactcatcagtactacattcctatttatggccagatattctattttatagaagtatattttagtttttcattcatcagttgatggaaatttaggttgtttctacttttgggctattatgaataatgctgctatgaacattcagatttttgcatggacagacatgtttttattaatgttgggtatatactatgtttaaccacttgaagaattagcagactttttcaaagcagttattattttacatttccaccagcaatggatgagggttccaatttctttacatctaagccaacatgtgttaatgtctgtcttttctattttggtcatgcaagtgggtgtgaagtggtatctcattgtggtttcgatttgtatttccctaatgactaatgatgttgcatcttttcatgtgcctattggtcatttgtgtatgttctcatgaggtgtatcattttagtagatgaagaaaggggaatggaagggagcaagagaacagggacaaaggcctgagaaatggtgagagaatcagtaaaagagagtagggctctcagatgataggagttaagagaggactatagaaaactgggtctctaagctgatgtgtcaagtcacactgtcctctgcttatcctaagcttaccttgctcaaatttctttttttttctttttctttgtttttggtttttattttttcttaaatttcaaggatattccttcttttgtaaatgtcacagagtatcatggctctgtcgccgaggctggagtgcaatggtgcagtctcaggtcactgcaacccctgccttccaggttcaagcgattctcctccctcagcctcccaagtagctgggattacaggcacatgccatcatgcccggctaatttttgtatttttggtagagatggggtttcaccatgttggccaggctggtctggaactcctgacctcaggtgatttgcccacctcagcctcccaaagtgctgggattacaggtgtgagccaccgtgcccgtcccaaccaggcttcttaaatgaattctaagatagaaacaacaggagctkccaggactctcttaagggctgaacctaggactgtcacagtgacatttctgccatattctgctggtcacaaggcaagcccaaattcaaaaggagagaaatagacctcttagagtttcctaataaaaggtaatttcattaaaaatacaattcataaattagccctatgtttactactgtcttttcagctctttttttattccatgcattaattgattcgtcaccacttggattgtgccaccaatgtttctatgacatgatctaaaaaaaaaaaaaaaaaaaaaagggctcagtagttttcacttaaaagacaaagaggcccactgagctattacagatgttaattaggattcatttactttaatatggtagaaagratgctatgataccactttagtgatgaacaaaataagcttaatcacatcctaggagctaagtattctgacattataatctcttctctcagagtcccatcacagcagtcttaggattcargatctattcttgggaaacattatagaaccagtgtgtcatgtacatacaaatgagggaaaatataatggctttggtaatcctgtagttatctttcttgtcatatactctttttttcatttttaaaaattggggcaaaatttatataacataaagttaaccattctgaagtgtacaatttaatggcatttaatacattcacagtgttgtacgacttttttttttttgaggaaaagcatatttttaggataatgtcaaaacagattaataagatgctaataagatggccagacattcactcagaagtgttttttgttttgttttggtgaaatggtatgagagatatgttgccttacacttaggccactgcattcccgcttaagtgccaggattgtgtcagcaacaggatggcctaaacaatctcagtcttgtctcctgccagccccctaaatcttccagaattgcaagaataggccaggtgtggtggctcacacctgtaatcccaacactttggaaggccaaggcaggcggatcacttgaggccaggagtttgagaccagcctggccaacatggcaaacccccatctctactaaaaatacaaaaattagccaggcaggtgtggtggtgcatkccggtaatctcagtttcttgggaggttcgggtgggatgatcgcttgaacctgggaggcggaggctgcagtgagccgagatcacgccactgcactccagcctgggcgacagaatgaggctttttctttaaaaaaaaaaaaaaaggaaaaaaaaaggcacatttatctcaccttccctcctattctgggaatgctaacatcctcagggaatctcccatattggtcccctataacccaagacttgggagtttcacagccccactctaggtctgaaaacaacacaaaagttgttctaagggatgaagccaccctcaataaaactggaagtcaaagcctgcatataagccccactccctcctgcctaaaaaaggaaaggtatttagatgtttttgtcatggatactttactgggatcaggtaagaactgaacaaatgcagtaagttattggagagttaaaggttaaaaaaggccgtgtgcagtcgctcacctgtagtcccagggtgaggccagggcaggtgtgtcgcttgagctcacaagtaacgagaccagccrgggtaacgtggtgaaacctcatctcgacaaaaaatacaaaattagccgggcatgrtggtgtgtgcctgtagtcccaactacttgggagcctgaactggggaggatggcttgagcccaggaggcagaggttgcagtgagctagatcgtgccactgctcttcagccagggtaatagagccagaccttgtctcaaaataataatagcaattttaatagttttaaaattttgaactagttagaacctctttgatatttacctcacctaggaaattgggatcagcccagctttcaaagggaggtacatgaatttaggactgcagagtacagcaaattttagttcctgatatggccatgctttyctaagaagtttccaaaggttattgactctcagcttagccttttytactgcacaatgtgatagatgctgtaaatcagcgtttagaggtgtttatctaactctccctagtgggagatggggaaattttcactgagaatgtaactctgcacyatgagcagatgtttgctaagtgggcaaggattgagtgggggatgtcttaaactgagggaaaacatttgtaaaagcagaaaggggtgaggatatgacagcaaatttactatagctaacatgagagagaagaggaagggtagtaaatagaattgaagagggtagccaagggccaaatataaatttgtattacaagctaaggaatttttatccagtcataaagagccactgaaagattttatgcagggrattataatgatcagattagcatattaagaagatgattttggcaatagtatggagtctggttgatagggaggccaggtaggaggctactgaagtrgtctggacaagagatgaagtgtacctaaactaaggcatggggatggaacggaacttagcattacaggcagttacttaaatggctaggggaagcaagaggaagcaagaatcattccttggtttaatggtttggatggatggtggtggtctttgttgacgctagatatacaggagtagaaaagccactaaaaaaacccacacacatttctgttttatgtaggcatcttgtataggacagactaacaaaaatgaaactgtttcttaaatttaattgaaatacaatcagcaattttctcattataattttacttaaccctgtacagttcagtctacaaaaataagtattggtagaatagccaggtgcagtggtgtgtgcctgtattcccaagctgctctggaggctgaggcaggtggatcacttgaacccgggagttcgagtgcagccagagcagcatagtgagacgctgtctctaaatattaaaaaaaaaaaaaagtttttttgtactaaagtgaatgtctgatatctgcacaccccacagaatgtacagtggaattctaatgccttatctctgaacttactatatataacattgatataaccttttctattgtttttgacgcctattttattcagttagcattatttcccttggcatccttatagccaggcaatcccttatgatgaaattaaaaaaaaaaaaaagaccaactttaatgatctaaggctgtgctgcttgatatgggagccacttagccacatgtgacttgagtatttgaaacttgactagttcaaaatgaaatgagctgtagatgtaaaatactcactggatttcaaagatttaatatctcactaacatttttgtatrtttattacatgttggagcaatattttggatacaagaagtaaaatttattgtcatgatgaatttttcctgtttttgttgttgttgttgttgttgttgttaactatttttaaaatgtagctacccctgtaatcccagcactttgggaggccgaggtgtgtggatcatgaggtcaggagatcgagaccatcctggctaacacagtgaaaccctgtctctattaaaaataccaaaaattagccgggcatggtggcacacacctgtagtcccagctagtcgggaggctgaggcaggagaatcgcttgaacccaggaggtggaggttgcagtgagctgagatcacaccactgtactccagcctggatgacagagtgagactctttctcaaaaagaaaaaaaagtagctactagaaaaatttaaattatatatatggttcacattatctttctattaactttctttgcttactaagtttatttcagttccattatctgcctagtttctatgctaggtgtgcctaacttctatactagctagagatttgctgcatatgattaacagctgtttcattttnnnnnnnnnnnnnnnnnnnncaagctgtactgaggaattaagatgatcagaaatttacttaatttacattatcacttctacattgatgttttctcaaactataggataatttcctgtttaaataaatgacagagtatgttgtactagaaaagaggaagagaagggaggggcaagaaatatagtctacaagcaaaaacctggattctccaggcctggacaggaaaaaattaagcaaaattaagtggattttcatcagaagggctcttgggaatctataaaaaaggagttaaccttaaaaatatttaaacttaaaaatatctttaaggccgggcacgggggttaaccccctgtaatcccagcactttgggaggccgaggtgtgtggatcatgaggtcaggagatcgagaccatcctggctaacacagtgaaaccctgtctctattaaaaataccaaaaattagccrggcatggtggcacacacctgtagtcccagctagtcgggaggctgaggcaggagaatcgcttgaacccaggaggtggaggttgcagtgagctgagatcacaccactgtactccagcctggatgacagagtgagactctttctcaaaaagaaaaaaaagtagctactagaaaaatttaaattatatatatggttcacattatctttctattaactttctttgcttactaagtttatttcagttccattatctgcctagtttctatgctaggtgtgcctaacttctatactagctagagatttgctgcatatgattaacagctgtttcattttaattcattataagtgcctggaaactgcaataatgcaaaattgtcttcccatattttggaaacaaggttaaaaagttctatagcaccctatagttgattagtaagaacttcaacgcagaatatctgcaggaaactgatttttgtagatgttatcacaattcattttgatatctgtaagttggatagtgtttattaactcttctgcaaataaattatttcttagaatgaaagtctccaagctggtacatggataggattggactagagaaaaagcttatttgaaacacattttatgagggttttcatttattgcctaaacactataaaatttttttgccatgttccagttgacacaggccaagaaatgcctgaacaggtagcaaacacacctagcaaacagggatggctaccatatcaaaaagtctctctgctaaggtgaggtgcagggtttctttttggggtgatgaaaatgttctaaaattagatagtagtgatgctcacacaactctataaatatactaaaatcactgaattgtatactttaaaagggtgagtgtaagggtatgtgcaatatagctcaataaagctgttataaaaaaattctgaagcatgcttatctgttgcagttactgatttactagtcatttaatgagaattaagtgagcagacacagaaagcaaccatatgttcaagaactacagtgatcagacaaaaatggactgtccttttttgacttctgtgtgagccccacagatctggtggcatttagggaagcctaatggccttcttttgtgagtacttgtgaaagttactaacaatgtattagattgctaatacattcaaattctaatgtaaaatgaatgtgatacactgaaaggtacagactgaatccagcagatgagtagaaagaaaaccactccaatatttaatcatttgttgttaaggaatttatccattaacaaagtttttagacagagttgtttatatctactcaaggtgtcattatgcacatctgtttcttgtacctcaggttcatcctatagaaaatcatgctaactcacaagtcatgcagtgttttcaaaaagacaagtcatgcagtgttttcaagttcagagagtagcaaaggatgcaaatctaatttctttaccatttgctaccatctgaagttagtaacattttttggctaatcaccaagcacccagaaagaaagaaatagagcaaatttggtgcatcgtttgtcttccgtatctcctttcgaagtcatttccacaggataagtgccaaagcacagaaaagaagctaggccccacttttactctcatgaacaaaagtcttcccatagatttttacatagctgctgcatttgtcatccctttcctgaagagctttgttgctgtggtcttgctctagggctgctttcagcaacatttctgacgcaggtttaatgctgattagccctaaaacaattctagggcagggctccctgccaggataaagaatgaacaaaattggtttgcatataggccagctgcagttgctgcagctagagtctgtcaaactaggaccattttcttgtttaccaagatgaggttaaattagcacagcatgaggcaaaaaaaaaagatttaaaaaacccagaaaattagctatgcttttgagtatgatgcagtgagtgtggaattaaggtgattttaagttagtttgagaagggaaggtaatatacagtactaaaagcttgattaaaagctgcttgaagatatttgcttgctaactatcttagtaaaaaaaaaaaaaggtatatttgaatagtgcctcaaagctcacagattacatgtagaaaagtctgttggcccatttttattgagtatgtgcctcatgcttacatgcttagccctggtcctggcacaagggtacagaggtggacatttaatagaggaagacactgtctttgagactgggtttctggagactcttaattcaagcctcagctctgtctttaattctcaccttaggcaaaccatgttagctgagcatctgtgttctcctaatgtaaacaatgagagagrgagagggactgctcaggctcttaaagataattcaagtctaacattttttgaattatttgtttgtgtagtgttatttcctaaaatatttgaatcaagttttatgtgttcatagtctctgatagtgggacatccagtctggttgaggaggaaagatgagctgtgtaatcagagaagctgaatgtgagaggtttctgacttccagagcttcagtttataaagctctttccctgcctctccactttgcactgctcccattgcagagactgcccgcagatctacctttgggaactcaggctttttattccagcaatgcaaggctgagttgagggaaggagcccccactttctcatccacctgcaaaggcaagagtacatagctgcaggtaacaagttataggaagggttagtgtgaggcagaaaggcacagtaaaggataaacttcatagtgtttgatgatccccaaagtgtcatttgacttcttagactcccagaacccctgtgcttcacttcccagcccttcatcaactctggattcaaggacttctgaacttgatctctgtcactttctcctccctgaccttcccagatcccagtcttggatcattaaaagcacccctactagtttagggctgggaaatgaggagacttaatcatcttataacattgttcctatgggaggtgaattcttttacagactaacgtccaaatacaatcgttagtaaaactaaggctacagctgttaatttaactgaagcttgtgtagttatggagagattgtttcttttatcagttcatatttctatgcacttctcattcagtactgtgctatacttttcactgcccttcacctcagctaagatggytttcaccttaagtctcaagacaaaggcagcaaacagccaatacagaattagggcatagagctgggtgtgatacagggtgctaactactcatagtccgctttaagcgcaggatagaggacattctcacagaaaaacaaaacaaaacaaacatttgcctatattagataatcaagtgggtagggcttagagaaaaaaggaatcaccgtgggttgtagtggggtagtttatacatgtaggaaacagtcctgaaagatatggatgtgcagaatggaggctgatgttctgagctccagctgagggaattttcatttatctaaagtttttatttctgtttttttttccccagccgaatttaagattcatatttytgttttaaaaagttgtgmaatgaatatagcaaagtgttaacatttgtkgaattcaggagggaaggtatctacacacagtgttaattatttctgttttacttctctatatgctctaatttcttctttttaatttttttgagatagggtctcactctgttgcccaggctggagtgcagtggcaygatcagggctcactgcagcctcaacatcctggactcaagcagccctcccacttcagtctcccaaagtgctgggattagaaggtgtgagccacagggcccagcctgaaattttttaaaattacagacaggaaaataaattgcattaaagttgagcagcccaagaaacaaaggaaagaacttaaataatatatagatcagatggtcagctcttgaaaaggtaggtgttaatggcagtcagatattatatcagtcttgaaggagcmcataaatcgtatattgttttgcaaccaaagaacagaaaaatgactgctatcatcaatgatgaaagctcaaatgtgatgaagaaatggaaaaaatagataatgggccaaggtttcttcatggcttggggttaacttttttttttttttttttttgagacagggtctcactcttattgtccaggctagagaggagtggcgtgatcacagctcactgcaacctcaccatccctagactcaggtgatccagttcaacctcccaagtagctgtctgggactataggtgtgcaccaccacasctgtctaatttttatattttttgtggagacaaggttttgccatgttgcccaggctggtctcaaactygtgggctcaagtgatctgcccaccttagcctcccaaagagctaacagacgcgagccaccgtgcccacccatgcttaatttgtttaggtgcgagatatactaacacagagaatatgctgtacatcattagagaaaatgaatataaataaatgacatactttagtaattatcaaaaggagcaagttcagcccaataaacaaggggcaacctagttttcatacccatacatctacgtgcaagataagtgtaatcacttttttcggaaagagtagcttttaatgcatatatttaaattattttaagayatgctctaaagcctctccattgtgctataattgtctctaacagttgaatttttgccttttcaagaatttcttctataaatgctgagggaagaaccattactgataaattttctatattcctaatatgcttggctaagcttgtagcaaggctcaatatatttgttggttggcagtacagaattttgagtagtctatttataccagtaatattgtgttactagtgaatagatgagtttaatcttagtgtaaaaagcatatctatgtaacagtttttctactgattaattgtatataattgaacagagttcaagttcattcctttttttgttcattccttcatacaaaatgggaagttgtttagaactcatcctgaaaggaattgacatactgtagtctctcacagaagtacaacttaataaacatttatggcaataaaatttacccaccatgtaagtatatctgcaaaactataagtatgtggaatggtcttacagaagtacaaaattaataatgtagtttccctggttatttctcatctatttctatatcatactgtgaaagaatccaatactgttacaataataataataatgataatttaaacataatttcagtataattataatcgcaattttaaaaaatgtatgtgtatrtatttagagatggggtctcactctgtcacccaagctgaagtgcagtggcacaatcatagctccctgcagccttgaacttatgggctcatgtgatccttccacctcagcatcccaaatagctcggactgcagacatgcaccaccacactcggcttataatcgcaagtcttacgttctgttttctttttagagacagggtctcactctgttgcccaggctgcagtacagtggcactatcagagctgactgcagccttgaacttctgtgctcaartaatcctttcacttcagtcccttgagtagctaggactgcaggtgtgcaccaccatgcctaattaaaaaaaaatttttttttttgtagagaaaaaggtcttgatatgttgcccaggctggtccaaagtgattctcctgcttcagcctcccaaagtgttgggattacaggcgtgagccactgcacccagtgtcacaaatcttawtttttttttttttttgagacggagtctcactttgtcacccagatggagtgcagtggtgcagtctcagctcactgcaacctctgcctccctgaatcagattcaagtgattctcctgccctagcctcccragtagctgggattacaggcacgcgccaccacacytggcaaattttttgtatttttagtagagatgggtttttaccatgttggccaggctggtctcaaactcctaatgtcaagtgatccacccaccttggcctcccacagtgttgtgattacaggcgtgagccactatgcccagccttaaatttttattaaataaccttcatagtcctacaaaaccattattgtagaatttgtacaaacaaggtaaaaatctttacacaaagtcagtagtattcctgtgttctttcaactagcccatgttcataattattcgtttattctcatatgcctaacgatgaggatacattctgagaaaatcactattaagaggttttgttattgtgcaaacatcatagagtgtgcttatataaaactaggtagcatagcctactacaaaccttgactatatgatacagcctgttgctcttattgttataaaagatttaaacattttatttataaamtggtattaccaacyttcccctatttctgaatatttaggtaagaagcaaaaataagttatcctggctttgtgtagtggctcatacctgtaatcacagcactttgtgaggctgaggtgggaggattgcttgagctcaggagtttgagaccagcttgggcaacatagtgacaccctgtctctctctacaaaaaattttaaagaagattagccaggtgtggtggcacattcctataatcctagctacttgggagactgaggcaggaggattgattgagcccaggagttcaaggttaccatgaacaatgattgtgctactgcattccagcctgggtgacagagtgagaccctgtctcttaaaaaaaaaaaaaaaatgttatctgagggacttacaagcaatgacaccccagaggtcttcatttctaataccattttccaattaaaggagcagggggtccttggagaaatgtctgatttctagaaatggggcaagaaatatgagccttatactgctggcaattaaggaagtgctcaaaaacccaaaacagaacaaagaagccacacaacacatagatgggggtgcatcaaatgggcataggagccaaataaaagagttgtaaatggcccaaactggaacacactgagcagaaaaataaaagtctgtcatgacttaaaatataaaataaatatgcatgagtccatactgatgtaaataaatgatcagataaattagtaaatggagaagagacaaatctcccttacagaagaattccaaatgatagaggtagatacgtactttaccctcaagaggtgaagtataactctctatttctaaaatgtgggttgggtagagtgatttccatctgaagattgcaatatagaaaaggagagaaaaaagaacttttctgtggagaagcctgaagaacactatcttagccaagtgatcaaggttaacatcaactgtgatgtcatattgacagtatgaatcattgatattaagtgatgaaaatggcactttacctgtgtggtcttccccaaacctataaactcagtataatcatgagaaaaacatcagacaaatcccagttgagggaccttctacaaaatacctgaccaatactactcaaaactattaaggtcatctaaaacaaggaaaatgtgagaaaccgtcacagccaagaggaacttagggaggcttgactgctctaatgtggtattttgggtgagattcttgaacacaaaaaggatcttaggtaaaaactcagaaaatctagataaagtttagactttcgctaataatgtaccaaatactggtcgttaattttaataaatgtactaatgtaagatgttactattaggagaaactggttttagggtatgtggaaactttactattttccctatttttctgtaaatctaaaaccattctaaaaattaaatttactttttaaaaagtttcttaaaacaatgaaatgagtttgaccaatgcaaagctgaagaaagaagataaccatgaaatctaggattcaaagcaaaggttaataaaattttgattatgtgacaccatgacggatatacagtacaataataatatccctatgtttgaaataaggtaggtatcaaattttaatttacaaaccaacacaaattattaaaggaataaaatattctaaagaaaataggctgagtgcagtggctcatgcctctaatcccagcactttgagaggccatggtgggaggatcccttgagcccaggagtttgagaccagcctgagcaacatagcaagaccttatctctactaaaaattaaaaaaaaaaaaaaaaattagccaggggtgtggtggtgtgtacgtgtagtcccagctactctggaggctgaggtgggagggtcgcttgacaagcccatgaggtccaagctacagtgaaccgtagttgtaccaccacatgccaacccgggtcacagagcaagactctatgtcaaagaaaagtgcagtggaggctggtgcggtgactcacgcctgtaatcccaacactttaggaggccgaggcgggcagatcacaagatcaggagttcgagaccagcctgattaacatggtgaaaccccgtctctactaaaaatacaaaaattagccaggcatggtggcacgtgcctgtaatcccagctactcaggaggctgaggtaggagaatcgcttgaacccaggaggcagaggttgcagtgagctgagcactgcactccaacctaggcaatagagcgagactccgtcamaaaaaaaaaaaaaaaaaaaaaagggcagtggaggggatgtttttatttcttaaattatattttagtttatatatagtcaaggctttgaaatgaatcattttcaaagctaccaatattttaaataagtgwcttaaaaattttrgagtatataattcagacctaagagtacagtttttattcatctatccatttactcaacgaacatttttattgccaggcacaatattaagtaggtgttgaggatgtaagggtgaataatgtgttgaagagcttaatttataaaggggaagatataatttaacagtgttaatgtaatatggtaagcagacaacaatatgccatagcaattatgagaacaaagttccaagaacttcacagtgctatctctgttaaaaaaaaaaaaaagacatcatattcacgtattattaagataaccaagaaaggaagataaatgctttatcttgaaccttactgttgagaaaaaattttattttaacacatcaattaatatttgtttagtacagtgtttgtacgatagtggttcatttaaaaattaagctatggaatttttaaaatattggaccataaaaatctgttctaatttgtagattttgtagygttatggaagaaactcctctcttctggacaggtcaagaaaggtttccccaggaggtctcttctgaatagaatctttgtttttttttgagacagggtctccctctgacacccaggctggagtacagtggtgcagtcacagctcattgcagtctggaactccagggctcaagagatcctcctgcctcagcctcctgagtagctgggactacaggckcatgccaccatgcctggctaattttttaaaaaaaatttttttgcagagatggggtctcactgtgttggccaggctggtctcaaactcctgggctcaagttatttcccccgccttgacctcccaaaatgttaggattacaggcatgagccaccacacccagccctgagtagaattcttaaagatgtgtaggagcctaataggcagacatggaaggaggggtgtggtaggcagaatttttaaaatattcccaaacattgtcttctgggtattcagttaaagagcagtctaggttctgctgttaaggaattttacagatttaattaaggtgactaattagctgaccctaaaatagggagagttgcttgaattatccaggtgtgtcctgtataatcacgagtccttaaaagcagaaaatctcagctgctgcagaagagagaagaaattagagagatttcaagtgcaagatggtttgatttgagatgttgggtgccatatacaaggaccaaagagagatcttaggtgctaagggcagctggctgacagcttgcaaggaaacggggaccttagctctacaaccataaggaactgaattccagcaataaccgcagtgtgcttgaaaatggattctttagccaggtgtggtggcgggcgcctgtggtcctagctacccgggaggctgaggcaggagaattgcttgaaccccggaggcaaaggttgcagtgaactaagattgtgccattgcactccagcctgggtgacagagggagactccatctcaaagaataagaataaagaaagtggattcttcttcagagcctccagaaaggaatgcagccctgtcaacaggatggtttcagtattgtcagacttggagtaaaggaatcagctgagccatgctgtgccagacttctggctcatggaaaatgtgaaataataaatgtgggtgtgttaagctgctaaatttatcataataacttggggcaatagaaaattattacaggggaaaagttgtttcagacacacgaagtctagcaaggacccataagatatcgtacttaaaagggaactgcacgtcatttggcgtggctcaagtgcaggagcctcagaaactaaagtaggtccagctagatcatggtggtcctcaaatgccatctaaggaatctggacttagttggcagggactgaatttgtgacactggtatcttagttcacgttgattttcccaaggaggtaagattaattctctgtctccttcaagtttgctcaaacatcacctcaatgagggccaacttgatcatcctacttaatactgcaacttgtgtactgctggctttcctcactttattcttttttaactttccattgcacctttcatcttccaacatactatataatttattatacttattatctccctcctcttagaatgtaaactgtgagagcaaggattattttggatattttgttcactattttttccagttatttattgttgcataataaactatctcaaaatttagccacttaaaacaaccaaacttttttaaaaattatttttatgtatttattttgagaaagagtcttggctctgcaattcagtggcacaatcatagctcattgtaacctcttaactcctgggctcaagcagtcctcctgctgtagcctcccaagtagctaggcctgtaggcatacaaaactatgggtctctccccttagaatgcctcagcctcccaaagtgttgggattataggcgtgagctgccacacttggccaaattaactcctctttagggatgaataagtggataataatacttagatggctacatgaattgtggcactgtcgacagaggaaaagctttgaggggaaaaatgagcttggttgtgtaaacgttgatgttgaggctgctgagtctgagacagcaagtggagattcttggtggatagtaaaagtcatgaattgaaactcagggctggggatcatcttgaggattttctttttatgtttttctgatggagggaggaaggaagactttgtttttcccatggagaaggggaaaattctgctcccttcacctcactttttttggttttggttgctttgttttatgttaattttgcagacttcaaaaagtggttaaaatggctccacctcgcccctcccccaaaggtgacttgacttttttctatttcaaaaaagtacgttaggtagtagctttgagaatcacagtctctgatagaactgggagggtcttagtcatcttataggtcattgttctcctcctgatatatgtgatgtgtgattttcagtctgtgcagaaccttaatactattttaaaatctgggtcttctaacaccaaacatagtaggggagggccttgaaggcctttagatgaaaggccacacactaacgcagagagactcagataactgcttttgtttagcacaaatcacatcaactgaaccattttaagcttccaacaacttcatttaattgttagaataatgagacttctgtttgattcttacaggaagattctctttcccagtgagtctcgtttctaacatatttagcccagtttgctcatgttaggataatttcatagaccatgaaacaggatagtctatttactaatagactgcattgactaatgtgatattttacattagtagaacaaatgtacccccttctctaccttgtaatttatatctttcttttagagaastttgttgatttctaatgtaggaggaagaaagtggtatttttgtgtaagcttaactgagttccttgtgtttttgacttcttataaaaatttttttggtgatagtatgtattggcagcaaaagtagttaatggaaatggagggaaaggtctactttacctctgaccaaatgactgcttctttgagtcatgcagcaggaaagtttgtttgaatcagcttagcagtgttgctccatagtgttacttgtcagccctaagttttttaatgttgagttactttcttttgttctggaaggcaaagcgtggctctcttggtgtctctttagcaaagaatatgttctttagtaatggggaaagatttgttttatattgaataataaaatgtgacatggataacaatatgctttcccagaaatacattggataaataatttccatagaaggtaaatacttaagaataattaataatgtgtttctaatttagtaataaaataatgtgttttctataagagaaaactcttgctcaaagacattgtgatttgcactaggctactagaccagcatattcagccagaaccagaaccttgttttcgtggctgtatttattatttgaaaatcacttagatgttcttcagaataataaaaattatttactaagcactggcaagcgcatgacatttattaatctaaaaattatggactctttcctcttagagtttcataatagcagttacaatacttaaattacttaaaaaatttttttttctcacttcaaattttattattagtatgacaaacatgggctaggatcaaaaactttgtttattccttattatcagagaactctagatcttgaattcattgctaaggttatttttgcaagtaaataatctgctgttgtgttctttgattggtggtaagctgcacagcacctaaaactgtcgtataataatttggccaggtgcagtggcaaatgattttaatgccagtgctttgggaggcccaggcaggatcacttgaggccaagagtttgaggccaagaaacatttttatttttttgtttccatgaaaaatagaaataaaaactcatctgggcatggtggcgtgcacctgtagtcctagctacaaggaaggctgaggcgggagtttgaggctgctgagctatgatcgcactactgctctgcagcctgtctctaaaaaaaaaaaaggaatttgtctggtctttgtctgtgtttcctgaacttctcaaacccttggaatttcctgagtgacgacgggaatgttatgctaatcaggtaactaatgatgggcctctggatagcttcaggataggcgctgtctctggaaggaccaactatgtggttgggactctgaaccaacctggcctctggagagggaaaggagttggagattcagcttagtcttgtagccaatgatttaatcagttgtgcatatgtagtaaagccagtaaaaactctggacactgagatttagtggaacttcctggttggtgaaaacactgatgtatgcgcaggggaaagtaggtgacatgccctttttccacaagaagaaggcatggaaactctgcattctctccttgatcttaccctatatatctcttcatttgattggtcatcctgatttgtgtcctttgtaagaaaactgtaattgtaaatacatcactttcctgagtcctgcaagctctagtgaatttagtgtacctgagggacttgtggaaactctcaaatttatagccagtctgttagaagtgcaggtagcctgggacttccaaagtgtggctggtgtctgaaataagggcacgcctatttgggagcgtacccttttacttgtggggtctgtgctaactttgggtggctgatgagagaatcggattgcagtacactcagttgagattgaaacagaataactgtgttgtgaaattttggttttcagtgaataaattttagtaattgcaagtgtatttaggcaggwccgagtgcagtggtgttgataactaattcattacaatcagttacagatttctttgttccttctccactcccactgcttcacttgactggcctttaaaaaaataaataaataataaattaaaaagagaaactatatttagtgttaggtaaatataacatggctctttaattttgatrtaatcaagaggaaagatattgtgaatctcttaaaaactcaaagcttactggattgatgttgatgtactcttactaaaatcttaactaagtctaggcaaggtggctcatgcctgtaattccagyactttgggaggctgaggcgggcagatcacttgagcccaggggttcaagaccatgggcagtgtggcgaaaccctgcctctacaaaaatgttttaaaaattagccaggcatgagagtatatgcctgtagtcttagccatgtgggaggctgaggtgagaggatcacttgagcctgggaggtccaggcagcagtaagccatgatcgtgccactgaactccagcctggacaacaacagagtgagactctgtctcaaaaaaacaattaattaattaattaattaaaataaactttaatattacctggatttaagtttctgtgttgttgaatattccttaatggagtcgatgaatttgcagagacccctccaagattcttttgtttgattcctttcatgaccatcaccctagaccttcaagtttgctgactagatttgggggttgtgtgtttagaaaggataacaagcttgtcatgggctagaacctgtggtcttcataaatagcttagtaggatatatggctttttctatgaaaggtggagaacatgcattaaaaatgggcaaattctggcctgggcatggtggcttatgcctgtaatcccagcacttgggaggctgaagcgggcagrtcrtctgaggtcaggagtttgagaccagcctggccaaaataatgaaatcctgtctctactaaaactacaaaaattagctgggcatggtagcacacctgtagtcccagctacttgggaggctgaggcaggagaattgcttgaacccaggaggcagaggttgcagtgagccaagatctcaacgtcacactctagcctgggtgacagagtaagactctgtctcaaaaaaaaaaaaaaaaaggcaaattctgtcttatacttggagaactgtactcgtgtatttaaacatgtaacaagcaatgtagacagttaccaatagaaggtacgatatagtcaggggttagtattatagtcagaaagtcaaaacgaacacaaataaaaactcaggctagtaaacacatgaatagctaactgctgtaataacaaccccataatacttcagtggcatgagacaataaaagtttttctcattcacgtttagtgtaatgtaggccaaggtgggaggcactctacttcacaaagatatttagtgactcaactttcttccactttgagaactgtccatcttttaaggcctcctttgcatttagctgatagatggcagaggaaagatagattgtgtgccttgacccggaaatgacgtcattgctgcccacatatcattggcaagaactaatcgtttgacccccacccagaagcagattttctttaaaacttctaggctcctggggttatctgtcagggcaggaagagagggaaatagtgtgagacttagctttgttttgtggagaaagtctctggtcacaaacaggctatgatggaagtggatagtgcaggaggtaacttactggggccctcctagtgggaaggtttagggaggagagtgagtgaagaaatatttaaccatgatgatcaggctgaaaaacagcccccaaggttcataaatctcaaatattcctcttcatttgcaaccccacaagcatgctatagaaatctctaccagtaactttgagctggggatggggtccctatttccactgccaactgagaggaagcgtgaagcaaccagaaggccagatctcatattcctttggtgaagagagatgtgttcttggcattctaacatcatctacattcatagtagcagaacttttgtgctatatttcatgtattttatggagattgagaaattttaggagttcagtatttccagagctgcccatgtacattctagtatgttaagttaaaaaattagtcacacttctttttaaattatacattatctgtttaaatatatgtcctataaagtagactttaaagtccaaactttatataaatggtgatttacgttatagcgcacttgaatcagatgtacttatttcactggaaattctctgaattatttaaactgaagttaattggactttggtaatctagaggcaaggatgaaatatttgaatatgtaaatctattaaaatgatttttgcttatgtgtagttctctatataactggttaaattgacctggaatagctttcatgtctcattttattaatgattttgtttaaaactaggcttctggggttacctgtcaggacaggaagagagggaaatagtgtgagacttagctttgttttctggagaaagtctctggtcagaaacagactatgattttatcagtgagacatgaaatcaaacatgataaacctctctgataaaaccggaaacgaggactatgtgaagtaattggaactattggtaaatattcctagtgataacctgaacatagccaagagtttctgccttaatcaggggaaaatacaggcttaagataggagctgggcaaaattgttagaccagttaatggatttgtttccctactttgcatctcattttgtggaagtgattttcagtgtcaattgtttgtttagacacagagtttggccctgttgcccaggctggaatggatcacagctcrttgcaacctccacctcctgggttcaagccatcctcccacctcagcctcctgagtagctgggactacaagcacctgccaccacgcccagctaatttttatattttttgtagagacagggttttaccatgttgcctaggctggtctcaagctcctgaactcaagcgatctgcccacctccacctcccaaagtgctaggattacaggcatgagccactgcacccagccttcattgtcaattgtaaagctcatgcttgcttttcctaacggggagatttttgtgtcatagtgtaattcccctctctcctcctctcatgagtagctgttatccctgtaaactaaagggaagagaaatacctgtagtatatatttaattattgaggtctccttcttgaattctttcatgctagtcccatatgtaacaattgtttccctcccagaagtgtgtttctggaggagggtgctgacttctgtgccctctgtggcacccttaaccaaggacttggatgtttgctcagaggtctttcagctatctatccatgaccatggatgtcagttcacagccctggctgttcctcagagatctaagtaaccactttgatgatttcagggttctcttagatatttgtaataaaccgattcctttattacyctagttcagttctgtaggcagctttctcagccctttgttgtttttgttgaggagagagtatgaaaggtttctgtaaaccttgtttgggatattcagttctcacagtatctgtgggtaagtagccccccagcgtagaagcttaatatttgttgctgtccttggatcatcaaacgttgggggtgtggatagcaagctctcttggccattggtaccctacattatcattattgactatttaaaagaaagactctgacatctctttaaagatatctgagttttagacatctgagtaaccaataaaagacattcagaagtttttacactcttcaaagctgctaagttatagcctgtgtcgttacagtagtaaactttcctccaagagttgacactttataattatgcttaggaatattattgacgaaatgggatatcagtataaagcaaatttcagcttatgtttgcattgataaacatgatttataaaaggtagattacttataagattgaatataatgttttttttgtttttgtttttgtttttgagacagctttgctctgtcacccaggctggagtgcagtggcgtgatcttggctcactgcaacctccacctcccgggtttgagggattcttctgcctcagcctcccaagtagctgggactacaggtgtgtgccaccacacccggctaatttttgtatttttagtagagatggggtttcaccatattggccaggctggtctcgaactcctgacctcgtgatccgcccacctccgcctcccaaagtgctaggattacaggcgtgagccactgcgcccggcaagattgaatataatgttgctggtgtttttaccttaaatactggaatgtaatttctaaaataaagttgtttttatatttgcagaaaaattgagaatggagttcccatatacttgcctcaccccacacacacaatttcccctatcattaacctctcgtagtatggtacattagttataattaatgaataaatattgatacattattgctaactaaagtctacactctatttagatttcttttttctttcttttttttttttttgagatggagttttgctcttgttgcccaggctggagtgcartggcgcgttctcagctcactgcagcctccacctcccgggttcaggcaattcttctgcctcagcctcccaagtagctgggactacaggcatgcaccaccatgcctggttaattttgtatttttagtggagacagggttttgccatgttggccaggctggtctcaaactcctgacctcaggtgatccgccttccttggcctcccaaagtattgggattacgggcatgagccactgcgcccggcctctatttagatttctttagtttttacttaatattcttgtattmgtctgttttcatgctgctaataaagatagacttgagaccgggcaatttataaaggaaagaggttgaattgactcacagttccatagggctggggaggcctcaggaaacttacaattgtggcggaaggggaagtaaacacatccttcttcatatggcagcagcaaggagaagtgcagagtgaagtgggggaaagccccttataaaaccatcagattttgtgagaactcactatcccaaggacagcatggaggtaaccaaccccataattcaattacttctcactgggtccctcccacggtgtgtggggattatgggaactacaattcaaggtgagatttgggtgaggacatagccaaaccatatcagtcttttttctgttgaggtatcccatccccataagttgtcatgtctacttaggctccttttggctatgacagaatctcagactttcattgtttttgttgtccttgatagttttgatgagtacttatcagatatactataggttactcctcctggaatttgatgtttttcttatgattagactggagttatggggttctgtgataagactgtttaaccttgtaaggaattgccaaactctcttccaaagtggccgtacaattttgcattctcatcagcagtgaatgagaattactgtcacttcctatccttgtcaatatttggtatagtcagcttttgggacttaagccattctaatcaatatgcagtggttgggatgtaatttttttttttttttttttttttttgtgacagtctcactttgtcatccaggctgaagtgcagtggcatgatctcagatcactacaacctccacctyttgggttcmagtaattctcctgcctggccttcctgagtaactgggattatgggcacccaccaccatgcccagctaatttttgtatttttagtagagatgaggtttcaccatgttgatcaggctggtctcgaactcctgacctcaagcaattcacctgcctcggcctcccgaagtgctgagattacagttgtgagccaacatgcccagccaggatgtaattttttaaagttggtcatttagtcttactgtcatactttttaggttgagcattcctaatccaaaaatctgagatccagaatactccaaaatttgaaactttttgaggccagtattctaattttctaattagggatgctctttaatttttaaagttggtcatttagtcttactgtcatactttttaggttgagcattcctaatccaaaaatccgagatctaaaatgctccaaaatttgaactttttgagtgccagtattccaattttctaattaaggatgctcaacctgtaaatataatgcaaatatttcaaaatctgaaacagtcagaaatccaaaacccttcttggtcctaagcattttggataagggatactcaacttgtatgatatctgactatagaagcattagctttctcctaatattcctctttaagtaagcattaagaagagaatatgtgtgctatttcccatacaaaacctgttagagatatttaatagcatttcacttattttgttaaaattacctattctctttgctttcattactaatcccttatcagctacattccattggtgttaagctacattctaatgttaatgtctcctgtgtgattgcttttggttaattattctcattttccattcttcaaagtcatttttgctttttgtttgtttttatttgttcataaagcttttttgtttctgttacattatgtagttttgtaccaatggctagaagcagatcgtcatggcaagagccaaggtgctgcaaatacgacttcaggtaaaaataaaattaagaacaaggatgggctattataaatcattattttaattgactgcaagcccattataaatgtttctttattcagttttgcttggtcagacttgtagatgttattttatgtttctcttctctcatctgcatcttaattttcataaagacttcatttgcttcaagccttgaaaacatgtattcagtagtctttaagctctcttggcagatatttcctactttcttaggaggaaaggattaattgcagcttcaatttagtaggaggttatttggcagtgttacttggagttaagttgatatgtagttgtagcagtcgtacaaatttatagtccttgtttgtttcaagataatatttaaaaggtaaattttaagtacaggatgcttatgtaatttttcatttcctgggaatccaaattcttagacttggttattttcctgttttttttycccagcagtaaattytaagttagaggtaaaacttgtgtttaaaatgagaagtataggttgttcccccatctctcatccccaaaagtcatcaccaagattctcttcttttggccagtgctagtaggaatagctgcatccagtcatttctaaattctyttttttttttttttttttgagacggagccttactctgtcacccaggctagagtgcggtggtgtgatcttggctcactgcaacccccacctcccgggttcaactgattctcctgcctcagtctcctgagtagctgggattacacgtgcatgccaccatgcttggctaagttttgtatttttagtagagacaggatttcagcacgttcgccaggctggtctcgaactcctgacctcaagtgatccacctgcctcagcctcccaaagtgctaggattacaggcatgagccacagtgcccggcccatttctgaattcttaacagtgatatcagaatttctacatagttagttcttcccctaatatccttccaaatcatatttgccaagacagctgtgtatatatagcaatgatctttcctgttaccccttttttaagcagtctaataagcagtggtggtggtggttttgcttttcttttgttagatttgttactgttttgtggctttttttgtttttgtaaaattatttctttctggaggtggtttccttcttgttgattctttgtgtgtcaagaaggtgcaatgttccttagttaacagaacaattatattgagaatggcactttcatgacctttctgatatatctcctgtcccattaataacttgatacatgaatgaagataatgttattttaactatacacaggcaggactgaattaaaaggtaagtgttgcaaggagttttatgataggttatgtcttgtttcttctgcttctgcagtgtttcatattttatttacatttgtggataataaaagcaagtatttctggtgttagagggtaggtgaaggagagggtttcttgatggctatcatgaagttacgctgttgctgtgtcagtacactatcagcagcttagactataactgggaggaattttgttttttctctaaagtgaaatgaaaagtaacctaaaaaatcaatctatctttcttttcttttcctttctttcctctctttctttcccttccctcccctcccctctcctccccgccccctccccctgcccttgcccctgcccctgcccctacccctccccttgcccctccctgccccctccactgcccctccccctccccttgccccccctgccccctccgctgcccctccccatgcccctccccctccaccctccccatgccgctcccccttactttcctttctttcgagatgaggtttcactatgttgctggtctcaagtgatctgcccacctcagcctcccaaagtgctgggattacaggcatgagccaccacattctggccaagtaacttttttttaaatgaagaagtgaataatttacaattcttagtgttcacaggaaaatctagcatcagcttaaaaacatcatggactcttcctgaaatcagttctgagccctgaatctgttcttcagccacattgactctcatggacagtttcacattcctctgctgactttttgatgcttacatactctagaagcttggtgcaaaaattgataaactctccttaaggatgtctgacaatttctcttctagaaatgaatgctctcaactcttagaagatggaagtatggagtagaaaaatacagagatgamatgtttgcctaaataagtcagaggaatctaaagaaaataatgatcattagccaaggacttcagttagaaatagtagtttagttgcctaagcaaatrtatttaaattatgtgtccttgttcaaaaaaattcctatgtattttatattgttgtctccagcaagatttttgagtgtgactttttcgtccttctgcgatctgttttgcattccaaggtggtttttttttttcatatttttacccaaaatagaaactgagtctaactagaagtcaaatacaattcataaatcaaattgctttgtgatatttttaatagtataaatactggtaaagtgacatttatcttttgctgtaacagctagtattttgcacttaattagaactctaaaagtaggaaaacacacaacacaataaaattgttgcaagatcttctagttccttgatcccaaatttttgacattgggaatttaagatccgtctaccttaaaatatttcatgaaactaaaacatttagggataataggtcttaagggaattactctggttgaggaggttaaaaaaactaatctgatagctattattgaattttcaatgttttactttttaaaaaatttattwaaaaaaaaataggaagaaaagaaacggggtctcaccatgttgcccaggctggtttcaaattcctgggctcaagcaatcctcctacctcagcctcccaaagttctgggattacaggcatgagctactgtgcctggcctgaattttcttagtaattaaaatgtagcctacttttatgtttccagaattttgccagataatgaatttaacttaggatagctcatttattttaaaaggttagtatgtttaatgtgttctgtctactaaacaggatgactcagcaatgatgtttctaattctgttaattttgttactggagaacctggatatgcaatcacatttctcagagatttttgtggaaactcaagcaaaattgcttcctttgagcactgtagcatgggggtctaagtgtgtataaaattttaggatcataagacatatgattagcttaatgtaagacttttcttttctgaagtaaatgttttcatatagtttattattaccacacactgaawtgtggaccataattaggttacarcaatgattatattaccatattttgatttttagtatcagttgagtagccaggattttaaaattcagattctgaagttttaaatgctgctctgttgttaacagttttttagttgtccrtcgggattttacaatacagatggttagaggcagaaattgaatcagatctcaayattatcagtcagtagtaggactataaaataaatagaaaactatgacatgcttttggaaaagttcwagatattaactatgtattatttgttgtaggcgaaaattttgaccagagtcctttgaraagaacattcaaatccaaagttctcgcccactatcctcagaatatagaatggaacccttttgatcaagatgcggtgaacatggtatgtgttttttttcccctcatttactctttagccttgttttcactttattaatatgaaggtagtgactgtattttgaatgtctaccttatttcatttcatttattctttaagtgattttataagaaatgtgaggccgggtgtggtggctcacacctgtaatcccagcactttgggaggccgaggcaggtggatcacctgaggtcagtttaagaccagcctgaccaacatagtgaaaccccgtctctactaaaaatacaaaaattggccaggtgtggtggcacatgcctgtaatcccagctactcrggaggctgaggcaggagaatcacttgaacccaggaggcggaggttgtggtgagccgtgatcacgccactgcactccagcctgggcaacagagcgagactctgtctcaaaaaaagaaaaaaaaagaaatgtgatactctcctcattttaaagatctggaagcagaagctcagagaagcaagttacttgcccagggtttccatagttaataagtttatacaatagatcctaaaagcccattttagtttcctactattaaactgtgttgtgcatttgtattaatatgtagaagctttgataaacagtgatattactttattggcctgagaggagcctgatggaaagagcctgattacagttctcatgtttcaaggaatattgtatggtaggcctataatytgtcatttttacagacartgtaaagatgaaaagcaacttaattgcgttatttaggtacagtagaaatctgaatttgtattattgttaccggtggatggagtccagcttcttggtgtctggaacaaaaaattggacaaaacatacaaacaaagcaaggaaagaatgaagcgacaaaagcagagatttattaaaaatgaaggtacaatccacagggtgggagcaggcccgagcaagcagctcaagagcccattatagaattttctgaggtttaaataccctctagaggttttccattggttacttagtgtacactctatgtaaatgaagtaatggcccacgatcagtctgtttggttgtgggaggatatcaatcagaagctgaagcaaagttacaccctacacaaacatacaaccaatcagaggctgaagtgaagttacaaagttacactcctatgcaaatgaagacttggcccacgaccatcctgattggttgtgggaaggaaacaatcagaggtactttcagtttttagtctgtcatgcagaaaaagggtagggggaaggtacaaagggagtagccactggtccttttgctacttgggcatggaaagttggggttttccttttgatttagttctagaaagtcagcatgaatcggccttaggttccctgcctccagaccctgttctcctgcctcataatgagttaccagtgctgattaaatgtctcttttatccctgcatgatgttgtgcatctataagcccagctactcaggaggttgaggcagtgtgactgcttgagcccaggagtttgagaccagaatgggcaccatagcaagaccctgtctcaaaataggtaggtaggtaggtaggtaggtaggtaggtagaggtaggtaggtrggtrggtggatggatggatggatrgatagatagatagatagatagatagatagatagatagatagatagaagatagagagatagtcaaccttgagagggtcttagaaataaagtaggtcatagttttcagattatttaggaagggctcttcttagaagcctgaataatatttgagatgttcataaactctatgattatataattcagggggccccaaagtaaggaggtagcaggcatgatagatatagaaatgaattgggtatatacgtaagaatgggaaaaaaataaaaaagatacagaaatgattaaaggtgaactgagacacagtgatagccattgctatttttgagttgttttgtttggtttttgtttttgtttttgagatagtctcgctctgtcacccaggctggagtgcagtggcacaatcttggctcactgcaacctccacctcctgggttcaggcaatcctcctgcctcagcctcccgagtagctgagattayaggcgcacaccactatgcccagctaatcttttgtatttttagtagagacagggtttcaccatattggccaggctggtgttgaactcctgacctcaagtgatctgccctccttcagcctcccagaatgctggtattatgagcacatcccaccacacctggctcatttttgcatttttagtagagatggggttttgctatgttggccaggctggtcttgtactcctgacctctagtgatccacccgcctcagcctcccaaagtgctgggattacaggcgttagccactgcacccggcctcttttttagtattttaaagatattgttaaaagactccattataacctgataatctaacagaaggaaattaatattcactagatgcctgctagagtactttatgtatgttattttcacatacatgtttacatgtacccagtgagaattcttatattttcaaaggttaagtaatttgcccaaagttaggcagtaagactcagaaattaaatccagatcatttttactctctagctcactttttttctcawctgccttgctgccttcccaaaagaaaaactgtgtaactgagttttgatctacactggaaatgttatgggtcacactggaccctttgtgatatttttgtatcacagtaaactctttccagcctgggctcgctctagggaggggatagcatggtgctatttgtaaggacaaatgcctaaagcacttggcactttgactttgattccttacagagtacaatgtggttattttcctaaactgttatacaatactaaaataatcagagatgccattttgctggaagttaatattgtagatgcctagcgtcatctttggtgaagactctactatagatattatgtagaacacaactgttagttatctttataagacttggaagagtccagacaagcatctgactaaaatagttgaacagcagtgacaaaaaaataacttatgagctgcttatgcagcaaattaatagaaaggcatttaggaaaagagtgtttaaatcaagcagtggaaaactggataagaatatgaatagatcacaatacttaatcttcttaaattagtaagatatttcaaaatataacttattctgtgagaaatcagaatggtattcaaagtgaggttctagcctaagcaacatagggaggccctgtctctacaaattaaaaaagaaatagctgggtgtggtggcaccatgcctgtggtcccagctactctggaggctgaggtgggaggatcactggggcctgggtacaagtacgttcttactatatgaatccacagtcatttggaacaaaatgccacccttcatgtgttttctttcttttaatcatttgaatgaattaatagtgagatatccatgatagcttttgcctctatctgcaaaacattaatctttaaagtaattatcagcttccttgatctttgatattttctttactccttgcccctgaggttattttatgtaagcagcaaaagtttccccctgaagaataatcgcaaaggctgtgttttgatggttaagcaccacatagcattttttttattgctgcaaatctaaaaggatttgcttgtactcctggaaaatctctgaaaagcatcccattaaagtagtttgcattcgggtcacagatttactgcctttaatttcctctttgatttactagtaagtgcgtttgtatgaagctgtaatttattcccacctaaagatataaagctttgtcttgcctttagcaaaattccaccgcagtgagtcatcaccttctgtaatattagtcattcctctaacaacagtagtgctttgaataaaaggtcattaatttcatacataaattaagtacccaaagcagtgaactttgttaaataaaatgtttaatgtgtatgagtacagtgcaaataaaatagaaaataaatacaagtgacaggtgaaataattcctgaattagttttttttcctcagttgctgatcagagatttttatgaaaaaaagtaaatatcacagaacagaaagaacaatacaataaacagtcaatgtatgtattaatcacctagaactaacatatgtcaacattgacatgtttgcttcagagctctacatttcctttcctttccctttcccttcctccctttctttgctttcttttctttctttcccttgtttccacagtctcactctgtctcccagattggagtgcagtacatttaattaaattaattaatttatttgagacagtctcactctgtcaccctggcagttcagtggtgcaatcttggcttacttacaacctctgcctccggtgttcaagtgattctcatgcttcagcctcttgagtagctgggattatagtcgcgcaccatcacgcctggctaatttttgtatttatggtagagacggggtctccctatgttggccaggctggtctcaaactcctggcctcaagtgatctgcccgcctcgacctctgtgagccactgtgcctggtctgcatttcattttaaatgaaataaagcattgcaaacagagctgaaggtcccccaccccactttcacatctctttgaggtaatctgcttattggcatccatgactatgtaatattctagttgatagatcttatctttaagcctgtgttgtacctaagaattcataggaagaaaacrtggtcaataacttttaagcaaactgtatgaaaatataaggattctattttttatgtctgtcctaatgaaacatcataaatatattttaggtaacaaaagagtaataactattataaagctcttactttataatttgctgttaactttgattacaaagaaggatatagtggaatgaagagcaaagagtaaacggtgaaaggttggctgaagaaacctattcagatgcttatcttgtaagagtaaaaggaaaaagggctatatatactttttgtagacttagcaattacttgaatttgaaatggataatcccaaattacattcataggtttgacattagaatgaagataagccctcattttgagccaagtttaggttcaagctcacaataaaattttttttttttcttgagacaggttctgactctgtcatccagactggagtgcactggtgcaatcttggctcactgcagccttgacctcccatgctctagcgatcctccacctcagccccccaagtagctgagactacaggtgtgcaccaccacgcctggctaatttttgtactttttgaggagacggggtttggctatgttgcttaggctactctcgaactcctggactcaagcaatctgcccacctcggcctctcagagtgctaggattacaggtgtgatccacgatgcctagccatatctcacagtaaaattataggaatggggctttcattgctggaggaccattgctggaagacccttttgcccccgccacccccatcctctcscccgtttccttaacattgcagctagaatatttcactggcatctcaaatgcaacatatccaaaactgaattcattattcrtcccaccagtcttttgtcagtgaatggtacaaccatccacctacttgccaagtccaacaatgtacacatcaccctgaaagttctcacttactcaccctctcccatatataatcagttatctgtctacttctctctgttccgtatactcaccttggtccaaaccatcaagatctcttacctggactcctgcagtaacctgtccatttcattcctcatactatagcttctgcttctgctgttccttctctctggaaggctcttccacctctccttcacctagtgaattcttactattccttcagacttcactgtaaacatttatatagagaagctgctcctgaccatcaccttccaccgtcttcccagcactcaggtcaccttaggttctcttagtaccttgtatacctttttgtagcacctatctcagttgcagttaaccaattacttagctagtagtcaactgtgtatctcgtgcttaatgtaagcaccatgagaacaggagcagtgtctcttattcattgttatatccctagctttgcgcatagtagatgttcaaattgttgaataaatgaagtgatacttgcttacaatacttctcttccctgtccttgactaggtgtgacctccactgcaaaaccatctcttaagcaggagtagttactctgtcttttcttatgatatctcgaacagagtccgtagcaacactgatcacatttttttggtaactgctggtttctgtgtctgtctttcctactagactgtgaactccctaaaggaaaggattatttttatctttgtcttttgagttaccaagatctaatgcaaaacatgggacaaaataagtgtttatggaaggagggagagaagaggggagggagggagggagacattctgagaaatgtgttgttaggtgattttattgtgcaaacatcatagagtgtatatacacatacacagacctaggtgatatagcctactatacttctaagttatatggtataacgtattgctccagccgttgtcctataggcagtccattgttgaccagagtgtggttatacagtatatgattgtatttgcataatgagggagaggccatggaagtcatagaactacaagatgtggaaaaaggaattttaaaattctagccaaactgcctgaaacggtctagagaaatataagaacatttgctgactcaaactgggaaagttacacacttgtcattataagcctgctttggctaaagtaatctggttactagtagtartctgatcatcagtgacacctctaatttttagttgttttattgtgggatggtgagggggtattgttagtagatagcaaagttaagggttaattagaaatgtttaataccgtgataaacaaatcttgatttatatttcaggttttctgagatttcttgtagttcctgacagtttaacaattctgatgaaactcaggttttctgagaaagtatcttgtagttcctgatataaaacartactgtatatcttttaaaaatggaaaaataatagcattttgcagttcatgtttcccgattagatatatagttcttactttttttgatttgttggaagagcatttaggaaaaattcttacatctgttgtctgtagcatagaaagccattcttcactttgagtacaacttttggcaagctttttctgtaaatgtttgaatgtgcgctcaagaaagctacaaacccttaagggaatatttggcagctgttcaacagcagttgagctatgattttgtgatttaggatgacaggaacgcctatcaattaaattaaatctttatgttgactttggtggtcactatgtttctgtattgcctacttgatggaaaaagaattacaagctgaagtccaggcactgtggctcacactgtaatcccagcactttgggargctgaggcgagtggatcacttgagaccagaagttcaagaccagcctggccaacatggtgaaacctcgtctctactaaaagtacaaaaaaaaaaaaaaaatagccgggtatgcacgcctataatcgcacacacttgtaatcccagctacttgggaggctgaggcaggagaattgcttgaactcaggaggtggaggttgcagtaagctgacatcacaccactgcataccagactgggcgacagagtgagattccgtctccaaaaagacaaaaaaagaattacagaccagatcaagaggtgaactaagcctggtgctttacccccagctgtttttgtttgttttcttgttcattcatttattcattcaaccaattgttatatgccatgcactgtgctaaacaagtttgagtttagcctggagcaagaataattcaaattatcccttctacaatctttattgactacaataaatgtgtcaaatgaagtttttgggtttttagggttttttgttgtttttgtttgtttgtttttttgagacagtctcactctgtcttctaggctggagtgcagtggtgcagtcttggctcactgcaacctctgcctcccggattcatgcgattctcgtgcctcagccttccaggtagctggggctacaggtgtgtcccaccacgcccggctaattttttgtatttttagtagaggcagggtttcgtcatgttgcccaggctggtggtcttgaactcctgagctcaggcaatccacccgtctcagcctcccgaagtactgggattatgggtgtgagccactacacccagccaaatgagtttttattcatgctatcagcagagcaactcattaacttgttatgatgaaatcagccttaatgtgaacgtagaattattaaaagattctgccatagcctttccttatacagttattcctaagactaggartaagtggcttttaccccctaccaaatccaggtattcataggttttacctaagtctatatctcattctatccaaatatacatagtaatttaatatgtaaaagaattgagtaaatctgccttagtcctttccacatctcatattcaatgatatgaaatatgaagacattttcactggtgcactaatgctgagcttcacagttttttctttttacccatgttatcagtcaccacctgttatggccccaaatggtatattattccattgcagttcccttgaatgtttaaagttattgaaatgaagtactagcccttgagtagctggcaatgtagagatcaaacagaattatacaatactagtaatgtgtatgtttatataatgtacatatgtttacagtggtgcaagactttaattgcttctccacaataaatactttttagaggagtaacattttatggcatgcaaaagatgaagagaacactattttttatggaaaggtaaaggaagacctctctaaggtagtatttatgtagagacttaagggaagtaaggaagtattttgattatctatcgctgcatgacaatccatccgcctaccagttaatggcttaaaatagggcttggcaatttttttcatgaagaaccaaataataagtagttgaggtattgtgggcatacagtttctgccacagtcacccagctctgctgttgtagtgtgaagrcatccatagacagtgcataagtggatggttgtgactgaatcccagtgaaactatttacagatcaggtggcagattgtatttgacctaagggtttttcttactccattcctcctgctaaaataaaatacttcagactgagtaacttacaaggaataagaatttatttctcacagttctagaggttgaaagtacaagatcaaggtgtctgtaggtttagggtctaatgatggcctagtctctgcttctaagatggtactttgttattgtgtactccagagaggacaaatgttgtatcctcacatggcagaaagcactagggtgctgctcccttcaaccttttataagaaggacgaatcctttcatgagggcagagcctgcatgacttaatcacttcccaaaagtccccaccttttaataccgtcaccctgaagtgatgttccagcatatgaattttggaggcacacatatatttaaacccatagcagggctgttgtttgctgacccttgatttaaagcaacaaaatcattacttagcctacatatctgcaatgtaggtagcttttggttggctgcgcctgtattctacttggtgttagtttggaaggtttgaagtctgaggactgaaatcatctgaaagctcacccactcacaggcctgtctcctggaccaggcatatagctagggctccttctgtctctgtgtggtctttcatttggtctcaccagtcaggcagcttcaggctagctaaactttttatatgttgcctcagggctcccagagtgtgttaccaggttaccagagagagagagagagagagagagaggagatggaagctgtattgccttttttagcctctgctcaaaagtcactctgtcacttgtcactgctgttgcattttacttgactaggccaggggtgggcatacatggcccccaggccaaatctgtccagctgactgtttttataaataaaattgtgttggaacaaarccatacttacgtgtttaaaggttggtacaaaagtaattgtggttttggacagaattttaaatcataactaggctcaagcacatccttattaatcaaaatargaaccattacaatcaacacatttttgccaatgagaaataagtttgtttattcctgtaacgtaaaatatccgtgctttgggatttgatgaactcttggaaagcattttctgcatcctgctggttgtggaagcgttttccctgcaaaaaattgtcsagatgcttgaagaagtggtcagttggcaagaggtcaggtgaacatggtggatgaggcatgactgcatrgcccaattcgttaaacttttgaagtatttgttgtgtgatgtgcggtcaggcattgttgtggaaaakaattgggccctttctgttgaccagtgcccgctgcaggctttgcagtttttgatgcatctcatcgatttgctgagcatacttcttggatgtaatgatttcgccaggattcaggaagctgtagtggatcaaaccagcagcaggccaccaaacagtgaccgtgacctttttttggtgcaagtttggctttgggaagtactttagagcttcttcttrgttcagccactaagctggtcatcgccggttgtctaatgaaatccactttttgttgcacatgacaatttgattgagaaatggttcgttgttgctgtgtagaataagagaagacgacacttgaaaatgatgcttttattttattttgttttgttttgttttgttttgtttgagatggagtctcactctgttgcctaggctggagttcagtggcacaatctcggctcactgcaacctccgcctcccaggttcaagcaattctcctgccccagcctcctgagtagctgggtctacaggtgcatgccaccacgccctgctaattttttgtattttagtagagacaggatttcaccatgttgcccaggctggtttcaaactgagctcaggcaatccgcctgcttcagccttccaaagtgctaggataacaggcatgagccaccgcacctggctccaagatgacgattttttaaaatttccactcagctcatgaggcacccasttaccgagtttttccacctttccaatttgcttcacatgtcaaacggccatagaatggtcgacgttgagttcttcagcaacttttcatgttgctgaagagggtcagcttcagtgattactctcaattgatcattgtcaacttctgatggccagccactatgctyctcatctccaaggctgccatctccttttcaaaacttcttgaaccaccactgcactgtgcgttagttagcagtccctgggccaaatgcattgtcgatgttgtggttgtctccactgctttacgacccattttgaacttgaataagaaaattgctcgaggccgggtcgggtagcttacacctgtaatcccagcactttgggaggccaaggcgggcagatcacttgaggtcaggagtttgagaccagcctggccaaaaatggtgaaaccccgtctctactaaaaacacaaaattagctgggcatggtggtgcaggcctgtagtcccagctactcgggaggctgaggcttgaacctgggaggcggaggttgcagtgagccaagattgcgccaccgcactccagcctgagtgacagagtgagactctatctcaaaaaaaaaaaaaaaaagaaaagaaaagaaaactgctctaatttgcttttttgtctaacattttcagtctaaaatctaaaataaacagcaagtaataagtcattagcaaaaaaacataaagcgagaaatgcccmttaaaatgatggtccaggctcagtggctcaagcctgtaatcccagcactttgagaggacgaagcaggcggatcatgaggtcaggagtttgagaccakcctggccaacatagtgaaacccatctctactaaaaatacagaaattagccaggtgcagtggcagacgcctgtaatcccagctacttgggaggctgaggcaggagaattgcttgaacttgcgaggcagaggttgcagggagccgagatcgcgccactgcactccagcctgggtgacagagcaagactccgtcttggaaaaaaaaaaaaaagatgtatactataaccacatttatttaaaaagtgtattccaatgtcaaatggcaaattccaacaatgcaaaaaccacagttacttttgcactcacctaatacaatgtggagtggagcagttgtgacaaagactgtaatggcctccagagcctaaaatacttatctgtctctttatagaaaaagtttcccagatcctggtataggcactctcagcagcccacccaggttcaaggagagtgagctccacttcttaatggggaagtgtcaaggtttggaagagtgtgtgaaagtagaaatattattggagctatatctgccacaaggaatgagtcatgtggataccaaggggaagaaagctgctggaaaagggaagagcagattttgatgggagcacgcggggtgtgttcatagaacagtaacgtgccattgttgctggagcagagtgggtgagttagagagtataagatgagggcagagaggttgttgggggctgagtcatgcagggcttccctgcaggccattataaggacatcagcttttagtgagataagagtccattggagaatkttggcaagagtgacaagatctaacatattttttaaggattgctttggctcttataagggaaatagattatgggggacaagggcagaaacaggctgttacatccagacaagaaaagagggtgacttagattagagtggtaagcgtaaagatcaaaacaattactttctgactcaggaggctgaggcgggaggattgcttttacycaggagtttgaggctgcagtaaactgtgattgtaccactgcacttcatcctgagtgatagagcaagacctcacctctaaaaaagaaaaaaaaaaagaagcaacagcaattagtttctgcatgtatttttgaagatagaattgataatatttgctgatggattggataatggggtaagtgagaaagagaggaagaagttaaagatgactccaaggtttttgtcctgggcaaattagatggatggaattacagaaaagactgatataagaagaaactgatttggaggaagaaatcagaacttcagtttgggacatggtaagtttgagttgcctattagacatcttgatgggattgtcaagtagttactcagttaagagtcaggttcatgagattgtagatttgggagttgaaagagtatatttaaaatcatggaagaagttgctctggaaatgaacttggatagaaaagaaacccaaaatgtggcacaatcatgacatgagcttcaaagccaatagtttttagggtaaaggaaaggaccacaatctgaaatggctgtgaggagcagtttggacacccacccgccttcatgcttaatgacaattgtgttgcattaatcctatcccaccatcaagattttgtttttaagcagtgggaacccagaaatcttaacactgaaagaattccactctacagaataaatgaaagtggaatgtgcataggggaagaagggacactggccctctcaacttcttcctctagcctctcactcccttccaaggccctgagacattcctgctgcctctttggaacccctttgaaaaccactccccttagtgttccaagatggatgtgctaagaggcacrtctaattctgtccctctyctaaaaacccttcagaggtttcccattgtcctccccacagttctaacatggcctaccaaggcccttcatgggctagcccctgattatttctcttgctttctctcacgtcctcccaccttgcattctctgccccacccacactgacctgttcagttcctcaaactcttctgggcttttgcacatgtcctctctgcctggaatcttctttatccactaagacctatactcgtcctgaggtttcagttgggcttcattttttcctggtagctcctycttttctaatgtgtgtcttcctactattatatgtttttcccatagcaacccttatttaccctatcatagcacttcccttactttatagtttatgatttttaaaacttacctgttaaccttactcgactggaaataccataggaccatgggccatgtctgtccttcccaccattgtatcatagggcccctctcataaaaggcacttaataaatgttttttgacggtttgaatgaagaaataaaggaattgtattttcttggtaatgtggggatgtgggagacagtctaaattttgtaccacatcagttattaaatatagaaaaatagtaataatatatggttaaattatttctatgtaaaaagcatattgcaatacaaaaatagaaatatctaaatatgaataatgagtattaggatggttgaattacaagttctgttttccttagtatatttcaacttttctgtaatttcacttcttttatttaaaatgttttaaagaatcaattctaattttctgtgcattttaagtgtcttaaatatagcatctttagctcctctgggtaattttgttctcaagtttcctcaatcctgggtagttcccaagaactagagcataatctctactagaagtaatctaaaatgccttgtttctgtgcttctgctttagtagatcaaaaagctttcaatttccaaagtttctttttcttggataaaataccatactattcaaaatagcaaagatgacactgttgtttttattattctttgtttaacttttttccacttcctaaatgagccttttcctatttccctgtattaaatacttgagtactatttttgtgaagtgctttttaatatttgtgaaatgcttttgcctactctgtcttcaagtcgttgatacagcaactattgtagataaaggaactgaggctcacagaagttatatggcttgctaaaggccacaagcttggttagaggtttactctgggactaaatcagtgattctcttgttcttagtaaagccccttgcatgtaacatcacacagtaaaagtttttcccttgtatatactccttttaagaataattttatatacatgtgtatgaggaatttataatatatttctaatttaaggctattgcgaatattaaatctggataaaacctgtctttttgaatcctgttatgttaaaaaaacaacatttatttctggcttgaagttatttgtgtactgcattctgatttttttttttctttctttcacagttgtgcatgcctaaagggctatctttcaggacacaaacggacaataaagacccccagtttcactcatttatmattaccagggaagatggttctcgcacctatggttttgttctcactttttatgaagaagttacaagtaagcaaatctgcacagcaatgcagacactttaccagatgcacaacgctgagcattacagcagtgtgtatgcttcatcttcctgcagtatggactcattggcaagtagtcttgatgaaggagatacaacttcccttttgaaactccagcgatacaactcctatgatattagcagagacaccctgtatgtttcaaaaagtatatgcttgatcacaccgttaccattcatgcaggcctgcaagaaattccttatccagctttacaaggctgttacctcacagcagccaccacccttgccacttgaaagctatatccacaatattctttatgaagtaccccttccacctccagggaggtcactgaaattttatggtgtttatgaacctgtcatctgccagaggcctgggcccagtgaactccccctctctgattacccccttcgggaggcatttgagctcctgggattagagaacctggtgcaggtgtttacctgtgttcttttagagatgcaaatccttctctactcacaaggtaggttttccttggattttacattttccaaaaacaagtacttttgctcccaactactgtgtttccatggggtrtattattagaaccgaataatgatcacagtcttttctgttttgtgtaaagggagcaggtatggtgggaccagyggctgagatgagactgctgtttctctttgaggtggcagtcagtgactgcagagagaaataggaaggaacacaagtgttaacttggctgatttgggtrtatttatttattaatggaaatagcccttttttcctgataatatataatcgtcattaagaaaacattttttcttcatcataatgagagtgagagaactctgttactaccagaaacgtgtagacttcccattctttatggattagtaaaggttcacatcaaaactcagcgaacattgaaaagggataaatgaaattgttgactctgcagcttcctgaggcaatcaactttggatctttgcctgtgggagcatttcatctgagtgagagaaaaggtgagcaggcatgagacagatgactttcccaggtctaacagttctgccagagttgtgtgtgtgtgtgtgtggttttttgtttatgttttttaatctcagaaggaagttatctttgtggtatctttcattcaaagttcttccaacacatattaagaaaataacaaactatggattttattttaccagtacrtttgtgaagactaatgctgagcctagactaggatactagttgtcatctgaatatgaatgtgtagagaaaatagagatgctatgtcttaatggatagtgaattgaaggaaattataaaatagtacctgtacactgatagattcttcaaaaaaggttacacaaatatttggattcacttttttttttagacaagttctcactccgtcacccaggctggagtgcagtagtgcaatcatgggtcactgcaaccttgacatcccgtgctcaagctgtcttcccacctcaccctcctgagtagctggtactataggaatgtgccaccgcatcagctaattttttattttttgtagagacggactgtcactgtcttgccctggactctcaaaatcctaggctcaaatgatcctcctgccgtggcctcccaaagtgctggaattacaggcatgaagcattgcacccaactggggttagcattttgctaacttgtatttaagctggcagaattgtagtgcaatcccgactggtgccgtcaagcttattttaccactttcctttttttatttttctattttaaattataagtggggctgagccaagtagactatatttgtacttccccatcttgtgtgtatgttgacactatttgtgtgttgacagccgttcacaaggttgtattttcttcagtttatccaacataatgttctttgataatgtgtttcatgtctcaatttttgttgtcaggaagttattctctaatgaccaatctaaattctttcctttcttctttcacccactttctttttatatgtatatatttaaaatatattttagtgaaacactttctcatcatctttagataaaaaaaaaatccattttttaatctgaagctccttgggcattaggagttaattgctttctgctccacagatttcagatgccactgcactaattccccagtgctcttgaggcagagcttagacatgtcctcctcagttggaaatccttgtggcaacttcaggggcttgattcttactgactgttaaaccactttcagttttgcattcactgaagcaatatgcttgtgaacttgatggatatgtgtgttttctaatctgagcatctttattatgtctttttcccaatatggacacctttttgtacttttttattctggtaacaatatgcagtttctgaggattctgtggatctccgtcatatttttcatgatctgcaagtgaaggctgaaacsctttatatggaattcttgacctggtaaatttgtgatgaatccaatctatgtaaacgagagacttcacaccttttgtcccagtctgtagttcattttgcctcttgagctactgacagcaaagtccctgccataagtgtggtggctgttctctttagagagagcgcctgctaaatattcagcatgaaccttccsaccagcagaagctgaggactcactgcttccattattacttacagatcacctttttgtatctgaaaaattttaccttaagtaattctctcttcctttcttccttttatttccctgaatggagtagggattagagaatggctagaaggggcagaggcttggagcttaataccttatggtgttttagcccattagaaaaaaataacttttttttttttttaagacagagtctcgccctgttgcccaggctggagtgcagtggcatgatcttggctcactgcaaccaccgcctcccgggttcaaacaattctcctgcctcagcctcccgagtagctgggactatgggtgcgcaccaccacacccagctgatttttgtatttttagtagagacagggttttcaccatgttggtcaggctggtcttgaactcctgacctcatgatccactcgcctcagcctcccaaagtgctgggattaccggcgtgagccactgtgcctggccgaaaaaaagaactttgtattctagacttagaagaaatcttaaaggccattttcttgaatcttgaagttcaatttatttatgttctgcctagagaagcaatttgggttagaaagaatattgggggtgggtgggttcttttgttttgcctttaatttttagagatggggtctcactgtgttgcccagaatggagtacagtgtattcacaggcacagtcttagcacactgcagcctcaaactcctcagctcacaccatcctcccatctcagcgtcccgagtagttgagactgcaggcacataccaccatgcctggtttagagtattggtttttgaagtcataacaatcctgggttcaaatgtctactctgtcatttattaactatacccatgggcgagttaggtaatcctcctgtgtgacagttgccacatctctatagggataatagtttgggttttttttttttctcctttctcactgatctattatgacaattaaataagaaaacgtgtataaaatacttagggtataattgacactgactaaatgatagctgatgctattataataattactagttttattagtcccatataatcttctataaattacacttatctctaagttgtgaaggttcaacatattactacatttaacataaaacctttttaaatgatacagtcaagagtttattccagagttgagaacctaataaatgttcttttatattgtataccatgctttttttagaaggcaaaaaaaaamyccaaaagcttccattatcacacttcctcttttattttttatttttatttttttttattgagacggagtcttgctctgtcacccaggctggagtgcagtggcgcaatctcagcatattgcaacctccacctcctgggttcaagcgattctcrtgcctcagcctcccaagtccctgggactacaggcgcgcaccaccatgcctggctaatttctttgtatttttagtagagatgaggttttgccatgctggctaggctggtctcgaactcctgaccctaggtgatctgcctgccttggcctcccaaagtgctgrgattacaggtgtaagccaccgcrcccggcccacacctcctcttttaagtagcaggttatgtctcaccgtttgtggtctgtcctgagctctcctatttctgctctttttttgtttgtttgttttgagacagggtgtcactctggtgcccaggctggaatgcagtgacatgatcgtagctcactgcaacctcaaactccagggctcaagcaaccttcacccctcagcctcctgagtagctgggactacaggcatgcattaccatacctgactaatgttttttatttttagtggagatgaagtctcactacactgcccaggctggtttgaaactcctgggctcaagcgatcgtcctgcctcagcttcccaaagtgtagggtttacaggtgtgagccactgcttagcttgtcctgtttggtttgtggagtctgttcaggagttttagctcattaatatctaccaatttatttcagtttcaaatgaagaagaataagcatttatggatatggttttatactcdatttttttgtaatctgtatgccgagaacaacagagtgaatcctgagattatagagctagatttttaaaaaatttaaagtgacataccccaaaaaattgccatacagtaaatttataaccattcactaaaatcactctatgttaggaattgtgctacaaaaaggcattgtatattttggatcttttccctacatttaatcctctcaacagcagtgrgttagtgctgttgtgcattttttgttgaggaggagattgaggcttggggaaactaagtaatctgcccaagatgatacagctagtaagtaatgtagtactactaagaattgggtttcatcagtcttttttcagatgcttaaccactgtgttaactgtattgggcactgcacttaacctctccttatctgtctcaatatttatttttaaatgattaactcattctgtgggtctattgtaaaggtgtcatgcgaagtaattgtagagtataaaatgaaagcgctgtgtaaatctagattttaatattgacaatgtctcttctattagagaaaaatatttcagttaaatgaatgaaataggtgtccttatgttgatttgtacttgggtgccctcctttactcttcttaactgtgttaagggggttttaataacatgtgatacttcatttcttactcactgataaagctatgccataaatttaaaaacattgcrtgtgctgaagagttaccatgaaaacccaaagtgaatcaaagtaggtggatttcagtgatgaaaatgtccttctagactgatttgaaattctgatccacagcccatttaaaccaattcaatctgttatttaggaaatgcatatatcactgtcactttgcagtggtaactagctagaaattctaagtagagaaaatgtacccaggatgtgaaggctcttttctaggaccccagatcagaaatgggcactttgttctgcaactgggaaatacctggagcagcacagtatgaaaatcagagtatgattcttttttcaaagaactagtggaagaataaaaggggaatttaaacaccattgtctaacttttgataccaataattgaagtctaagaaacatttttgggccttgcttacctcctttggttcttcatagtggaaataaaccactacccacaccacactgcatgcctgtgtgcctttgcagtgcttgtctgccatccctctgttcgtttcattcctctttgagttgtatgtgaattaaccttgtcagaaggtggaagctacttaaagttttcttgaaaaagttgggagctttctcatcacaaattgctaggcatgctcaagtggacatcatagttctccttggaactgccatccataaaccaaacagtactttgctggtcaactgagaggtatttatagggcattgtccaagtgacaattaaatgcagaaggttctcctacagttccaaagtcagtccaagggaaaaagaggctccctatatgtgagaatctcttccttgcattcctctggtaacaagatccagtataaaccatttctttttcaatagggawctcttttgggcactgtcctctcccattagagtgtttttccaaaatcgccttagataccgtggatatttcaagtttcagcattgttttatgtccttcagtcataggggcactttaaatcaatatccaatagcaaacttagtagttgcctctgaaatggaaagtctgtagtccagcaccctgatagttgtcactgggaggcactcgcaggctttcgacataagccctagcccacactccacatacagagaatttgtctgtaccagtgctccagcttctcggttctacactgcgtgagctcaggcaatctaattcattcccatttagcatgtccaattaataatgcttgaagggtagattgacactgtgccctctgttttactgtactaggtaggagaaatggggtgaaacagtcaaacctaagatccactcccataaaacatttagataaagtgtgtttaaacattccaatttcattcaaacttcctccttaatcctatcaaccttaacactttaatatattatcattctaattgtagcctgcgttaaggctgtaagccactgtgttgaggcaatggctcctgcctgtaatcccaacactttgggaggttgaggcaggaggatcacttgagcccaggagtttgagaccagcctgggcaacatagcaaaaccccatctctactaaaatacaaaaattagctaggcatggtagtgtgcacctgtagtctcatctactacaggggctgaggtgggagatcgcttgagcctgggaggtggaggttgcagtaacctgagattgtgccactgcactccagcctgtgtgacacagtgagaccctatctttttttttttaaaaagacttcactagaagattttggtgcaacagcatataaggctctcaaatgagtcccagaaacttctccatcccttgattatttgacccactcctgtgcattaggttttgggtgttcagcaaggtatcttggcccttttgtgagtctttattttgattaatttaccttactatatatccccaagcaattccagatcatgtttctaattgtaatctttcccttcttacattttaaatttctctgtgctggggcaaatagagcagatttgtttgagccctttaattttgggaaaccatctgagggtccttatagtccatgcaacctttggtagtgctatattaagactttcatttcaggctgggtgccgtggctcatgtctgtaatcccaatgctttggaaggccgaggtgggcagatcacctgagttcaggagtttgagaccagcctggccaacatagggaaaccctgtctctactgaaaatacaaaaattaggcaggcatggtggtgtgcccctgtaatcccagctacttgggaggctgaggcaggagaatcgcttgaacccaagaggtggaagttgcaatgagccgaggtcgtgccactgtactgcagcctgggagacagggcaagactccatctcaaaaaagacttttgtttcagtcccatcaaggtctgttttattcaccctatttcttaatagacacttaaaaatttccaccctgctgggttgagtcctttgactcattattaatgtttttattagcatctgtaagatgagagtaagctgagatagcaaattcaataaggcttctcgtaatgttagattttgaagcagtaaagttacatggagtgcccacataaaaggagcctccctaaccgcagcatttgccctgggtaacggatgtattcagcgggtgaatatcccgattatcataaagccagtcctgcgtggcttttgtgcagagcatatcagcttcttcatctggggtgttccacttggaatttatagggggaattgggcagtctcccttctcaaggtaaacagacttcgagtagcttttatccagtccttgagactggctgktccctcaaggattggataaaacagttcaattcatttctgactgaatcatcacctttgtgtctggatcacatatagccatctgtgattgttccatagtgagctgtgggccctgtgtcaacccaagcatgttcttccacgctgcagcatttaaaaataaagatactgcctcgaaattagttcctgtagcagagattcatcaggaagtggatgatacttatctataaaatgagacttcatactatcccctggtttctgttgagggcaggagttcaagaccagcctggccaacatggtgaaactccatctctacctcccttgtggcagattgcttgaggtcaggagtgtgagaccagcctggccaacatcacgaaaccctgtctctacaaaaaaaaaaaaaaaaaaaatacaggcatggtggtgtgcgattgtaatctcagctacttgggaggctgaggcccgagaattgcaggttgcagtgagctgagatcatgccactgcattccagcctaggtgacagagcgagactccttctcaaacacaacaaaattatgtggaaacaacaaagagtgtctctaagatctctggtcaccagaaaggtactccacatgggggaaccacaaaaccaagaaactacagaatacctaagggtgttggtgaggaaatgcccaggcggtttccacataatttttcccgttgggagtggctttgaggctagttgtcacgccctgaccagcagaaatctgagcttggtccagcatcaaggttgacctagcactcttttaaatttcattttagcttttacatagaacaataaccaagggattttatatttaacttttttctgttggtttgcatttccttatatatccagtgaatcccactccctgggaggtggattcatctctaaattccattagttacttttaccttcagtaaatggtctcagcacagstactgctccatcccatgagtggccacccaggaattaaaggttcctaattccccaccctctcattgtccctcttcccaaaccacaggtttccatgagcctgggctgttataacaaatctcagtttttctgacaccaagtgagagagtctttcctccccaacacctgtcaatttgtgataccarctggatgcccaacagttcaattcattcctaactgaatgtcagactccacaggtttaagagttcattctcacaagactgtcctcacttctgatgccagccacaaatgaggtatcaggtgtcttggtttatttgtgttactrtaaaatacctgaggctggttaatttataaagaaaagaagtttggcctggtgcagtggcttacacctgtaatcccagcactctgggaagctgagacaggcagatctcttgagcccaagagttcaagaccagcctgggtaacatggtgaaaccccgtctctacaaaaaaattaaaaataaggccgggcacagtgtatcacgcctgtaatcccagcactttgggaggccgaggtgggyggatcacctgaggttgtgagttcgagaccagcctgaccaacatggagaaacctcatctctactaaaaatacagagttacccaggcgtggtggtgcatgcctgtaatcccagctactcgggaggctgaggcaggagaatcgcttgaaccctggaggcagagactgcagtgagccgagatcgcaccattgcactccagcctgggtaacaagggaaactccatctccaaaraaaaaaaaaaaaaaaaagccagacatggtagtgtatgcctgtagtcccagctacttgggaggctgaggtcgaggatcacctgagcccaggagttagaggctgcagtgagccattattatgtcactgcactacagcctcgtgacagagcgagaccctgtctcaaagaaaaataaaagaggtttatttggctcacagttctgtgcatgtgctagcacctgcttctgatgagggccttgggaagcatctactcatggcaggaggtgaaggggagccagaatcacatggcaagaggaaggaagcaagagagaggagggagatgccagactcttttcaataaccaattttcatggaaagtaagagtgaaaaactactcactcacaaccatgagaatggcacaaagccattcatgagagatccacccccaggacccaaacacctcaccnccaacattggggccaacaaaccatgtccaaaccgtagcaccaggccacatacattttttcttggatgactacaaaatcaggggttccccaacaccatcccccaacccctcaagttctataaattcccagaatgattcacagaactcaagaaagcactttacttattgctaactggtttattataaaggatacaactcagaaacagccaaatggaagagaggtgcaaaaggtgtaggggtgggtgcagaactgctatgctttccttggacttacccagcaccttaatgtatttgccagtccagaagctcctctatatttcttcttcttcttcttcttcttttttttttttttttgagatggagtctgtctctgtcacccaggctggagtgcagtggcgtgatcttggctcactgcaacctttgcctccaggttcaggtgattctcctgcctcagcctcccgagtagctgggattacaggcacatgccaccacagctagctaatttttgtatttttagtagagacaagttacaccrcgttggccaggctggtcttgaactcctgacctccagtgatccacctgcctcggcctcccaagtgctgggattacagacctgaggcaatgcacctggccacctctatttttttcttgaataaatttttgttccttgctattttctctaagaaaatttttattaagctttcaatatattagcaaaaagtcttaatatttycttgttttcttgacccctgttatatctgtagttttgtcctccttttcattcctaatactgtttgtgcattctctttttcccccaattatttttacctgaagtttgtcaattatattacttcyttttgtttgtttggttttttgagacagggcctcaccctgtcgctcatcctggagtgcagtagcacgatctaggctcactgcagtcttgacctccctgggctcaggcaatcctcctgccttagcctcccacgtagctggagctacaggtgtgtgccaccatgcctggctaatttttttttttattttttgaaatgacagggtctcactgtgttgcctagactagtcccaaactcctgggtccaagcgatcctcctgcattggcctcccaaagtgctgggatcacaggtatgagccattgtgcccagccctattactctttaaagaaccagattttactttcattggtatcttctgttgtacctttgttttctgttttattaatttatggttttgtttttattattcacttctttctactactttttttgggcttattaaacctttctttctccccacctgcccaccaaaaccagtatcttaagcacttgagtcctgtgttagctacatcccacaagtcttagtatctgatactttcattatcattgaattctaaaaataaataaataaataaataatttgagacagggtcttgctctgttgcccagactggaatgcagtggtgtgatcacagcttatggcagcctcaacttctcagggtcaggccatcttcccacctcaacctcccttgtagctgggactacaggtgcatgccaccacacctggccaatttttaaattttttttagaggtggggtctctgtatgttgcccaggctggtcttgaactcctgggctcaagcaattctttcacctcggcctctcaaagtgctgggattagaggtgtgagccatcatacctggctagttctaagaatttttaaaatttcatttattttggccatttgtcttgcttttctctctctctctgtttttgatgttttgaattgatttaaatttttttctcattgcagttttttctgtttagatgttatatgctmtttttctkaatgataaattttgagatttcaacatgaacagttactcttatgttatagaatcttcacagataactataaaatgctttaactccatgcccattgtggcttacttgttatgattgttcagttttaataatccctcaaattagacatttttattctatacacttggttttgtttaaatttactcatagtgaccttattttgtttttctttgaaataaggtctcactctrttgcctaggctggagtgcagtgatgcgactgaactcctgggctcaagcaatcctactgcctcagcctcctgatagctgggactacaggcacangccaccatgmtgggmtaatttttttcttactttttttttttctttttgtagagatgggggwctcactgtcttgtccaggctggtcgtgaagtcctgggctcaagcagtcctctgcctcagcctcccaaagtgctgggattataggtgtgagccactgcacccagcctcagttattattttttgaaaattcacattttatttcatatcttagagatttcttttgagatcagtcttcttcctaacatgtgttcttagaagttcctttcctgagatagctttctctattagatcttattttgtccttgtttttgaaaaatagttcattggatgttaaattctatgttaaaagttttttttttttncttagtactctgaggataatattctatcatcttaaatagttcattggatgttaaattatatgttaaaagtttttttctcttagaactctgaggataatattctatcatcttctggtttcctgtattgctgttgagaagtcagccatcacctctaatgtcattctaatgaatgactctcattgttactcattagccagaaatctgtcttttcaactctggttatatttaagattttctgtctttggtgtgtgatattttgactgatttatctgaatgaggctttatttgttctgcttgtggttcattatgtttcctgaaatttaagaattaatgtcctttacccattttggaaaattctcaactatctttgtaaatattgcattcrtgtatctttttttaatcctcctgaaattctagtgaaacttttttttgttgttgttgttgttttgtttttgagacagagtctcactttattgcccaggatggagtacagtggtgcaaactctgctcactgtaacctycgcctcctgggttcaagcaattctcctgtctcagcctcctgagtagctgggactacaggcgcatgccaccatgcccagctaatttttgtatttttagtagagacggggtttcaccatgttggtcaggctggtctcgaactcctaacctcaagtgatccacgcgccgtggcctcccaragtgctgggattacaggcatgagccactgtgtccagccttaaacatgttaatctgtcttgctcaatcttccattatctctcaacccttttttttttggagatggagtctcactctgttgccaggctggagtgcagtgttgcaatcttgtctcactgcaaactctgcctcctgggttcaagtggttctcctacttcagcctcccgagtagctgggaccacaggtgtgcaccaccatgaccaactaatttttgtgtttttagtagagacggggtttcaccatgttggccaggatggtctcgatctcttgaccttgtgatccgcccgccttggcctcccaaagtgcttacaggcgtgagccaccacacccagcctcattccaattttctgtgtgtctctgtgctgcattctgggtaatttctccacatctgtctccwgctttatgaattctctctttacctgtgtttaatctacaattagccctttctttgacattttttggtcacagtgaagcttgttacagacaaacatgtttagrttgggtggcttaggtggtgtggtggctccacattgatgtcatactgaggacaggggtcaagtactccatgattagtctttgctcttacttcaggagctgcsagaggctgtgcctttcattttctagtgccgtaggtcattgttggcaatacctgagatgaatttctgtgaaactagggagataagccaaattatgcatgtgtctgagacctcaaagccaacataattcagataatgctcagtcacattgggccaggcgcatggctcacgcctgtaatccctgcatttagaaggctgagacaggtggattacttgaggtcgggagtttgagactagcctggccaacatagtgaaaccccgtctctacaaaaatacaaaaattagccaggcatggtggtgtgcacctgtaatcccagctgctggggaggctgaggcagragaaccacttgaactcaggaggcggaggttgcagtgagccaagttcatgccactgcactccagcctgggcaacagagcragattccatctcaaaaataaaaaataatcagtcacagcatccaggatcataggtgtataatcctccagctacatcaggaagtccaccagaggcrtgctggataccaccagcagcttcacatctccattggcagtgcttggcagggcataagccttgctagacacagctyctggtctgcaccaccatggctcctgtgccgccagccacaggtccagacctagacccctctgttgcccttgaggrgctgaccttattctccacagtgatgctggtggacagcrtggcaggggctgaggcagcagaggccattgccaccttgggatctgtgccagagccatcactaggcacatttttgacagtatgtttttattgtataatatagtcaagcataattttttaatgtctacttttatttcattttacatgccttagatgttaacatattaatttctcaaagcacgtttactggctactcatcatgtagtaggtcatatgttgaatgttaacaattctgagattagaaatacagatatgtccaggcacagtggctcatgcctgtaatctcagcactttgggaggcggaggcaggcaggcagatcacttgaggtcaggagttcaagaccagcctggccaacatggcraaacccctttctacaaaaaacacaaaaaattagccaggcgtggtggtgcacagctgtaatccaagctactcgggaggctgaggcatgagaatcacttgaacctgggaggcagaggctgcagtgaaccaagatcgcaccactgcactccagcctggacgagagagtgagaccctgtctccaaaaataaataaataaaaagaaaaatacatatattgctctctaggagatgatggggtattgrggaagagagaccatgaagagagaattatgatagaattgtaatgtttcagtgagatgaataattcctgggatggaaataaagatagggtactgttgaagcatgtagatagtactctggtgataataagaagtgttagggaaggctttccaaagaagcaattgcctgaggaaaaagtggaacctagtcaggcagtgcaagaggaagggacattctgggcagaggaaaacaatatacaaggggcacaaggcctgtgaaaacatggactgcaagcaagtggtcttactgcatatggagtgatgataaggaatgaggcagacaagggccaaatcatgaaragcctcatgtgccttgctgaggcctgtcttaaatattaaaataacttcttttatacattcatcactttgagtatcaattataaaaagactttcctaaaatatttaagtttaaaaaaaatgcttaaagaagaaaactctgccttttatttcttgattcagttaaaaagaattgtcttatttctgctgagtaattgcattattaaaaagygtgtgggctgggcacagtggctcacgcctgtaatcttagcactttgggaggcaaaggcgtgtggatcacctgaggtcaggagttcgagaccagcccggccaacrtggtgaaaccccatctctactaaaaatccaaaaaaattagccaggtgtggtggcgtgtgcctgtaatcccagctactcaggaggctgagtgaggcaggagaatcgcttgaacccaggaagtggaggttgcagtgatccaagattgagccattgcgctccagcytgggcagcaagagtgaaaactcgatctcaaaaaaaaaattaataatgtgtgtggtacttcaaccagtcttgaagagaatrcagaactggaaagaagaatagacatagaacactcacaacacatggatggaataaaatctaagcatgtctttttaagttatagatatctagcaaaattatatatattcttatcccatcatcatctattcgttcaaaaatattgttttagcctctattatatgtcagatactgtggtagatactgaggttacaagaatataaaaggccccaatccttggttgaaatgatggccacagagcagaatctaaggagatttctctggatttggtcttcatagtctataactgtaaattactgtctctgcctactcctggtgagtttttgttgttgttgttgggttttttgtttgtttgttttttgtttttttgagacagaatctcactctgtcacccaggcctggagtgcagtggtacgatcgcagctcactgcaacctctgcctcctgggttcaagtgattcttgtacctcagcctcccaagtagctgagattacaggcatgtgccactatgcctaatttttatatttttactagagacagggttttgccatgatgggcgggctagtcttgaactcctggcctcaggtgattctcctgccttggcctcccaaagtgctgggattgcaggtcttgagccactgtgcttggctttttgttttttgtttttttttctgagacggagtctcactgttgcccaggctggagtgcagtagtgcaatcccggctcactgcaacctccgcctcctgggttcaagcaattctcctgccttagcctcccaagtaactgggattacaggtgcctgccaccatgccctgctaatttttgtatttttagtagaaatggggtttcaccatgttggccagactggyctctaacttctgacctcaggtaatccacccacctcggtctcccaaagtactgggatcacaggcataagccactgtgcctgcccggcctttttttgtattttgttaggattctgttgaacttaagaggaaaaaaaacataacatttagtagttatcagtaaattttagtcagcactgggtgtgaagtgggccctatgctttatgggtaaaatcagagaaagtggatgccactctgtccttaggaaacccacagagaggagagacagtacgggggccaagtgccataatggagtcctgtgatagtgcagaacttcarttagttctgattagggcacagtttctacttctaggggccatccagccgacctcaggggtttcaggtcagcttttcatcctcaccccgcccccgcccctgggataaaagacccatattgcctacagttcaaacatctgcctgattatcctagcagagtggtaggaactgattttctgatctcctctactacccgcctcacctgcacagagagtaccagctgtctcagcctagcttcttcagtgggccttggctgtaaaatgtgtgtatccaccccaggtaattaggttagctctttgtgctcgtatgactgacccctaccttttaggccacctggtgtttgttctagaagttattcctataaacagattttcacctaaaatttgaatctttatgaatcaaataaggaaaattttaagtaaacttgggctgtggataactgatgattcattamyaaaaaggtagtcatttaaaattataaaatgacacaaaaaatttaaatggaaaacatcctgtttatgcttggtcaggtctttgagttgatgtgactcaagtaacatctgatcattttcttaacctttttaaaaagactcccctaaattcttcctcccaaagattttactgtgtttgttcacagtgggttctgtgaaaggattattayaagcccacaatccattatcctcaattctacaaatccaaaaaattctgaaaaccaaacattctttttgtaactcattcatcagcaaaaccagacctgaaccaaagtgaccctattcatattctttgattatctgtcctactgggacatatatggtttgctrcagaaatattaatgtatttaattataggatactgccctagatagttcatatatgtggtatatgcaccatactgcttttctaaattaaaaaatctgaattctaaagcatatctacttccaaacatttaaatcggacttgtggacatatgtaagtataaagcagcctttgcagagtggtttaaaaggctgctttactattgtggggagcttttaattttgataaactagtgagttcatgtaaataaaacataacaaaaacactaatccttaattttctgttaactcgagaatacccagatatgatagttttgtggctaggggttagacatagaaagtgtaactatgaatgcatgtatctgtttgacttcttgtacccccaaaataaaggctaaaataaatataatcagctaaccaaagctatagccacagtcatatatactgtgtaagaaaaaagcctctgatggaggttgcagtgagccgagatcatgccactgcactccagcctgggcgacggggccagactgtctcaaaacaaaagaaaaaagaaaaatgggaattgtgtaagcattcatgtataaaaaaatgatcaaaaatgttacactggcctggtgcggtggttcacgcctgtaatcccagcactttgggaggccgaggtaggcggattgcttgaggtcargagttcaagatcaccctggccaacatggagaatccccatctctacgaaaaatacaaaaattagcctggtgtggtggtgggcgcctgtaatctcagctacttgggaggytgaggcaggagaatcgcttgaatccgagatgtggaggttgcagtgygccaagatcgcaccattgcactccagcttgggcaacaaagcgagactccatctcaaaaataataacaatgttacactgtatcttgtacatttttagtgggataaatgccaagagcagttttattagttcttgattcctccacactttaagagaatataagttcgtctacccatgattttaagaagcaaagagtgtgatgtttcccacctacccacacccccttaaaactattcaaatgaaaccatttaattctttaattayagtggaatagaactgacctattttctgtatgatcataaagaaatatttacttttaacgcagaaatttttttcttaagatccacattttccagcttaatgaagtgattgtgtttttacttggactcttccctttcctttttccttgttctgtgcagattatcaacgcctgatgactgtggcagaaggcatcaccacacttttgttcccatttcaatggcaacatgtttatgtgcccattctacctgcttctctgctacattttcttgatgctcctgtcccttatctgatgggccttcagtcaaaagaaggaactgaccgttctaaactagaacttcctcaagaggtaaaactacaatgaatgatgaagcatttgctgtttgctgatttaggtcaaggcgactttcgttagattgcattgtctttgtcaaaattttatctgtctctttgactctcctaaatctccaagtatggctaggggagagcctgagctatagaatgcagactcttgatgatgactactacatagtcattaaacctggtttaaaacaagacagtggctgattttyacaactataaatttctgaagatggagcagtggtagcatgatctcattgctttattctagtaacatattttttttctttattcacgttataaattttgtttttaaacaatacagcccaggttttagcatccttaaatcattgtatcaattgaattttatttttgacctctatcaaatgaaaagtaacatgttgcagcaaactagggataatggaaatatcaaacacttcagtattctctgttttcagatacaaggccagttatttgttctaaatgtcarcttggcttggtggttgagataaaaattctaacacctagtttttatgccaccttaaagttatactttctgtgtgttgtactttcaaatgtttaaaaaaataggccaggmgtggtgggattacaagygcttgtaatcccagcactttgggaggccaaggtgggcggatcacaaggtcaagagatccagaccatcctggctaacatgatgaaacccatctctactaaaaataccaaaaattagccaggcatggtggcacacacctgtagtcccaggtacttggaaggctgaggcaggagaatcgcttgaaccctagaggtataggtttcagtaagccaagatcgtgccactgcactccagggtgacagagcgagattccgtctcaaaaataaataaataaacaagaattattgaaagcatatttctgatctataaagtaagaatartaacacctcctaggtgttgtttttacttttttttttcttttcttttgagatggagtttcgctcttgttgcccaggctggagtgcaatggcgggatcttggctcaccgcctcctgggtttaagtgattctcctgcctcrtcctcccgagtagctgggattacaggcatgcaccaccacgcccagctaattttgtatttttagtagagacgggttttcttcatgttggtcaggctggtstcaaactcccatcttcaggtgatctgcccgccccggcctcccaaaatgctgggattacaggcatgagccaccgtgcctggcctaattgttacttattgttaatggtactgaggattamcatgtaaggtctttgaaatgaaatatggataagagtgtgccacagccttttacaaaacataagatgattaattacattatatcactagctatttaattcacatctttcttaatagaatctcatgctgagattcacctttatttgttcttatttcccatagagattctcattttaataagtgaatttaacacactaagccacagccattatttcctgtaatgattctcataatcatccactgcttacttttattctaatgaatatttccccacaaaaattaaggtttttgctcaaaggaaaatagcatgattcagatcacataagagacatatacagactattgttctttttgggcttgtgcatgtttttcttctctgttttacctcttttctctattccttgaatgttcttgtttttgctttcattaaattagtcaagtatgttatttgctccaagaagttaatcctttaaattttcaaggaaaaagaaatagactagccaaatgcattttgttttgaagacttaatgatattttagtttcttgttgagtgactgatctattttgtatgttaatccatgtaataktttataagataatttatatgtatgttgtctttccatttttcataacaattgttgagagatttttaaatggcagcttgatatatctgtagttgggaaacctttccatctctatgcctgtttgtatccactaaagataaacaaatttaaggattctgaaagctcctacagtaatgtctgtgattttctaatttttcattaatgagatcaacactgcttaataaatacgtatactcatctgttcatagagtagaataatatgaaataacctgaattagctgtgaaaatagcagtgcttcrgctgggcgtggtggctcacgcctgtaatcccagcactttgggaggctgaggcgggcggatcacgaggtgaggagatcgagaccatcctggataacacggtgaaaccctgtctctactaaaaatacaaaaaaaatagccgggcgtggtggcaggcgcctgtagtcccagctactcgggaggctgaggcaggagaatggcatgaacccgggaggcggagtttgcagtgagccaagatcgcatcactgcactccagcctgggcgacagagcgagactccatctcaaaaaaaaaaaaagaaaagaaaatagcagtgcttctgtgtagaaactataaattaggacatcattgttttataagaaaaggctaacagcctctttgttctggtatcattttacaatgaggtgaaataatctgcttcacataattttggagaggaagtagatataaaaatagtcatttaaaaaaatgacttaaatgcactcactagtaatactttcctccacctttccctgaaaagtctaaaataaaataatggctaaaaatagtgacaagacttctaaacatagttacaaaaataacaaatttgcaaaatgattattttaagaaggtatgattttagttgctagctaactaatataactacatagatttataaattaatcaccaattagctatcctcatgatttaagagtgatacccacaagtagccatttgtaatactgttttttagggagtaggatagagagaatgagagtggaaggaaggcactgaagattaattgcatggaatgtacctcactttctactgttcttactcatcttcacagtaactggtagacaaaaagttaagagaaaaactgaaacagagctgcttttgcaactttgttcttgtcatatcttgccctgagattctgaggraataatttattttattttttagacagggtctcactctgtcacccaggcaggaatgtggtggcacagctcactgcagccttgacctcctgagctcaggagatcctcccacctcagcctcatgagtagctgggacgagaggcacacaccaccacacccagctaattttttaaaattattatttgtagagatggagtctcactacattgcccaggctggtcttgaactcttgggctcaagcgatcctctggctttggctttccaaagattaccagcatcatccacagcatctggcccagagggaatattttaaatgctctcctctctctggcttaccctcaagctggcttaacttcagacactgagaagtgagatcacttactaaacatgaagagagctgcattagtctctcatttgtggatacttcctgctccggcctacagttttagggttcccccaaatgaccatctcctcagagcttattctttcatttgccaaacagttgtctcatacactatttgtgtagaatacagtgggagacaccaagtcaaaaagaggtgatttctgcttttcaaaaaagtcatttacaaataccaataacacaagttaaaaagtaagtcagtaagaggaatgaatgaacagagaagatccagaggagatcagaatgcctttagggtaagggtataggaaggtttcatgacagaagagatgattaagctttaagcctttgttttcttacttttgagggaattttttttttttttttttttgagacggagtctcactctgttgcccaggctggagtgcagtggcgccgtctcagctgactgcaacctccacctgccaggttcaagtgattcttttgcctcaacttcccaaatagctgggattacaggtgcaygccaccacacttcgctaatttttgtatttgcactagagatggggtttcaccatgttggccaggctggtcttgaacttctgacctcaagtgatccacccacctcaggctcccaaagtgctgggattacaggcatgagccactgtgcccggccacttttgttgttgttgttgttttgtttttgagacggagtctcactctgtcgcctgggctggagtgcagtggcatgatcttggcacactgcaacctctgcctcctgggttcaagtgattctcctgcctcaacctctcaactagctgggattacaggcgcctgccactacgcccagcttattttttgtgtttagtagagrcgggctttcaccatgttggtcaggctgatctcaaactcctgaccttgtgatttgcccaccttggcctcccaaagtgctgggattacaggcatgagccaccatgcccagcccacttttgttgtttttaataggaagtagttacatatcatgaaggcttgtgagcagtgttgatcagtagaaatatttagtcctaaagcaatgtcagattgaggtgttgagtaaatttttatcatgtaatacttattgagctcttctgaattttttttaatttaatggtgttaaaagtgagaagcaacttatcagaatgccctattatagagttctcgtttgttttggagaaagggctttttggttttcttcaatacattttcataacacagtttgtatttcctgttctactttgagataatcaaagccccagcttgggcccttcttaagcagacataggagacttttgtgggatcatgaagacagaccagtagctatggtgttggaactcctactttgtagtacactcagctcagcagtgatttcatgaccataataagctttaaaatttcagaaaatgtatcattttcccttttcataggaggaggagagggatagaaaaaggtagtaggaaggcattagtgaaggtgatagtacaaaatctaagtggtgggaggttgctggttaacatttagattagcaaattagtaaattttttcttccattttaaagatactgaattggccgggcgcggtggctcacgcctgtaatcccagcactttgggacgccaaggtgggcggatcacaaggtcaggagatcgagaccatcctggctaacacggtgaaaccctgtctctgctaaaaatacaaaaaaaattagccgggcgtggtggcaggcacctgtagtcccagctacttgggaggctgaggcaggagaatggcgtgaacccaggaggcagaggttgcagtgagccaagatcgcaccactgcactccagcctgggcaacagagcaagactccatctcaaaaaaaaaaaaaaaaaaaaaaaagatactgaatcatccattcaaattatgtgaccttcatttaagcctttcagtgtaaagaatggtgtaggccggccaggcrcagtggctcacacctataatcccagcactgtgagaggctgaggcaggtggattacgaggtcaggagttcaagaccagcctggccaagatggtgaaaccccatctctactaagaatataaaaaaattacccaggcatggtggtggacacctgtaatcccagctacgcgggaggctgaggcagacaattgctcgaacccaggaggcagagkttgcagtgagctgagatcgcaccactacactccagcctgggtgacagagcaagactacatctcaaaaaaagaaaagaaaagaatggtgtaggcagtgctactgtcttcagcaagatgcgacatttcagctctttatttatttagagaaaactgctgacattggaggtgaggaaaaatagcagggaaaggccataagccaccaggctgtttgagggtgcacatttggaacaggtgccaggaagtcacctaatttcttgggcctcggtttcttcatctgcaaaattaaaagactggattcaaagattacatcaggctttaggaatcattgttgatcatctggctttgaaaggagggaaaccgaaatttttttttttttttttttggccaaagtctcgctgtgttttgcccaggctggagtgcagtggcacgatcttagctcactgcaacctctgcctcctgaggtcaagtgattatcctgccttagcctcccgagtagctgggattacaggtgcatgccaccatgcccagctaatttttatatttttagtagagacagagtttcaccatgttggccagactggtcttgaactcctgacctcaagtcatcctcccgcctcagcctcccaaagtgctggaattacaggcatgaggcaccatgctaggcctcattttgagtttttattgagcttaatttagagtttcactatgctgcttgctaattggtatctaacatgaagagcaaggatcaaaagagaaaaacaaagacccgactggttgctttcccctttccccttactttgccgtctaggatcagagagcagtgtgaattttccccttggtgcctgggggtgggggagccagggagaaacacatagtgaagcttcctrttttgtttattaacttccaccccatgtcttatgttcaaccattgatgtaatcaatattatttttatgtgatgggctacacttttggcactccaccccccaatctagaarcacaaccttctttttaactaacaaccttgtcstgattaagagagtatggacagtagaggttaaatactgtttgaagtctactacagatacctgagggataatcagaactttatacatatgcttggcctcttgaattttctatatctacttgaaaaatatttaaaatatttattcaaaataaattccaaatgtagagtgtaaacaaactcaaacatttcttctgatttctgtcacctcttctactcaactcaaaaatatcttgtgtgaactcttaattattcaaaggttaatcaagtgcrtagttacatatgcacttgcctctaccacctctctctgcctcctgcattaggtataatgacttctgaaatggttttgctctaggaggtttagtgaattttgagtaaagttaaaatttgtggattatctgtgaattggattgattttgccagtttcatcctattgggagatactacagctgctggtttttggtgattattgtcaattctgcattacagatgttagagcagtggagtggcaaagaaagttcaagtgcatacagtgagcattttacctaatatcatgtatttgtaaggtcttatgagtctgggcacgcttacccacataggaatgcctaaatggatgccaattgttagaaaatcatattcagattataatatattgctgagacccagagaaaattattcatatatattaagtatggtataaaaaactcacatagggaaaaatgatggaaaaagaggttatttttaaagaataagaaattctaaaccttgcaaagattaacataaaaggcaccataatctatgcttttgtttgtaatagttggcaagaatttttttttctttttgtagaaacagaatcttgccgtgtttcccagtcttgtctcgaacccctgggctcaagcgatccttttgctttggcctcccaaagtgctgggattatgtgtgagccactgtggctggctggcaagaatatgttagcacatacaattcctttattttaaacctttgtatttcatttttctctttcaggctaatttgtgttttgtggacattgacaaccattttattgagttgcctgaagaatttccacagttccccaataaagtggattttatccaagaactctctgaggttcttgttcaatttgggatccctcctgagggcagcctrcattgcagtgagagtaccagcaaactgaagaatatggttctgaaagacttggtcaatgacaaaaagaacggcaatgtctgtactaataacatcagcatgtatgagttactgaagggcaatgaaaccatagcccgcttgcaggctctggccaagcgtactggtgtggctgtggaaaraatggacctctctgcttctctgggtgaaaaagacaaggatttaaaactgmattgtgaagaggcagaactaagggactaccagctcaatgtacagctccgagaggtctttgctaaccgttttacacagatgtttgcagattacgaagcatttgtcattcagactgcscaggacatggaatcctggctgaccaaccgggaacagatgcagaactttgacaaagtaaaaagaaccatagttttccttttgtggttattagtggctttattattgattttaacatttttaaattttttattcttctgtgcctatgcttacccatatattattgattttgttaaccttttttaaatgcagactttttgtcttccagccccattaagaacttttctttaccaagtatttttacattagataaaataattttacaagcaaataaaccagctcattgaactggtcattaaattgtgcgttaaattgcctgtaatctcattttcaatttttctttaccttaaagatgcttaaattatagaaactcaggccgggcacggtggctcatgcctgtaatcccagaactttgggaggccgaggcggacggatcacaaggtcaggagtttgagaccagcctggccaatatggtgaaaccccgtctctacgaaaaatacaaaaaattagctgggcgtggtggcgcacacctgtagtcccagctactcaggaggctgaggcaggagaatcgcttgaacccgggaggcagaggttgcagtgagccaagatagcgccactgtactccggcctgggcaacagagagagactccatctcaaaaaaaataaataaataaataaaaaattatagaaactcttacattttgcaggttttccaaatctgttaatactgtttaaccttataacagttttatttactcttactttatgatcaagtatggttaaataagcctactcctttttgaagaaatctctttatttagtctagaaatcatttatttagtctttatcctatcaggaagtcacaacttgtccatgtaaagttaacagtttggtttcagaagccaaatttctctatctcattttaagataaaaggagaaaaagagtgactaaattaagttttatggctgtaagtgtaaaacaattccaaagattttggaaagagaagtcagaaaatataccagctttccttgtcctgtgatttctaaggggtactggattcttctgccagttttttttcacctatctcccagattttatttttcagacagatgcacttagggttgtatagtaactcttttaggtcaccagggtacagtttagttctttactgctgtgattgctgaggtataatactgctattagaatgtatcatgggtttcactaagtggcctctttgggtcatgaaaggccttctaaaggggctgatacattccaagaggctaatctacagtactggagaatttttggaaataatgaaaaattttcgtaaaggtacatagtggctgggcatggtggctcacacttgtaatcccaacactaggaggttgaggctggaggatcatttgaggccaggagtgtgagaccagcctaggcaacatagtgagaactcatctctacaaaaaattttaaaattagccgggcatggtggtgtgctcctctggtcccaatgactctggaggctgaggtgagatcacttgagcttcagaagttgaggctgcagtgagccaagatgatgccactgcactccagcttgggctagcgagtgagaccctgtctcaaaaaaacaaataaaagataatttttttacttcatcagatattttttctgttggaggatgatattgtatgttgaacagttacgttctggtgttctttgtttttccccacatcagacaggtaatgttctaacatggtaacaaagtttgaggaaggtacatctcacacatgagcatgaaaagccaattattacatttatgaactacaaaagcatcctgatgcacttacgtttgagaaaacttctttaatattaacaagacttcacttctttaagtgtatgcccttaggttcctttttcgttagtcttaaccattttccatactttttcctatctagcttagaactaatctgtgggctgggcacagtggctcacgcctgtaatcccaacactttgggaggctgaggcgggcgaatcacaaggtcaggagatcgagaccatcctggctaacatggtgaaacctcgtctctactaaaaatacaaaaaaattagccgggcgtggtggcaggcacctatagtcccagctacttgggaggctgaggcagaagaatggcatgaacccgggaggtggagcttggcagtgagctgagatcacgccactggacgccagcctgggcgacagcgagactctgtctcaaaaaaaaaaaaaaaaaaaaaaaaactaatctgtgtatatccatggtttatccttgggacaattcaaattcttacctaaatcaagccctgatacttccttccttcttaatctttatgtagcctcaaactatataaatggaattctttttacataacccctaaagaaatgaaaattttctgttggattccagaaggcttataagtacctttcactaggaaaatctgcaggacatactagtcgtacaagccaaatcgttgttgacctaaaattttatagtctatgagggtctgaatatcaaaagccagatctttggcccactttttttaaaaaaaggctatttgatgtatgaaaagtaagatgtttattggtgaaggtgaactgatttctagactactgtgaatctttctgtggttatttggatttatgtatatacacctgaactatggaactacttaaagtgaataagtggatttctataaggaaattttaagaagacctcctaaatttcagaatgaaagtaaatatgctagcaagaagctgatgagtatttttaaaagtcaccttatgtcagaacttatttctctttcctctttcccctttccccttctggcttctgccatgcaaaaataaaaaccaacccagcaaccaaaataggaatttacttccaaatttacttccagattttagtactgcattgaatgtagaatccctgtacacacatgagcatggaagaacaacagaaaaaaaaatgacacttttaattaggaactgattacgatgtactgaaccatcccatgcatcagacaggctagtaacaggaaaggtgtacagcttattgtactcgttctccaaaggcttgcttctgatggtttttcaggcaatgatttgttttttttttgtttgtttttttggaaatgcggtttcactatgtttctttaggctggcctcaaactcctgggctcacaggatcctccggcttcagcctccctagtggctgggactgtaggtggccaccaccatgcccagcttccaggcagtgccttttttagttgttaaggctgagactgttgtgtcagcacaggtgtggaaggaatttttccttggcttaacactcatctattgatttctcacagagttaaagagtctagaaaagcattcacttaaagaagaacaaaagaacttcacccataagcataaattccatgtcttttttaagattaatgctgatgtgtttattgtatcagttaatcatctcactaccttgtggcttgaaagtatatttcataggctaggaatagagaacagaaggaattacaacttgtagccgggcgcggtggctcacgcctgtaatcccagcactttgggaggccgaggcgggcggagcatgaggtcaggagatcgagaccatcttggctaacatggtgaaaccccgtctctactaaaaattcaaaaaaattagccgggcgtggtggcaggcgcctgtagtcccagctactcaggaggctgaggcaggagaatggcatgaacccgggaggcgggagcttgcagtgagccgagatcgtgccactgcactccagcctgggcgacagagcgagactccatctcaaagaaaaaaaaaaaacgaaattacaactcattggggaaagggataaaaatttttaactgcaagtgaagtggatgattgacaattgtatagcaacttatctgccatctttcgttactgatgccctctttgctacataatggtcataaggatcagaatgtaaattttgtaaggtaagatcagtgctaaagacctaagtgacgtacattctctaaatttaggaaaatggaaagaaaagtggatttttaaggatttttgaatttcaagtgtcagttttataagatttaaaaaaggaatgtcctgagttaacataattttcaggcttatcatgtagtgttgagatggtctctttgcactaataatttcctaattatctcattacaggcttcctttctgtctgaccagcctgagccttacctgccatttctttcacgcttcattgaaacacagatgtttgccacctttattgataataaaattatgtctcagtgggaagagaaagatcctttgcttcgggtctttgacactcggattgataagataaggctgtataatgtaagggcacccaccttgcggacatctatatatcagaaatgcagcactttaaaagaagcaggtacatttgccatgccttttaaattaaattaaaatccattatcgcttttttcccacaaattgctggccttacgtacaacaaaattaattttcagttttagacttcatggctaatcctggtactatatcacgaaatgctttgtaaatttttctttctgagtcctactcctacttgacgttcctcttctcttagaagaggaaaaacaataataaattgaatcaagtatgtctggaaggttgctatgatttttgtttttgtttttgtttttgagatggttctcactctgtcacccaggctagagtgcagtggcgcaatcttgactcactgcaacctccgcctcctgggttcaaatgtttctcctgcctctgcctcccaattagctgggattacaggcacgcaccatcacgcctgactaatttttgtatttttatagagttgggatttcaccatgttggccaggctggtcttgaactgctgacctcaggtgatctgccctcctcagcctcccaaagtgctgggattacaggtgtgagccaccacgtccagcctgacttttgttttattctctttattgcctaaatggaaaaaatgttaatttctgtcttgctacttatgtttctttttctttttctttttcttttttttttttttgaggcggagtctcactctgtcgcccaggctggagtgcagtggcgccatcttggctcactgcaagcgccacctcccgggttcacgccattctcctgccccgagtagctgggactataggcgcccaccaccacacccggctaattttttgaattttcagtagagacggggtttcactgtgttagccaggatggtgtcgatctcccgacctcgtgatcgcccacctcggcctcccaaagtgctgggattacaggcgtgagccactgtgcccggccttatgtttcatttttacttctcacctcttctctatatccaagaaaggatatttatttaaaacagtaaatcttagattctgcttaatttacatactaaaacagtatctttgctttagtagtgccattaattataatagcttcacttattgaaattaaatctgactcaggctgggcgtgatggttcacacttttaatcccagcactttggaaggccaaggccagcggatcacttgaggtcaggagttcaagaccagcctggccgacatggcgaaaccccatctctactaaaaatacaaaaattagccaggtgtggtgtcatgcgcctgtaatcccagctactagggaggctgacatagaagaatcacttgaacccgggaggcggaggttgcagtgagccaatgtggcaccactgcactcccgcctgggcaacagagcaagactccgtctcaaaaaataaaaagaaagcagttaattctgagtcttagcccagcctgtctaggagtggtatatagtccataaataaataatcatattattagccacatgagtatttactatggcaggcatcatgccaggtggtcccgaattttttttttttttttgaacagggtctcatttgtggcctagcctggaagcaggggggccctagtggtcattgggccctaatttttgggcttagggggatgtcttacccaacctccgtgggaacggtcctttatggcttggccccccctccgggaatttttnnnnnnnnnnnnnnnnnnnntgagccaagatggcaccactgcactcccgcctgggcaacagagcaagactccgtctcaaaaaaataaaaagaaagcagttaaatctgagtcttagccagtcttgtctaggagtgtaatatagtccattaaataaataatcatattaatagccaacatgagtatttactatgtcagtcatcatg

SEQ ID NO: 17865 - DNA, 119472 bp, Homo sapiens
  misc_feature (1)...(119472): n = A,T,C or G, or insertion/deletion polymorphism (see Tables 1-2)
ataaaatgattatagattaattcatgtattttccagtccttggaaatgcagattccctatgtggtgttggtcaatggttaatgcctgttgttctggccagggatttttgatctgccagctgtgaacagtttgtcttcattcattcatctttaaattcttacttattaattgacaactaagtaccaggttctattctaggcattgggaatgtttctttaaaagtttctaaaaaaaaaaataaaataaaaggttggatctctgagatatattattaagtgaaccaaaggaagttccaacacaacatgtatagtatgataccttttgtataacattatgtatatatcatatagagatatgtatatatctggccaggcatggtggtatgtgcctataatcttaactacctgggaggctgaggctgaaggatcttttgaggtcacaggtttaggccagcctggacaatattgtgagacctcatttcaaaatttaacaaaaaaaagaaaaaaggaagcaatatgtatatatttggaaggctagatatgatgctgctgcctttggggaaggtaacaaaatcattttggtgaaaattggggaacacaggtaggtgggatggaggctttcatattttactttctgaagttctctgttgcaatgcttctcaatctatagtgaagaaacacatttgggaaactagtgtggaatgatacttctgtaaaaatccaataaagatattagtaaaatgatttttagttttttctttttttgagacagggtcttgctttgtcacccaggctggagtgccatggcatgatcatggctcacagcagccttgacctcccgggctcaagtgatcctcccaccttagcttcccaagtagctgggactacagggtttgcaccactatgcctgggtaatttttaatttattttgtagagatggggtctcactgtgttgcccagactagtctcaaactcctgagcctcccaaattgatgagattacaggcctgagtcacctcatccagctgaaatttttaaagacattgaaaatacaagcctgcattgtttatcattagattcaacagacatcaaattattctgtcaacatgccataaaagtttctaaacgtttactctcaattcttcacttacctcgttgaagatgggtaataagttcagagtcaggtgccagtccttgggccacaggccactttttgaatggcattaaatatatataaattaatatatatgtaaattaatatatatgtaaattaatatatatgtataaaaatatattaatttatgtccctgcagacatgccctatattctacccctaggattttcagttacatgaatacataactcctttttatttatttaatcttaaatccaacttaatggaaagactgataaaaggaatattgtggtacgctagaatgtggagtctatagatacacacacacacatattacactgaacatatatgacttatagaattgccatgccttgaaaaagaattttgactcagtctggtaataatagaaacagatacaatgcacagaaggggttcagaggatggaggaattttttttgacaaggtaacaaaaaggaggtaatatgtggtctaggttttaaagactacattcataaacattggtcagaaggataagtgtggaagaccattttaggcagagggaaaacaggtgccaagatggggaggtatgagatcgctgggtgcattgagaaatacagtgaacatctgtgtttcagcctgcccagtgcccagtctcccttcctcagttctcccttgaggacctgcaacttctccattctcagcaaaagtggtttgggtaggactaacctctttcctactttgtgaactaatctgagtctcccatcgcccttccctcccacacagcgattggttctgaatgtctgtcatgtccagaactcttgctggaacacttgcaaggggaggagagagaagtgcttgttcttgctgggattactgagaggaggatttaagcacagagctactgagtgccatcttgacacaaaagagaaccagctggagaatggaaccagcagagaaaagagcagagaccagagctagaaacagaatccaatcacttagtttatttccctgcagccatgccctgtattctactgctgggattttcagttacacgaacacttaactcctttttacttatttaatcttaaacccatcttaatggaaagactgacacaagaaatactgtggtgtgctagaatgtggtgcatacgtgtgtatactagggactaatgtggctgaagaggtgggcgagggcaggcatgtcaggcatgtgaagggctgaggaacagaccctcattttaggggactctcagaaactctggagggtttaaagcagtgtttacctcaacaagaaaatcaagagctataaatcagaaactgtaatattaagaacatttagtttttcaagcttttctagtagttcatttctttttattgtttgtctctaataattacaaaacttgaaaacaggagaaggagggctacagaagtagctggggctggagcagtgacttcagggactggagatagccctgtacaattaaaaatagaaaggacctagcaagtccctggaaatgacatttttaaaatgattccattttcctcttaaggattaagttgtaattttattttgagcaatgaagtggctgaccccttttagtaatgttttctatttcataataaacattcaacagaaatagaatttcaagaggaaacttttataaataatgagaatcagctattccgaagctccctacacattttaattagttttctcccaggaacacattcattaactattttgaacactataaaacaaaagtaaaccagcaccacatcaagttccctgcgtatagctgtcatgtctgtttaaattctatagcagtttgtgtgtgtgtgtgtgtgtgtgtgtgtgtgtgtgtgtgtgtcttgtgatatttttcacaattccaggccaactactttgaagcatgttcctaaatttggatgtgtctgattatttcctcatgattagattcaggttaaagatttttcaaggaatactccataggtaatgttgtatctccatgcttcacatctaggggcacacgatgcccaattttttgttcaattattggctactttttatcatttgttaaggtggtatccatcagatttctccattgtaaaagtaccttaacacccttgcaattaataagtaatccatgggattattcttccacagtaaatagcattctaacaaatatcagtatcaaagaaaaatggcccataatgaaattttgtacagttagaatgactctaacaaatctctactgagtattcactaaactatgttatgctaggcactaagaccaaagtgatgaacaaatagagtacatggaatgctacatgaaagggtagaatgctacaggagcatacaggagaggaacaaagaccattacatgtgaagaaatggaagttcagagatgtgaaaggactcgaccaagattttagatccagtagcagagtgaaattagaacggtggtttttctgatgcccagtccagtgttctttccatgaccacacacaagggctctactgtaatgttggttctctggaacaagtatagcatttgttaccacagtgaaaacaatgataccttagtactaaaagaacaagctttctccagatctaccacaaggtgctttagagggaatttcgatttaaactatgtgcattgtaacattgaagtcactggagacctagtctagttttgcctcagggaactgtttctttatagtgtcactgtcacacacacatgcacatacacacgcaggcacatgcatacagcacataactggatattgcttatcagccccatcttaaaaatagcacagaacaagacttttattttcagcaatcaggaaacgttcagaggtatctacatcctagtcttgagagtcgacttatatttgatacctgatttttatagttttcacagcattttcatatactatcactggactctcaaaaacaacacagttaaggcaggtgtgattgggcacagctgtagtaccaggtactcaggagactaaggcgagaggataacttgatcccaggagttcaagtccagcctgggcaacataaggagacctcatctcttaaaaaacacctgaactggccagacgcggtggctcacgcctgtaatcccagcgctttgggaggccgaggtggctggatcacctgaggtcaggagttggagaccagcgtgaccaacatggtgaaaccccgtttgcggtgttagccaggtgtggtgccgcatgcctctaatcccagctacttcaggaggctgaggcaggagactcacttgaacccagaaggcgcaggttgcagtgagccaagatcgcgcccattgcactccagcctgggtgacaagagcaaaacgctgcctcaaaaaaatacaaaaaacacaaaaaaaaaccccacctgaattatttcttaaggtgggaaagagggatcagtgtaaaatgttggctggattactgtcttgcctttagatataaaaatatctagtgtatacttaattttcagaattacaaaattagggaatgatcaaacgtatatatatattttatttttcaaaagcctgcggcacccagtgtttcaaggtggtctcgcattcaaggactagctaagcaggtcagaccctgcttagcttccaagatcagagaagacagggcaagttcagggtggtgtggctgtggaccatgtttttatacctataatttatttatattcattcactcaatcctgctgtatgcaggacgatctcagcttcaaactcaaaagctggatctggtggtcagctctttcaggcactgttttgtcatgggatttaaagatctcttgtgcttagttttggatctgtaaacataaatcccaacctggattcttccctgggctgacggagttcagggagaaaggtagcagtagataagtcatatgctggaaaagcttggactctaccctgtcatgaaaactttcaggaacatttcttatttctttttagagacaaggtctcactatgttgcccaggctggcctcgaactcccgggcttcagcagtcctcccgcctcaccctccgatgtagctaggactacaggaccgcgacccggcgctgcctaagaactgtttttaaacgtgaaagccacggctatcatttgctttttgctctgctcttcatcttctggataaacctcgtaacacactgcttgttttggggtaagtgaatttaagtattattatggcatttccaattttcacggaaggactctggcgatatcataatcgtcacaagccctgaaacggccatcagaggtcaagcagggaggtgggtttcctggagggcttaactgtggggtaagtgactggagggggctgatcagtttcccctttcccttttcccggagctcagtggtagtctgctgcctacgccccgtcagacaagtggcctgagtcccccgcaacccctgcaggtccggccgccggcgccaagcctcaaggcatccaagccaggaacgatcgcggtcagctctgccacggaacatgtgcaagacccggcagcaggttccgggggaggcgaattgatttcacaacggtcgagaaggaggaccccgcccacttcgtcatttctcggaagcccagggactcgccggaagagcggctcaaaagccggaaaactggcaaatccgagtctcccggcgcatgcgcggcgcaatcggcttcgcgtggttgcagtagagaggatccctccgccagccactgcatccggcggccggatctaacttacccgctagcgttttacccttgcgcggccgtggcgtagggcggtcttttcccttggtcctccgcggcgccgcctcttgtgacgtaagccgcagaatcctctgtcttagttcggctctattgccgcgagcttgactcttcctgggtctgaggaaaagtaaaagtaattttgtcatttcctgaaacttcaagytaaacctttaagctgttcatttcctaaaagggtgaaaacgcgggcacccctcgagctagttcatcgccttttaacctgtgagttctgttaaaaggaagtaactgcaaaatgtcttcgctgttaggtttctttggaagttttgggttgtgttcatgcgttctctcggcgtgtgaactgggagaaagtggagtgccagccatatgaaatgacaactgtatatggaggctgggaagtataatgcgcattctggcttgatgaaattaatgaaattttaattaagtttaattttcatttgaattacccaggaatagcatcttgaaaggcggggcataaaaagcagttaaagagcttcgagaaacggttactcgttttgtaaactaaagaccaaatgaaaatccagctgcactagaaaagaaagaaacttataagggccgaaggttttgtctgcaatttacagctaattagtctcaaagatttctgtgatttgcccaagagaggtggagttggggccactgctttacccaggacaccgccgcggcccgcttgaatactgccgccgttaggacccgccgtacctggccgtccagggcctcttttcttgtcttccactctcacttgtcttttctcccctttccatgtttttggttcctttcctgagtttcccttgtctccactcccctscccctttgcttcctctatctctttaacttctgttttcttgatggtggagccaactttagtttcccttaaaaggccataaaaggaaatagaataattttaaaaatgtcttttcataaggcttgttttcttgtcttaagcctgttttttggtggggggtgaaaaagttcatatgcagatagacataaacttcttttggtaaaagctgccctctattttcttccatagctgtcctgtgaaagtaggagtgtgtgtgaatggtgaagcaaagagagggagacatggggtcaggagaagagggagcacagcgtgtgtarggagttaattagaaccagagggcctgggtctgtggctcatgcctgtaattccagcactttgggaggctgaggcggaggaccctttgcaccactgcactccagcctgagcaacagagtgagacccagtctcagaacaaaaaaacagaaacaggagaaaaaccatccatataagcagagaggtacttaaaatgttgcaaaactaaattccaaataacgtctgtggattctacaaaatctaggaaatacacatttccaataaatctttgtacattcatctgtaatgcatttccttaggtgatttgagtcctttaggagtaaatctgtatctttagctgtcccagaagtaatcacaggcgttcattgtctattcaatgacaaagtattgtgaactattctatgaaataataaaatatcagtgttttcagagtacatggccttttcagtagccttttcagtgtggtggcacctgttcccagttctgccagtggatattgttatctttgatctacaactgggaagctaaaacccagaaagttacttgtctaagactatacacctccaagaaggcagaactgtggctgctatttccaactttctagtctctgaacatgtaataaagaactgatttccaatttacaatgaataatagaatttacaatgaataatataatttactataatataacaaccgaccaaagtgtgctgttttattaccaatttctctctctctctctctctctctttcttttgtgacagagtctcgctctgttgcccaagctggggtgcagtggtgaggtctcggctgactgcaacgtccgcctcccaggttcaagcgattctaactgcgtcagactccccagtagctgtgactacaggcaggcgccactacacctggctaatttttgtatttttagtagagatgggggctcaccatgttggtcaggctggtcccaaattccttgcctcaagtgatttgcccgcctcggcctcccaaagtgttgggattacaggtgtgagccactgtgcccaccccaatttgcttctttggtgtttgtaattctgcttggtcaaccgtaacttgcagaaattgattggaacatatattttgataaagtatttgaaggtattcctgaagtttgatttatgtttcagctgcctatactgaaagaaaataaactgctgtgtattccataatttaaaaataattgttcactttagtgacattttgtagttggatagtggagacaaaagatgatactctctgtgatcttcaatctaaacatttatgttaggacaaattattcccatatctgtataatgctatatttctkccctgacctctacaaatcacagaagcaccgttattcgatcttgttctctttttcaaaaaattctaccttccaaggtggtggttctttaagtttataagtgaaccataaagtagttggaaacctggatcccaggatggtagaaacatgaagcttgtttattccaaggacagttttatatatgtataggactttattatccttactatatacagcattttaatggggagggggaaccaggagcattgttgggggttaatttaatttttgtagttttaaaatacaaacgaatgattgtatcagtctttttttttttgtatttattgatcattcttgggtgtttctcagagagggggttgtggcagggtcataggataatagtggagagaaggtcagcagataaacacgtgaacaaaggtctctggttttcctaggcagaggtccttgtggccttccgcagtgtttgtgtccctgggtacttgagattagggagtggtgatgactcttaacgagcatgctgccttcaagcatctgtttaacaaagcacatcttgcaccgcccttaatccatttaaccctgagttgacacagcacatgtttcagagagcacagggttgggggtaaggttatagattaacagtgtcccaaggcagaagaatttttcttagtactgaacaaaatggagtcacctatgtctacttctttctacacagacacagtaaaaatctcatctctccttcttttccctacatttcctccttttcttttcgacaaaaccgccatcgtcatcatggccctttcttgatggtcgctgtctcttcagagctgttgggtacacctcacagacggggtggctgggcaaaggtgctcctcacttcccagacggggcggccggacagaggcgctcctcacatcccatacggggcggctgggcagagacactcctcacttcccagacggggcggccgggcagaggcgctcctcacttcccagacggggtggccgggcagaggtgctcctcacttcccagatgatgggcggccgggcagaggcgctcctcacctcccagacggggcagcagggcagaggcgctcctcacctcacagatggggcggctgggcagaggtgctcgcttcctagatggggcggctgggcagaggcgctcctcacctcccagaagaagggcggctgggcagaggcgctcctcacatcccagatgatgggtggccgggcagaggcgctcctcacctcccagacggggcggccaggcagaggcgctcctcacatcccagatgatcggcggccgggcagaggcgctcctcacttcccagatgatgggcggccaggcagaggtgctcctcacatcccagacgatgggcggccgggcagaggcgctcctcacttcccagatgatgggcagccgggcagaggtgctcctcagctcccagatggggtggctgggcagagacgctcctcacctcccagacgaagggtggccgggcagaggcactcgcttcctagatggggtggctgggcagagacgctcctcacctcccagacaaagggcggccgggcagaggcgctcgcttcctagacggggcggctgggcagaggctctccttacctcccagacgatgggcggctgggcagaggcgctcctcacttcccagatgatgggcggccgggcagaggtgctcctcagctcccagatggggtggctgggcagagacgctcctcacctcccagacgaagggtggccgggcagaggcgctcgcttcctagatggggtggctgggcagagacgctcctcacctcccaaagggcggccgggcagaggcgctcgcttcctagacggggcggccgggcagaggcgctcctcacctcccagacgaagggcagccaggcagaggtgctcctcacatcccagatgatgggcggccaggcagaggtgctcctcacctcccagatggggaggccgggcagaggcattcctcacatcccagatgatgggcggccgggcagaggcgctcctcacttacgagacggggcagccgggcagaagcgctcctcatttcccagacggggcagccgggtagaagcgctcctcacttcccagacggggtgtatcagtctttaaaatcagcaatartgttacactgctagaactttagaacatacagacatgaaataatatcctcaccagaaaagtactaaccaactctgttactgagaagcttgagaaaacattttaacaacatctgcactcagggataaaatttgaaatgagagttcaaaggacaagatttattaaccttatctttctgtcttacaatgaacacagaagctctcataattaagcaatttgaacagaaagattagcaagggattggtctttgtatgtttaattactctgaagttataatggaaaacctctcatgggacaayatgtatttacatgtttgcaaataatgctttgctttacattatgtagaaaatattttattccagagtattgtgaactttcaaacatctattctgtagatgattgaaatattttggataattaatctcaattcatattgatacaaatatctttgactctcatactctgttgcagttactattgctacatagcaaattggcccaaattaagcatcttgaaacaaccatttcttatgttcatgaattttggggaaattcacatcagacacggaaggaataatccctgcttcttgtggtgtcaggtctcatctcttaagccgggctggcttaaagactagaattgctgatgggaacactcacacctggctgccttatgtgatttggtttccttacagctagtgatctcagggtagtcagactttttaccaggtggttcagggttccaagcatgagtgttctagtgcacaaggctggattgccaagcttcattatcatgtccacagtggtctgttggttgaaacagtcacaagcctgcccatagtcaagasktgtggccatagacacttcctcctccacctctccatgaagagtataaaaaaagttaggaccctgtttaaaaactgctacttactttatccagccctctcatagtcatattcaactctgaagaatttttctttagatattttcccaaagggactacatgttcataaaccccctacatgtgggtgaaggccaattaaactgccatgggatgatttttctttctcatgggaagcagatagaattaacagactgtggctgctgtttttaaacaaggtatgccagtatctgtatcccttctgagatgcgttgtgtttcttcagtgagggagaacatgtaattaatccctgttgaaagcccttttatttagaaatcatgcttgcttttactctttattatttggatatatatctatgtctggaaatagactgagaggaaacttgcctgttgatatcttaataaaagtaattaaaacattcccagggccaggactaggatgaggtgagtgaggcacttgcttcagctgtaaaatttaaggctacgccaaaaaactcagtaatccaaataaatattttcatgtgatattaaagaaagttaaatctaatgccaagcaatctataatcaaatatcaaagttttagataaagacagtacattattttccaagggctgctgtaacaaagtaccaaaaactgggtggcttaaaagaacatacatttcttttctgtcagttctggaggccaggggctctcaggaggaaacctcatgcctctctgctagcttcgggtcattgcctgcaatccctggtgtttgttggcttgtctccactcatcttcgccttcatcgtcatgagttcttccctatgtgtctctgtgtcctctccttttcttttgaggacaccagtcactggacttagggcccattctaatccaatatgacctcattttaaataattatatttgcaaagaccctgtttccaaataagatcacattctgaggctctgggtggacatgaatgttttggaggcactattgaacaatacagacaggatcagtgtcactgattttttttttttttgccataagatccaatatggctgagcatggtaacctccaatctgcctcaatgtccaaaaacttgctcacacctattacaggagtagatattaaatgtgttttgggccaggcacagtggctcatgcctgtaattccagcactttgggaggccgaagcaggtggatcacctgaggttgagagttcgagaccagcctgaccaacatgaagaaaccctgtctctactaaaattacaacaaaattagccagacgtggtggtgcatgcctgtaatcccagctacttgggaggctgaggcaggagaatctcttgaacccaggaggctgaggttgccttgagctgagatcacgccattgcgctccagcctggacaacaagagcaaaactctgtctcaaaaaaaaaaataataaaataaatgtattttgactcaaaatagacaatacattatgagattttttttagtagttagcatgggctggctactgccaggtgagctgctgttccatcacctctggaaccaaagactgagaagtttcacccactcatctatttcagcttccacatgcctatatgatgacttctaaatctgtctctcctgcctcactactgtatgaattctagattcctttttccaacggctcctggacagcccaacttgttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgtcctgaggatgctgctcccttgtggccctctctagtgtagctgttcacaggcctcctacccctcgctctgaagcaaagtggaagtcctcccttctccttctggtcacttctggaccatttttcccccctccaccctacctgccccagtttttagtctcacgttagcagattggcatgctctgttcatgaacctcctgagttcttctccctggttttttgaagatttttaccttcaggttcactgccattctctgaaatgacacctgatttcagcatccaagtagatgatcttccaggagccacgtttcatggtttcttgacttctccttttccaacaattttgttctctctctgtagcagccactctactccatggacctactttaaactgtgttatctcacatccaagccatcatctcagtctttctttaccacttctaatctttgcagctcactcttcctagttcttttcaccccacattatattctcactattctctttacctggtttaaattccatgatcagtcattataatcactcccttgcataatctcagcacccaactaaacccacccagcataatataattgcagaaagacacacaaccatgcttcctgggctcactctaaatgaccccaaccttgagtggactcttaattctgtgtggcaaccacacatttccctggaacattcaccttctcctagataacccttctgataataaacacactctcctggatacctagttttcattccttcccttctttcttctgacctctcatacttctcccatcatcactctgtcagtttccttaagaaaacagaagtgatctgaatagacctccatggccctcaccagctgtccactcaccttctgcacctgggtctacatactctgccttccctgatgtttctgtgggtagactgtccatgatcctagctaagggcaaccctttcatttgtgcccaatggctcttcttctttcatttattcaaggtaattacagcagcagttgtaccctccttctgtattatcaattaatatcaattgattttgagatagggtctcgccctgtcacccaggctggtctcaaactcctggcctcatgtgatccacctgccacagactcccaactcactcaattgatattaattatatattaatccatatcaatcagttaatatcatcagtcaatggattgttcatcaatacacaatctctactttgtctaataaaaaatcaggcctctcttttgatctctcatctcctctagttactgccccatttttctgtttttttttgttttgttttgtttgttcacagccaaacaccttgctatgatttggatgtggtttgtttgtgccctccaaacttcatgttgatatttgacccccagtgttggagacgtaggcctaatgggaggtgcttggatcttgaaggtagattcctcatgaatagtttagtgcccttccttaatggtgagttctcactctattagtttctgggagagctggttgttcacaagagcctggcattttccaccccctgccccccatccactaccttgcttcctctctggctgcgtgatctctgcacacactggctccccttctgccttctgctctgagtggaagcagcttgagatgcagatgtccagtcttcaattttccaatcaccagaattgtgagccaaataaaatatttttctttcttcttttcttttttttttgagacagggtttcgctctgtcacccaggctggagtgcagtggcaccatctcagctcactgcagccttgacctcccaggctcaagtgattctcccacctcagcctctctagtagctgggattacaggtgcgtgccaccatacttggctaatttcttaattttttgtagaaaaagggttttgctgttatccaggctggtttcaaaactcctggactcaagtaattcccctgccttggcttcccaaagtgcttggattgtaggcctgagccactgcacccagccaaattttttttctttataagttatccgacctcagatttctttattgcagcactaaatggaatagacacatctcaacattttcctaattcctctctttccattctttgttggacccactcaaaccaggtttcacccttgctgcatcactagacctgctcctatcaaggtcactgtgactgctctaccattggttaattctcacactttacctttcccagcctatcagcagctgtgacacagtggcctcttaattggcttttctgcctttacccatgttgcctgaagtctgttctcaacacagaagccaaagtgatccttttaacagctttatcactgggtcaactcatcccattcatctcctcaataagttcatactattaataaaagccaaaatttaaatcatgtcctaaaaccctctcagtaattctggaaccttctctcctgctgttctctcatagatttctcccttccaagcacattggcttcccagctgttgttccaacacacctggacacacttttccttaggtcacgtcagtagggaatttcttctgcctagaaggctctccactcatcattattatctatcctctccagnnnnnnnnnnnnnnnnnnnntctcagtgcttcttcactgctctcacataatctcagtgctaagaattatgcccatagtagtcctcatacaatgtttgtccaatgaccgaaagaactcatgttttgtcctcatcctgtaccttcctacttgtgtaaccttggcctggaatgccctttctcccatctggaaagtattcattccttcagacttactttttggtgaaaagtctttttctttttcttcttccttttctattacccatgctggtgatttaaatacacttaaccacaattacctttattatccctaagaaatttaagattcaagatggccaactagatgcagccaggaagaacatctgtcactgagggaccgggacatcaggaagactggtgcacatttaacagatctttggaggaaaggcattaagagtggacagagggaggacacagatactgggctgaagggagaggaagctgggaacactgcatggggctactgcacactaggacttattcctggcccccagtgactcttggggaagggatgagttgaatgggcaaggagtgacccacccttaccatggacctctggaatcctggcagccaaagaccccatgacccccatggacacttaagctggcaaggataaccgtttagagaggtagtaggggcaggactccagcctgcaaggagcccagggggtttggtgcaggagtgtctgaagtggagcatgaccagggatgcccatctctcaaggctcaccatgctcccctaggagagtttagccttacagaaactatcggacctgaacagagcaggacagtcttgcctgtgagatgtgagcagtcttatctgagtgccccactgtctgctagcctcttcttggcctgtccaagtctgcttgcagtgcagcctcagatgcccaactagggtgcgttttgtgaatccatatcatagatcctttgttgtcataccatcagagagctccaaaagagcagcctgtgccgacgtgcaccaacccacccacamcctcccctgactgcagcctccttcgcgtcactttgcctgcrctcatttgcccacgtccactccacactgcttagccagcatggtgcctgccctccttctctgacatgggtgtgcacatgtaccccaccatgccactgttgccgacataagtgcatggaggccagtggccttgtcccccacgcattgctgctgctgccagtaaaaacacacacatggagccgatagcgctgtccccatcagtgccttgtccctgtgcacacaccaccaccagtgtgaatgtgtacaaaaaggcgactgcccccaagcctaccagtaccccacctaagctgctgagcatggacccgccttgctgccactgttgttggcatatgcgaacaagcatagatcctgctacaactgccccaaagaagcacttttgctggcatcacccattggagtattgttgctagtggtcctaacctccagcagccagaggacaaagccaggggcccgataccagccccctagagttatagcatgcagcccagaagtgctgagctgatccttggtctcctaaaatcttccagaaatgaagacagtcaacttaacccaccttatataacaatcaaacgcccaagggcatcaaagaagataaaagcaaaaaaaaattaaaactcatccaaaggacagcaacttcaaagattgaaggaacgtcagcctatgcaaatgagaaagaaccagcacaggaactgtggcaactcaaaaagccatagtgtcttcttacctccagatgaccacactagttccccagcagtggttcttaagcaggctgaaacagctgaagtgacagaattagaattcagaatatggatagacataaagataattaagattcaggagaaagttgaaactcaatccaaggattcaatggcatatgataaaattatgcaggtgataaaatacaaaacggctattttaaggaagaaccatactgatctgatggagctgaaaaagtcacctaaataattccagaatayaattacartattaacagagaattgacaaacttgaggaaagatctcagagcttaagacttgttcttcgaaatatctcagataaaaatgaagaaaaaaattaaacaataatgaacaaaacttctgagaaatatgggatcatataaagagaagaaatctgtgactcattggcatctctgaaagagagagagaaaggaagcaagttgtaaaacatcttccaggatatatccatggaacttttcccaactttgctagaggagccaacattcaaactcaggaagtgcagagaacccctgtgagatactgcacaagacaaccatccccaagacacatagtcctcaggttctccaaggttgaaatgaatgaaaaagtgttaaaggacctagagaggaggggcaggtcacctacaaagggaaccccatcaggctaacarcagacctttcagcagaaaccctataagccagaagagattgggggtctgtattcagcattctaaaaaaaattccagctaaaaacttcatatcagccaaactaagattaagataactaagataagccagggagaaataatatccttttcagacaagcaaacattaaggatgtttgttaccaccagacttgccttataagaggtccttaagggagtgctacatatggaaagaagagaccattactggccattagaaaaagacacttaagtacacagatcattgacactataaagcaaccacacaaacaagtctgcaaaataaccacctaacaacatgatgacaggatcaaatctgcatatatgaatattaatcttgaatgtacatgggctaaatgcctcaatcaaaaggcacagagtggcaagttggataaagaagcaagacccaatggtatgctgtcttcaagagactcatgtcacatgcaatgacacctataggctcaaagtaaagggatggagaaaaatttagcaagcaaatggaaaacagaaaaaagcaagggttgctattctaatttcagacaaaacagactttaaaccaatgaagatttttttaaaaagggcattacataataataaaagggtcaattcaacaagaagacctaactatcctaaatatatatgcacccaacacaggaacacccagattcataaagcaagttcttagagatctatgaagagacttagataaccacacaataatagttggaaactccaacaccccactgacagtattagttcagtggggaagaaaactaacaaagatattgaggacccgaactttacacttgaccaaatggacctagtagatatctacacaactcaccacctcaaaacaacagagtatgcattcttctcatctgcatatggcacatactctaacattgaccatacaattggccaagaaaccatcttcagcaaattcacaaaatccaaaatttggatcacagcactcttggatcacagtgcaataaaaacagaaatcaatactaagaaaatcacaggcaggtgcactagctcatgcctataatcccagcactttgggaggctgaggcgggaggatcgcttaaacccaggaattcacaactaacctggacagcatattgagacctcatctctaaaaaaagaaagaaagaacaaaagaaggaaggaaggaaagaaagaaagaaaagaaagaaaggacggaaggaaggaaagaaagaaaggaaagaaagaaaataaatcactcaaaaaaaaactatatgattacatggaaattaaacaatgtgctcctgaatgacttgggtgaacaatgaaattaaggcagaaatcaagaaattctttgaaatgaatgagagagaagatacaacataccagaatgtcagggatgcagctaaagcagtgttaagtgggaagtttataatgctaaatgcccacatcaaagttagagagatctcaaattaacaacctaccatcacaccttgaggaactagagaaagaagagcaaaccaaccctaaagctagcagaagacaagaaataaccaaaatcagagctgaaatgaaggaaatcaaaatgcaaaaaataaagtaaaaacaaacaatgagtccaggagttggttttttgaaataataaataagatagactgctatctagactaataaaaaaagggagatccaaataaacacaatcagaaatgacaaaggagatgttaccaccaaccccacagaaatagaaaaaaccctcggggactacttcaaacatctctgtgcacacaaagcagaaagcttagaagaaatggataaattgatggaaaaacacaacctcccaaaattaaagaaattgaatccctgaacagaccaataatgagttctgaaattgaatcagtaataaaaagcctaccaaaaagaaaagcccaggactagatatagattcacagctgaattctaccagatgtataaagaagagcggatatcattcctattgaaaccattccaaaaaattgaggagggtcttctctctaactcactctataaggctagcattatcctgatactraaacaaagcaaagacacaagaagaaaagaaaacttcaggccaacatccttgatgagcatagatgccaaaatcctcaacaaaatacagcagactgaatctagaagcacatcaaaaagctgtgaagttgcaaagttggctcagcatatgcaaatcaataagcatgattcatcacattgtgaaaggaaaataaatctcagggccccaaaatcactaagccaaagggaagagtcaagctgggaagggcktagggaaaacctgcctcctattctattcctaaataagatagctacaaagataaaaaagctgcaaatctccctcaaaatttgcccacagggaaattccttgtagacaaagggcaggcagaactcaaagtcatccttctgctcttgtgagataaatgcatatctgattgcttcatttgccctattatttcactaagccagactaaggcataagtgactattactgtaaattgtgcattcagtgaaaggctaatcagaaactcaaaagaatgcaaacagttgtctcttatctacctatgacctggaaatcccctccgtgctttgagttgtcttgcctttctagcctgaacaaatgtacattttacataaattgattgatgtctcatatctccctaaaatgtataaaccgaggctgtgccctgacaaccttggggacatgtggtcaggacctctggaggctgtgtcaggggcaagtcctttaccttggcaagataaacttactttctttcttttttttttattatttaagttctagggtacgtgtgcacaamgtgcaggtytgttacatatgtatacatgtgccataytggtgttctgcacccattaactcttcatttacattaggtatatctcctaatgctgtccctcccccctccgcccaccccacgacaggcaccagtgtgtgatgttccccttcctgtgtccaagtgttctcattgttcaattcccaccaatgagtgagaacatgtagtgtttggttttctgtccttgtgatagtttgctaagaatgatgatttccagcttcatccatgactctacaaaggacatgaactcatccttttttatggctgcatagtattccatggtgtaatgtgccacattttcttaatccagtctatcattgatggacatttgggttggttccaagtctttgctattgtgaatagtgccgccataaacatacgtgtgcacgtgtctttatagcagcatgatttataatcctttgggtatatacccagtaatgggatggctgggtcaaatggtatttctagttctagatccttgaggaatcgccacactgtcttccacaatggttgaactagtttacactcccaccaaaagtgtaaaagtgttcctgtttctccaatatcctctccagcacctgttgtttcctgacgttttaaggatcaccattctaactggtatgagatggtatctcattgtggttttgatttgtgtttctctgatggccagtgatgatgagcatttttccatgtgtctgttggctgcataaatgtcttcttttgagaagtgtctgttcatatccttcgcccactttttgattttgatggggttttcttcttgtaaatttgtttgagttctttgtagattctggatattagccctttgtcagatgggtagatttcaaaaattttctcccattctataggttgcctgttcactctgatggtagtttcttttgctgtgcagaagctctttagtttaattagatcctattggtcagttttggcttttgttgccattgcttttggtgttgtagacatgaagtccatgcccttgcctatgtcctgaatggtactgcctaggttttcttctagggtttttatggttttaggtctaacatttaagtctttaatccatcttgaattaatttttgtataaggtgtaaggaagggatccagtttcagctttctacatatagttagccagttttccaagcaccatttattaaataaggaatcctttccccatttcttgtttttgtcaagtttgcaaagatcagatggttatagatgtgtggtatcatatctgagggctctgttctgttccattggtctatatctcttttttggtaccagtaccatgctgttttggttgctgtagccttgtagtatagtttgaagtcaggtagcgtgatgcctccagctttgttcttttggcttaggattgtcttggcaatgcaggctcttttttggttccatatgaaatttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcgttgagcagtggtttgtagttttccctgaagaggtccttcacatcccgtgtaagttggattcctaggtattttattctctttgaaacaattgtgaatgggagttcactcatgatttggctctctgtttgtctgttattggtgtataggaatgcctgtgatttttgcacattgatattgtatcctgagactttgctgaagttgcttatcagcttaaggagattttgggctgagacgatggggttttctaaatatacaatcatgtcatctgcaaacagggacaatttgacttccccttttcctaattgaataccctttatttctttctcctgcctgattgccctggccagaacttccaacactatgttgaataggagtggtgagagagggcatccctatcttgtggaagttttcaaagggaatgtttccagtttttgcccattcagtatgatattggctgtgggtttgtcataaatagctcttattattttgagatacgtcccatcaatacctaatttattgagagtttttagcatgaagcgttgttgaatttcgtcgaaggccttttctgcatctattgagataataatgtgttttttgtctttggttctgtttatatgatggattacatttattgatttgcgtatgttgaaccagctttgcatcccagggatgaagcccacttgatcactgtggataagcttcttgatgtgctgctgcattcggtttgccagtattttatcaaggatttctgcatcaatgttcatcagggatattggtctaaaattctctttttttgttgtgtctctgccaggctttggtatcaggatgatgctggcctcatcaaatgagttagggaggattccctctttttctgtcaattgggatagtttcagaaggaatggtaaaagctcttccttgtacatctggtagaatttggctgtgagtctgtctggtcctggactttttttggttggtaggctattaattattgcctcaatttcacagcctgttattggtctattcagagattcaacttcttcctggtttagtcttgggagggtgtatgtgtccaggaatttatccatttcttctagattttctagtttatttgtgtagaggtgtttatagtattctctgatggtagtttgtatttctgtgggatcggtggtgataacccctttatcattttttattgcatctctttgattcttctctcttttcttctttattagatcaattttgttgatcttttcaaaaaaccagctcctggattcattgattttttgaagggttttttgtgtctctgtctccttcagttctgctctgatcttagttatttcttgccttctgctagcttttgaatgtgtttgctcttgcttctctagttcttttaattgtgatgttacggcatcaattttagatctttcctgctttctcttgtgggcattaagtgctataaattttcctctacacactgctttaaatgtgtcccagagattctggtatgttgtgtctttgttctcattggtttcaaataacatctttatttctgccttcatttcgttatgtacccagtagtcattcaggagcaggttgttcagtttccatgtagatgagcagttttgagtgagtttcttaatcctgagttctagtttgattgcactgtggtctgagagacagtttgttttggcaaaataaactttctaacttgattgagacttgtctcagataccttttgatttacagcagaagcagaattgaaaacaaaaaccacataatcatctcaatagatgaagaagtctttcagtaaagttcaacatgccttcatgttaaaaaccctcaaaaaattaggcatggaagaagcatatctcaaaataataagagccatctttaacaaaccccaagtcaagattgtactgaatgggcaaaagctggaagcattccccttgagaaacagaacaagacaagggtgtcctctctcaccactcctattcgatatagtatttaaagttctagcagagcaatcaggcaagagaaagaaataaaaggcatccagagaggaagtcaaactatccctgtttgaagatgacatgattctatacctagaaaaccccatagtctctgcccaaaagctcctagatctgataaacaacttcagcaaagtttctggatacaaaattaacatacaaaaatcagtaacattccaatacaccaacaacatccaagctgagagccaaatcaagaacacaactccattcacaattgccgcaaaaagcatgaaatacctaggaatacagctaatcagagagatgaaagatctctacagtgagaattacagaacactgctcaacaaaatcagagataaacaagtagaaaaacattccatgctcatagtaggaagaattgatattgttaaattgccatactgcccaaagaaatttacaggttcaatgctattcctatcaaattaccaatgatagtcttcacagaattagaaaaaaagattttaaaattcatttggaatcaaaaaagagcctgcatagcccaagcaagcctaagcaaaaagaacaaagctggaagcatcacattacctgtctccaaactttactacaaggctacagtaaacaaaatagcatgatgctggtacaaaaacagacacatagaccagtggaacataatagagagctcagaaataaggccgcacatctacaaccatctgatctttgataaaactgacaaaaacaagcaatggagaaaagactccctattcaataaatggtgcttggataactggctagccatatgcggaaaattcaaactgaacccctttcttacatcatatacaaaaataaactgaacatagattaaagacttaaatatgaaacctaaaaatataaaaaccctggaagataacctgggaaataccatcctggacataggacctggcaaagatttcacaatgaagacaccaaaggcaattgtaacaaaaacaaaaattgacaaatgaaactagttaagctaaagagcttctgcagagcaaaagaaattatcaatagactaagcagttaaccttcagaatgagagaaaatatttgcaaactatgtatttgacaaaggtctaatatccagaatctataaggacttaaacaaattagcaagcaaaaaccaaacaacctgatcaaaaagtgggcaaagaacctgaacagacacttttcgaaagaagacatacacatggccaacaagcatatgaaaaaatgctcaatattactagtgattagaaaaatgcaaatcaaaaccacaatragataccatctcacaccagttagaatacaccatgggatactatgcagccataaaaagcaatgagatcaagtcctttgcagggaaatggatggagctggaagccattatcctcagcaaaccaatacagtaacagaaaaccaaacaccacatgttctgactcataagtgacagctgaacaataagaacacatggacacagggaggggaacaacacaaactaggacctgtcagagtggggatggggtcaaggagagcatgaggaaaaatagctaatgcatgtggggcttaatacttaggtgatggattgataggtacaggaaaccaccatggcacatgtttacctctgtaataaacttgcatatcctggacatgtaccccagaaattactataaaattaaaaaaagaaaattccaaaaaaaaagtaaaaaaaaaaaagtcaaaaaataacagatactggcatggtttcagagaaaaggggacacatatacactgcttgctggtgggaatgcaaattagttcagccattgtggaaagcagtgtggtgatttctcaaagaactcaaaacaattactattcgacccagcaatcccattattgggtatatatacccaaagtaatataaattactgtactataaagacacatgcacatgaatgttcaccacagcactattcacaatagcaaagacatggaatcaacctatatgctcatcaacagtagactgaataaagaaaatgttcatgtacaccatgggataatacacggccataaaaaagaatgagatcatgttctttgcagcaacgtggatggagcaagaggccattagcctaaggaacagaaaatcaaatactgtatgttcacacttgtaagtgggaactaaacattgaatacacatggatacaaagaagggaacaagagacactggggtctacttgatgggggagggtgggaggagagtgaggatcaaaaaactacctactgagtacatgtaatttacctatataacaaacctgcatatgtaccactcaacctaaaataaaagttaaaaaaattaacataaaatattttctagtgaatattccctattcaaatttcctcaactgtcacagtaatgcctttgtagttaattttttttttttttgaggtggaatttcactctgtctcccaggccagagtgcagtggtgggatctcagctcgctgcaacctccacttccctagatcaagtgattttcctgctccagcctcccaagtagctgggattacaggtgcccaccagtacgcccagttaatttttttgtatttttagtagagatggggtttcaccatcagatggccagcctgatcttgaactcctgaactcaagtgatctgcctgtctcagcctcccaaagtgctgggattatggatgtgagccaccgcgcctgccctaaaaatttttaatccaagatttaatcaaggattatacattatcttatttttgaaatttgctttgttttccatgtatctatcactaattcatgcccatcatttccaagggaagagtaaactcctttctcagcaaggtcaaataaatgagaaatctatcagttctgtttgtttttcttggagatgccgctcccaaaagtcttctttgtattatatgcccactgcacagtttcctctggacacttggcgtcacacatcatctccctcctagattagagtccatgtgaactggatcccaggtctttctctgtcttgatttgttgttcttttgttttggtaaaaaaacatccttcagtagcttcttgcaggagggtgcattggaggtaaattttttgagaacgtgcatgcctcaaaatatgctaccctcacattcagytgggagtttatttgggtatagaattctaggtgtaaatgtaacttactcttaacattttgcaggtactgttctgttgacttctagttcagtgtggattagacatccaatacattcttttttttttttttttttttgagacaaagtctcactctgttgcccaggctggagggcagtagcacgatcttggttcactgcaacctctgcctcctgggttcaagcgattctcctgcctcagcctcccgagtrgctgggattacaggcatgtgccactgcacccagttaatttttgtatttttagtagagacaaggtttcaccatgttggccaggctggtctcgaactcctgaccacaggtgatctgcctgcctctgcctcccaaagtgctgggattacagacatgagccaccatgcccggccccagtacattcttattacttgtttcatgtctataacctttccctcttccctctgaaggtttttaggattatgtatccctcatgttctaaaattgtgcagtggtatgccttcggtcattttttttaattttaattcaggaagctgggtactaggttgatgctttcaatttggaaacttatttctttcagtttgggggaaatatttttgtattattaaagaaataatgttcttgtattatttctttaataatacaagaacatttgatttattctcatttatttttccagatcctctttagtctaatgttgaggatcctggatttacctcctaaatatttccatcatttttctattttctccttctgctttttttgagactttctgaaacttttcttctaaccatattttttttttttttttttttttttttttttttttttttttttttttttttaaacactggctaactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctttttaatgtttcatgggtccaacagcttttcttctttttcagaggatactaattgcagtttctttgaaattttcttcttttgtctctggttcctctaagttcccccatccacatttttttgccttggtatatgcctcttataccaagaggctttcctatataggaaagttggaggctttcctatataggaaagttggaggctttcctatataggaaagttggaggctttcctatataggaaagttggaggctttcctatataggaaagttggaggctttcctatataggaaagttggaggctttcctataatgtcgttgatctttggttgtctgtttatatttaagactgaggatggaaagctgattgtggtgggaagtgggaaagcctggtgaatagtaagcttccctggaggattagcaagcaaggagcgagccaatttctggcagccttgccaaatgttagtgtcatagtaggatcttttcatcgccagttttgtagggagcagatttctgggaaatgaaggggaaaaaggctgggaggtcttgcaggccagtatgcagattaccccaatttttattctcttttcagttcaccctggctcctacttttccaggcacctggaagaacttttgatgtctgactcccagggttctgaggtgaggtaggctggcttcttgctggtctcccctctgttgttgtgtgggtttcagtgttttcctagtcagtcccactcagccagtggctgccaacctcctgaaactgtgatctggtctgctgttgttttcttcttccactctttttttttttttttgagacagagtcttgctctgttgccaggctggagtgcagtggcatgatctcggctcattgcaacctccacctcccgggttcaagtgattctcctgcctcagtctcccaagtagctgggagtacaggcgtgtgccaccacgcccagctaattttttgcatttttagtagaggcagggtttcactgtgttagccaggatggtctcgatctcctgacctcgtgatccacccgcctcggcctccaaagtgctgggattacaggcatgagccaccgcgcccggctcttcttccactctttatttctgtgtggatttataacttttactttcctcttctatcttttgagagagcgttggaatggagtggagacaaaagctcatgttcagttttccatcttattaggtaatcaatttgttattatgcttttcaggtaatcacttcatggtttttctttaaaagaggacttcttcaatgacatgtataattaaatacatcatagtttattttatcatgggaataaatgcttgactagttaaaggatacttagcatatattagggttgcctagtggacaagctgaattcagcaccataggctttgaccaaaagaaagccccctgaaacctacaaaaagagttagaaagcatcacttactatattcttggtgtctctgcaaaatctcgccaaatagaagagtatctcttctactatatggaaagaacacacatgcacatttattttgtggtttactttagtatctatttcatttcatcttcatggctaccttaaaatcttacagttgaaatttaacatgttttaccgttaatttccttgtgggaaatgaaaaacaataactgactggactgttctcccttctttatagcagttttttaacaaattattattcagtggggattagatttgattctgttcgcctctgggatgttgtactagtccacggctggtctttcctaggaattaattgaaaaggaaatggtagatatgattagattgctggacccagtaaaaaggtagacgctgagaggtacccgtggccaactgagacaagctgcccatgaattatgctgctctgtgcttattaagacttcatgttgcacagaaatggattgaaaagatgtaagttatccagtctctcaatattaccctcaataatttacttccaaaaagaaaaaaactgatctgaagatttcaggcaagaatttaaaattgctaatctcatttcataactccaaaaggattttatgtctgtcactgtaaaacctgctgtggatattcctaagtctcaattcagccaacttccgagaattcccacagcatgaaaatacatgaatcgccagtgcttgggctaaatgcaaaccaattaagcttttaaatagctgaagtgtgagctaaagcctgctacataatttaaatgccatctagtggccaaatgtcatctttagtcctcattcaaaacagttttggtgccttctggtatttatcttagggtgatataccaaatagttttgagtcaatcatatgatagccacttctgctttcagagtgaaacgaaattggaatatgataaaaaatgtttaacagcttgaaatgtgcgtaagtcccagcttttattccagggtcatctgcttatatggctataaaacagagttgttgcttggtttgactagtatgccatcaaatagtacccgtaagctgggcacagtggctcacacctgtaatcccagtactttgggaggccgaggcaggtggatcacttgaagccaggagctcaagaccatcctaaccaacatggtgaaatcccatatctactaaaaatacaaaaaattaccaggcatggtggtgcatgcctgtagtcccagctcctcggggaggttgaggtgggagaatcacttaaagccaggaggcagagtttgcagtgagccgacattgcaccacggcactccaacctgggtgacagagcgagaccttgtctcaaaaccaaccaaccaaccaaccaaacaaaaaacccaaatagcacccatagttataatttactattttgccattgaaaaattaaagcatatatgtaatgttaggaagctaatataggaccstattttaatcattgatagacagaggatttaaaggatcaggcttcagtcttagcaaatgaagtagctgtgagagagacatatcatttgtccataagtaagtgccatgcacaagcacattagtatgattataataatagtggccttgagagcagcagccaacatagattaaatgcttatatgccaggtactgttctgcatgctctgcttgtattaattcatttgatcttcacaataacctaatgaggtaggtattgtggttgcacccattttataggcaaattggggcacagagtggttaaatttcatgcccactagagagaggccgaataggaattggagcatttggagtatcctttggtcttttagctggtttggattttgggtagtgctttggtggaaggatcctcagagaatcatgaaagaccctttaatataacaaggacacagtcagcacttgatcatcctatgatctaggcagagtctagatctaggcaatgctctaggaagagtctgggaatgttggctcaaggatgaggctgtgcaaacaaggctctctctgggtccctggcaagaacagctttggttagacctacctgctcttttggctctgtgggggtaaatcatctctggagaattgagagtggattttgcttttgtataattgtggtctggggttatttgtaacgtctttctctctctgtttagatcatagagttgattgatttgagtgcaaccaaactagctgtggtcattcaataaataagacaccattaagcatttttcttcttactggtcacagatatggttctattctttcactttggacatgtgatcatataaagccttaaggataagaaattaggttactacctcacatagggatttgttgattgtattgtattgcattattgtattgtatttatttatttattttgagacagagtttcactctgttgcccacgctggagtgcagtggggcaatcatggctcactgcagccttgacgtcccagactcaagcgatcctcccacctcagcctcccaagtagctgggactgcaggcatgtgccaccacacctgtctagtttttttaaaaaaaatttttgtagaggggtcttgccatgttgcctaggctggtctcgaagtcctggtctcaagtgatcctcccaccttgccctcccaaagtgctgggattataggcatcagccactgcaccctgcctgctttattaattttagtgagcctcacatacagttttcaaagtcaataaccatgggtttattatcctcaatttacagataagaaaactaggatgaaagagattacgtggtttgcccaaattcacatgatatatggctatagaagtaagactagaacctaggcatttcattgaatatgctaaacacacatatacacactcatttttctaggtatatastattaatatgtgcatatgtataaatgacaatgacaattgagtatttaaacatttcaagatgtgaacatgaaaattatgctaattctatttttttaaaaatagagactgagtttcactcagttgcccagggtggaatgcagtggtgtgatcatagagttgtaaccttcaactcctgggctcaaatgatcctcccacctcagcctccacgtagtctcctcagtagccaggactacacgtgcatgctaccgtgccctactaattttttaaattttttgtagagatggacctttaatttcagttttgtcatctattctgtactttctcagttactattaaaagatcttcaataggacagataatcaaatcatctatataacataaataatttaaatgttttactgactaaaagacagaatctaggtaatctttcaaggcttactctagatttctagttttattagtttttaatttaagaaatttattaaggatttcttttcataagatgatatacctttacagcagtttaacaagcttatcatgcttcatacaatttatccagaaggaggcagcattttactattaaattgatgcttccgcaaaggttctaaattgttttgttttgttttttaaagatgtaaactatctaaatacacacaccctaaatcctttcagggcaaagattcctgactatcactagagctttgcatattgccacaactgtgaaatccaaattccactcagattaaatgcatctaaaattacaaatagcatagatagtagcaaaattcattggcagaaaccatttttgcaataaagatattgatcaaaataatttagagttgaacagaagatggagtagaagggaaaatgaatgattcagttgttgctaacttgtagaaaataagtatttggttaataagagatcaacttgttgaaaaaaatttgattcactcagaaacaaggataatgaattagttttaatcatctagctaaattcataaatgggacttgctgtttcttttgatgtttttattgaatcataggatctttagaaagaamcttgaaatttcctgtggcatatttcagtgattgctggtcagaactcatttcatctatcacggaaaatgagagtctatctgctttcagaggattaggaagaagggaattccaccatgataagggaaattaagttatgagaataacaggatggcagaggggcctttttctgttgccctgtatttgacacagagcccagagctaaaaacagtaactggggtctggtgctttctccagagtattcctaaggggctaaagaactatacaccagtccccacccacctcctctgtcccttaacaccctgtccttggggagtaagtagggtggagtgatttcccccctgccatcactaaggggctgcttcccactcccatttccaagtgaagaaagagactgtccccatcgtgacctctacttaggcataagatttgctaggctattcattctactagagcagaggagatgcaagctaggagagatgggtgatcagagagaagaggctacagtggaacagtcagcttgcctgtccattatgtggcatggccagggtgcaagaaattccttagggcaagaggacatatggaaggcaggtgccttcgagccaacttgctgtaacaacatcctcccttcccagggctatgcaccatgacttggagtgtattactggggatacttgagggagtggatgggaaagacccagccatagctcagtcttccatatgggggtgtgcagtgggaagacacccccagggccctctgactggctctcacatgtgctccaaaaggtggacttgagaggccggcactcacactcagggttttctggagaagcagagcggcgggcagagtgagggccacagctgatcctgttgggtggaaagaccctgtccctttccttcccactcttcctgactaaaatactcgagcagggcataggagagggaggaggaggggtatctcagagcccgcactcccsctcacccatcttacttcaaacagccggggtcctgactcaagcgttctttggagtgggaggagatggaatttaaatggagtttgaaattgaagttttagttggttttttaataaccaaaaatgaatagaaagtgatgcaattttggccaggggcagtggctcatgtctgtaatcccagcattttgggaggccaaggcaagagtgttgcttgagttcaggagtccaagaccaggctggacaacatggcgaaatcccgtctctacaaaaaatacaaaaattagccagaagtggtggtgcacacctgtgttcccagctacttgggaggctgaggtgggagaatcacttgaatccctgaggttgacagtgcagtgagctgtgttcatgccactgcacttcagcctgggttacagagcaggagaccctgtctcaaaaaaaaaaaaaaaagatgcaatctgtctaggatgccatggagagatgggaaagggaagtatggaatttggataaagggttaggaaaaagttgaaagatttcatatttatgatccagtaagtagagctaaattggctatataagtatgtaatggtaatgctatttaaacactaatataatttttatttttcctaattcctgttcctcctccacccttcatcattaaggcttatttaacagggaaagaaaggacagtatcaaagaagttctgagggaaatcaagatgatcagtgttccttaaccaacagaaagagaaaatagataaccgttttagttttaggagggggatctctagagtccgatctggcatgtcagcaacgtaagatcnnnnnnnnnnnnnnnnnnnntcacactttgtaactctgtacccaggacagggagaggaaggagagtgtaggggaagagacagggaatatgtggtcaaataattggatcctgattttctcctcatacctacttggccaaaggagaaacagagttttaaaaaaaggtcttttggtgggggctatattcccagagcgaggaggtttgtgtctagtttccctagatacaggctaggaaaatttcaggccttccaggagaatcaaaatatctaacacggaaccccacaggcagtgaattagacatggctgcagatggcatctaagcagagagagggtcaaatatagagccccaatatcacgaatcatcagataaatgcaagacaaaaccatggtgagatatcttctcacatgagtcagaatagctataacttgaaagtccaaaaattacagatgttggcaaggttgcagagaaaagggaacacttatacactgttggtggaagtataaattagttcagaccctatggaaagcagttgggagatttctcaaagaactgaaaacagaattgccatttgacccagctatgccattgctgggtatatatatacctaaagaaaaataaatggtcctaccaaaatgacacctgcattcatatgtttatcatagcactatttacaatagcaaagacatggaatcaatccatgtgctcatcaatggcggattaaattaaaaaatgggtgctgtgtgtccaggctgtaaaaaaaaaaaataaagacaaaaataaaaattaaaaatttggtacatatacaccatggaatactatgcagccattaaaagaatgaaatcatgtcctttgcagcaacatggatgtagctggaggccattattctaagagaattaacacaggaacagaaaaccaaatattctcacttataagtggaagctaaacactgggtacacaaggacacaaagatgggaacagtaaacactggggatcccagaatgggagaggaaagaagtgggacaagagttgaaaagctacctatcaggtactatgttcaccacgtcagtgacaggatcattagaagtccacaccttagcatcatgcagtattcccatgtaacaaacctgcacatgtaccccctgcatctaaaataatttttttttgaaaagagaaacttttggaagtcttggttatattctctgtctttactgtggtggtgatttcatgggtatatacatatgtcaaaacttttcaaatagcacatttgaaatatatgcagtttatggtatgtcagttataattcataaatctaggggttttatcccctgaaaggaataaacttctgatacatacaataagatgactgcatctcaaaatgctaaatgaaaaaagagcaagacacaaaaggctacaaatgatatggttctacttatatattattctggaaaagccaatgttacacaacactacagaaatcagatcagtggttgcctggggagtggtggcaggtgctgactgcaaaagggcacagggaatttgaggggtgggagatgcagaaatgttctatattttcattgtggtaatggttacacaactacatacatttgtcaagactcattaaaacatgcgtgaaaagggattttactgaatgtatattatatctcaataaccctgacaaaagtaaaaaacaaacagcccaaatagagagccccaagaatgccttggcttttgcttttgtgatgcggaaggatccagaaattcttacattctgctgtgggattgaaaccagaggcctccaaccagggatctgggagcaacatgtgggtaagacaccctctgccccgcaagctcccgcaagctccctggtgcaagcctgccaggggctgttggaggaagaggtggaagtagagccagaggatttgcagagccagcctgaatgaaggcggggccagttaacaggggcaaggacctgtgagacccttgctttacccaaaaagctgaccacagatgtcactggcagggtgttaccagggaatatgtctgaagaggccagccctggggtcaactgtctccctcagctgcccccggagacatgtaatctctgttctacactcaggtccctattttgtgaaggagcagggaggaatgggagaaacaaatctccgagggcatttgaactttgaactgactgcatattgatctgaaaaagactgtttaaagcgaggtaactgattgactcttttttttttttttttttagacggaatctttctctgttcacccaggctggagtacagtggcatgatctcggttcactgcagcctccacctcccaagtttgagtgattctcctgcctcagcctcccaagtagctgggattacaggccgagtagctgggattacaggcgtgcactaccacgcctggctaattttttgtagagacgtgttttgccttgtcccggatggtctcgaactcctggcttcaagtgatcctccgacctcagtctcccaaagtgctaggattacaggcttgaaccaccacacctggccgttgactcttttttttgagacggagtctcactttgtcacccaggctggagtgtggtggcatgattttggctaactgcaacttctgcctcctgggttgaagcgattctcccgcctcaggcttccaagtagctgggattacaggagtggtcttgaactcttgacctcaggtgatccaccctccttgacctcccaaagtgctgggattacaggcatgagccattgcccctggctggccactgacacttaaccagcaaattcatacctttcctatcccactccatcctgccacctctaaaagtgggaatggagcttttgaggaagtttatatcatttatagaaaggcacaatgctggctgggcgtggtggctcatacctgtaatcccagcactttgggaggccaaggcaggcagatcatgaggtcacgagtttgagaccagcctcaccaacatggtgaaactctgtctctaccaaaaatgcaaaaattagctgggtgtggtggcatgcacctgtaatcccagctacttgggaggctgaggtaggagaatcgcttgaacttgggaggcagaggttgcagtgagccgagatcactccattgcactccagcttgggcaacagagcaagactctgtatcaaaaaaaaaaaaaaaaaaaaaaggcacaatgctgccatctttttggtgcatataaactgcagcatgtcattaaacaaatcctgctatgagtattttcaggcgtccttctccccacagtgcctgtgtgggtagagggtgagacttgggttgtggggaggaggctacaagagagagaaagagaatttgagggagatgaagagggagagagggattgacttggagaggggaatgagaggaggaaacacaaggagggactcagagcctactagagtaaaggagtttgccgggaggactgagcttttggggaaaggagaggaattggagaggattctaaggaagccttgctctgtgatgtgtcctgtgatcccctgctgatctcatcgagacaccttctgtgaagaaatgtgttcaattccactccctggagtctgctctcctgtttccattctgaggcttcagtgtgctaggattggctttggggcccgggcaccttggggtcacgcacttttcatacagcggtcacccaggcgagagctgaacagattccccttattgtggagactgtcttttgtctatgcctttatgttgaaatatatggcgtcctatcctgttttgtcccattggagagctgtctgtccctgatctgcataacagccatattaaatggaagtttactatgaaatcggcttccaggctttcttaggtggaatagctgcagtttctttattcttttgcacaagttgctgtaggctttccttctttgagttctttaatcatctttaagcttcctgggatttgccaggtatgttttcagctaattagcctagagtaggattagcaaacatcccaaacagtgcttggctcatgtgtttatgagtcatgctgtatctcttttaactactttacatttatttcttcaaactatttgtttaattaaataaaatgtcaaattttagttataatgggctcaatgatttcacctgtctgctaagttatttgggcttcttcagacttggatctcactgccttttgtaacaacattggctttcgtatgacatagaggacattggtatcatatatatatgtatatatatgtgtatatatatgtgtatgtatgtatatatatgtgtatatatgtatatatgtgtatatatgtatatatgtgtatatatgtatatatgtgtatatatgtatatatgtgtatatatgtgtgtgwrtatatatatatattttttttttcttgagacaggatctcactctgttgcccaggatggagtgcagtggtgcaatcatagctcgctgcagtctcgaactcctgggttccagagatcctcccaaagtactgggatgataaacttgagccatggcatctggcccttatgatttttttttttgatagtctattttcaaggtaaaacacttagtgaatatttagaagtttagattgttaaaaaaattagtgtgtgtttacttaaaacgagagaactttaagtctatcataaatgtctattttggttgattatgggtctagtgaggcataacacacaaaaatgttgaacattccatttaaccatgtgggaaaactgggaattctgaaggattaaattttggtagaagacaatgggaaaattccatataactaagaggagatgagaagaagtatataagcttataattttctggaaaaaaagtaaaaaggacttttttttttttttaaattctgggtagaaaggtaggggaaacagtttcagaatttctaaaatatattgcttttatgccttgaattttatggtccactttaaggcttgaaaatagtatttacaaaaactgatttgattatttataccaagggcatctttcataatcaaaggctacctggagataaactctatgatatttgacaatagtataaaacacttcaatactcatgatctcaggcacaacctgtagatgtatttaaagggatttcttgatgctatattgattttttktggacaaataaaagctattttgacacatcaagtacattaatttattttgaccaaaaggatagaaagtaaagccatgcctaagaatgtgttagaagtacaaaatattataaaaatttgagctaattatttagataattcaaatattaaagtttgaattattcattagaggtaaagtgaatttctgttgaatcctttattgaattgactttgttctcttaatggagaattagcctcaaaactaggaagtgataagtagccgggggcggtggctcacgcctgtaatcccagcactttgggaggccaaggtgggtggatcacaaggtcaggagttcgagaccagcctagccaatatggtgaaaccccgtctctactaaaaatacaaaaattagccgagtgccgtagtgtgtgcctgtagtctcagctactcgggaggctgaggcagaagaatcgcttgaacctgggagtggaggttgcagtgagccgagatcgtgccactgcactccannnnnnnnnnnnnnnnnnnnnnnnnnnnnnnnnnnnnnttttttttttttttttttttttttggtttgtgtgtatcattttatttatttttgtttttattcttatttttatttttattcttatttttttttgagacaggagtttctttcttgttgcccagctagaagtgcaatggcacaatctctgctcaccgaaacctccacctcccaggttcaagcgattctcctgcctcagcctcccgagtagctgggatacagacatatgccaccacacccagctaattttgtatttttagtaaagacggggtttctccatgttggtcaggctgggcttgaactcccgacctcaggtgatctgcctgcctcggcctcccaacatgctgggattacaggcgtgagccaccatgctcagcagtgtgcatcattttagtagcaaattatttatttgatgcttaggtacctagccattagaaaatgtgttcattcccgctttgtttagtttaatattttggacttttgccttattttctttcattacttcttttgttttcatcagttttcttgtttaaaatggaaacagaatgctctagaataagcttagttctcaagtttgtccacttattttctgactgtcagtgatctcattaatcataatataatccttggtaagcgaggactagagatatgcattgtgaaagaaaacaaaaagaggagggcacagaaggaagatggggtggattcagtctccactgccactgtggttatatcagactcagaaagtaaacatgcctgtgctcagatcacgcacatctagtggcatacatttgtcaacacccaacaccacaaaatcattaaaaatcaaatcaaaaaggataaattatcattctgaacaatatgacacaggtacagtttagtcctcttccttcttctgatatctagttgtgtctttccatcactgtaggcagaccgaagtgacatcacatttgaggtgcaatcaatataattaatcaccttggaggtgagacatattggttctcaagaactgggtctgacgtcaaaggagagcaatcttgcaagtgcagaagaaaggagtatcaaacagtgcacctatcttggggacctcgaccttccaataaatcacatcatagcacacctaccatgacaatatttcacattttcaaaacaattttggtgtaagtatcttgtgcattttttwaaattttttttgagacagagtcttctccatcacacagactggagtgcaatggcatgatcttgcctcactgcaacttccaactcccgggttctggtgattcttctgctcagcctcccaagtagctgggattacaggtgcccaccaccatgcccggctgatttttgtatttttagtagagacggggtttcaccatgttggtcaggctggtttcgaactcctgacctcgtgatccacccaccttggcctcccaaagtgctgggattacaggcatgagcaatcgtgtccgaccatcttgggtatttttaaagaaatagcactgctattataactttgttttcatgtaagtggaaatagtggatttccatgggatgaaagcaacggggcaatgcctctagcattgtttagtgctagatgaggctggtagttggtaagaagtataaaaatcaaggagagaccgggcgcagtggctcacgcctgtaatcccagcactttgggaggccaaggtgggtggatnnnnnnnnnnnnnnnnnnnnccgtctctactaaaaatacaaaaatcagccgggcgtggtggcgtgcgcctgtagtcctagctactcgggaggctgaggcaggaggatggtgtgaacccgggaggcggagcttgcagtgagcccagatggcgccactgcactccagcctaggcaacagcaagactccgtctcaaaaaaaaaaaaaaaaaaaaaaaaaaaaaaaggagagaaggagagatgactttagccaaaataagtctggaaatgtgattttagccagtcttcactttatttcatctgtggttcgtctgtgggtcacatttcccttcctaacaaccccaaattcttatatctctttaaacctgatcttatgaatgttgtagaaccaaatttgtgaatttcagacaggctactgccttttccagagatatttacagtttaagcctttttttwaaaaaaaaaaaaaacaaaagaaagataagctttatcagtaaatggaatttcaaagtcaaaagaggctgagcaagagcctttttatttggaagcagagggttctttctagtacagtcttctttgcttcatctgtaagtttgaaagtcttttgtctttatttatatttttaaataagttaggtacaaaagttcagagaaagtcccacttgatttggtggaaattcatcaattaactttcaggtggtcatgctattaaaacagtcttctgggtatatcctgacataagccaagacgttttcactggaccacttttttttttttttttttttttttttttaatttttgagatggagtctcactctgttgcccaggctggagtgcagtggtgcgatcttggctcattgcagcctccgcctccctagttccggtgattctcctgtctcagcctcctgagtaactgggactacaggtgtgtaccaccatgcacagctaatttttctatttttagtagagatggggtttcactgtgttggccaggctggtctcgaactcctgacctcaagtgttcctcccacctaggcctcccaaggtgctgggattacagacataagccaagccacccagccattttttttttttttttttttaagacagggtctcaccatgttgctctggctgaacttgaactcctgggctcaaagtgatcttcccatctcagcctcccaagtagctgggactacacgcttgtgccactgtgcctagctcaatagcatgtgtgttaactgagttagtaacacagttcctttctaccacctccaccttaagagtattgggagagacttttaattaaagaaaaaagtagcaaatttgaaaaatagaatgtactaaacattctggtttttaaagaatgactattatgtctgtgaaacatcacctatattttgtttgataaaataaaaaaagaaatgcttggttgaaggcaatagcaggttcatgtttttatgattgcatatctcacaataaaaaagtaaactcattaagtttgttacaaggatttggcagtttttatgtgatttactcttattaacaaggacaaatatattgaattaccattttatatcaaatctatatcctataggatttaaaatgaaccagtctggttgacacatgagtatgatgcagaaaatcactaatgagaataaaacaggattccaagtatatcagatgtccctatttgtgtatgttatatattaaaacatgaatttgtgtttcataagtgtaaggctttgacttggttttaagaatctgatattttaatgacctatccagatcctttcaaaagaagtcattccttgactatttcaaakactttacttctctatttctgctagccttggaaatattcactgttgatttttttcctttggtcacaaccttccacctcctgcttttatcaagcccttcaaaatggttcttttcattctgccttgacatttctccatgcgccctgtggcggcccactccagcctgttgtctcccactgctcacttaggggctttagctggaactgtgtctgggctagacctggtcctcaagaatatgtatttagaaaggtgaacagctttaatctcattgtgctgtccttccctctgttacttccctgctcttccagtctgttggcttttaatttcttttttcttttttgagagagagtctagctctgttgcccaggctagagtgcagtggcacaatcatagctcactgcaccctcaacctcctaggctcaagtgatcctcccacctcaagctcctgagtagctgagactagaggtgcatgccaccatgtccagctaattaagttttatttatttatttatttatttattattattattattattattattwtttttttttatagagacaggatctctatgttgcccaagctggtctcaaatttctgtgctcaagcgatcctcccaccttggcttcccaaagtgctgggattacaggtgtgagccaccatgcctggccacctttcatttctgacttctttattttttagctgcatgtttgggaaagagagaacatagggaaggcctaccatacacttgaccacctttgctcagaagtgacccacatcacctcatccatgttctggtggccaagaaggaggcaggaaaatgtagaggtgcagataaatattgataagcattgacagtttctttgatgtcagtcttgtagaattattttgagaattaaatatgacagcattttaaaaatatttagttcagtgtgtggtagataattagatcaataattattaaattgcttagtattccagttcaataaaagttgtttttctcttaaaaaagggttgatgaattagcattctactatatgttgatatatttccgtgagtttggttagtgcaagccaaagtcagagaggttgttccatactcagagtattcataaaaccgtatttctgggtctgcaagaacagtgacttagaaaccatcctgtggagtcacatcttggggacatttcagtcagctcccaggtgaaattacatggtcaaaatgatgtttttcttctgattttagctgagctctcaatgttaagacctgggtttggagtatctatttatcaatatacatttttggggtcattctgagttatctctagtaggctgtttgttctattctaaagctcatttcctgagctttctgtgggatgcctgccatggagtcgcctcctgctgtagcctggagtggggtttgcctggtggtcctgacactgattcccttgccacctgcactccaggtggcttaacacccaatcttgagactgaatgtgtcaccctttctgataatccgataccattttctttttttctttttctttttttttgagacagagtctcgctctgtcacccaggctggagtgcagtggcgcaatctcggctcactgcaacctccgcctgccaggttcaagtgattctcctgcctcagcctcctgagtagctgggattacaggtgcctgccaccacgcccagctgatttttgtatttttagtagagacagggttttaccatgttggtcaggctggtctcaaactcctgagcttgtgatccgcccaccttggcctcccaaagtgctggaattataggcatgagccactgcacctggccacctttgcgttttataatccctctgctcttttgctgcctaaatcagaacatgcctaccccaggaagaggcagggcacatccgcctcagtatcaattctactcactagggacaaataaaagccattatttttattttgaaacaaaaataaatatattagggaatagaatgtaaaatcctcttgaattttgaatcaagaactacaagaatttttttttctataaattgggtggaactcttgacccatttttagtttggtttcatttgccattttgaaaatactgtgggtagagtttaaggagcagacttctctcacttacatcttgttaacttgaacttgttcttatcaagtctaaaacggattctattctagcaatgcatcctctgataggtcactcctgatgtcttctggctggtagagatgcctctttgtaatgctcacagccatgcatggctttctcttatggattttgtttacattttatttattattttgttatttagcaaacataaaatgcttattaaaagcaaggcaatcttctaagtgactaacgtattttaattttcacaacaaccatatgagggaggtactcatttgtgtgtatgtatgcatatatatgcatgttggtgtgtgtaaatatatctctgtgtatgtattcttatatgtatatatgtatgtgtgtatgtatatatgtgtgcatatatatgtatgcttgtgtgtgtatgtttatgaaacactgaggtacagaagctgaataactttctcaaagtcacatagccaatataagccataaaccagagatagtttttgaaatcaggtaactgacttctaagtcgatactcttagccactatattgcctcttgctgtattttaattgttggttaacttctctcttttcgtctggactataagggccttctggacagagttttattgatcttgcatcccttgagcctagaatggagccagacacacaataactgggcagccagtgttggctaaacctttgcatggagagggtggaggtcatttgaactgtctgcctaggccatgtgacttaatgaccccatcaccttctttatgaacatagccagtgggttctaattgttagaggaattgtacacttatttcattctgtgcttagtggaacacgttgtgaaatttttgtacatagacagtttcttggaatattttaacaatttctttgaatgtctgaatgggaattctaggattccaatttctctctgtcccttgtttgtgattctaggaaatacagcttaattcaaagtttgtgaaagctcaggaatctttctgccatgttctgagattttattctgtactacctgtcctagagttctgatttcaggaacagactccaccaaaaaacagcttttgaggctttgaaagtaaaagcagatgccattacctgcaatatcagcagttttccttagaatctttccgaagtgacatctcaaggagctgatttggagcaaaactttatattccctgtgagccgaatcattttgaaaacacacttgttgcaagtgatgactggtcagaagtaaatctactgagtgtcagctccatgtaggagtaatccaccacagcttaaaaaatcaaaaccgtattttccttagaaaacatgttttaatgaatatcaaggtagaaatcttccttattttgttgataattaaaaggaaggctttgcattacaccaaatttggactctctttgtggtccttgcttcccctaaccctactttatttcatacacacacatacacacatgcatacttttgttttgttttgctttgttttgagacagggagggtctcactctgtatcccaggctagagtgcagtggtgtgatcatggctcaccacagcctctaccttccaggctcaagcaatcttcccacctcagcctcttgattagctgaaactacaggcatgcaccgtactcagctaatttttatattttgtagtaacagggtcttgctatgctcccctggctagcttcaaacccctgggttcaagtgatccttttgccgtggcctcccaaagtgctgggatcaaaggcacatgcatactttgtttctatttggaatattttgagaaaatgtggtctgcctgctgtcagttccatgtcagcattcattgactcactcatatggcaaacatgctgtataacttttatcattaccttacttgcatctgattttctttttcaaaaactggaagtagttacatgtctttgtagggtcagagagttagaattatatcacagttattctctctccctgtttkcctcctcttccttctttctctttccccaccttcaactttggaaacaaaccattagtgcttttatagttagagagtaccttgagggaggaaatatttctgtttcctcttgagggcaatctcgtaaattctgctaacatactaagaggtgtgaatcagtacagtgaggccaaagggatcatatggttgaattcagatcctgaagcagttactctggatataaatgactttgccactaattgtttatggcatattaaaggctaagagctagaaagatgacaaaggacatgcatttagggtagtgtattataattatatgttgagtgttacttgtggtaggtaaacacagtgtgaaagacatagtaactgacacagccaaagatcaataatccacatattctcaattagaatatgtatgtgtgtgtgtataaatatgcatttatttatatatagcccttcttatctcagaaaggaatgaagattatttaccaaaatacacatggtacaaagagataagtaaaattgaaaacaagtggatgagagtaccagaaccctaaatgagggtaggaagatgcagatgaagctaggagttacattatacattaaatgtatgctgtaagaatgggtctatttgctcgtgttggctacaaagtctgccctaaactttccagtagctgatacagaaagcgatatggccccaaactaagaaggagcaaaattattcctaatgctaagaagaccagtgatgaatttttcataaacagggtgttgcaaaataactaggccctcagcaatatcccctgagtaaatacaggaattagttttattggtttgctctatgatcctgtgcaccctgaggctggcagatattgactcttccagaaatagctatttttcatttgtggagctgcttattgtttaccaaggctcaggaatctttgaggagggatgatagcaaaatattattgttttactagattaaattaggtaacaatactttggcagctaatcaatagctaatgtataatcagaataattgtgtatatacaagtattttttatcctagaagtaaacaaaacttttcttaatttcactgagttattattattattaattttgctgactgtcatttgatgttgtttatttgaatatgacttctataatttctrctgtgtgtctgaagaaaagggcagaatttgagagtgtttttaaaaaaattcttacatgtttcctgtaagaattttacatgtttgccttagactctttaacaaaaatcatttatttgtaaaagtgatacatgctcattttaggagatttggaaaacacaagaacacacaaatgacctaaaatctcatcatttataaataactttggcatgttatatagtatatgtctttatgygtatagtgtatgcagtggcttaatttcttaattttatgagggttactacatggttccacagccatagaaactagctttatagtttctctacttatgattaagtaaaactattgatttcctatctgcktgaacacacagaactatcctaagatactgtggaattgggagcaaaacacaaaacccaaaactttgagtttaagaccagagacttgagagaaagtctgacattcacaaatacactcccaccaccacgttttttattttgttttttggtttttattaaacaatattaggtatcagtttccacaatgaaataatgttccccaagtgatggtgctacagaaagtgggatgcactatataaatgtgaatggtattgtccttgttaactaacactagtgacttcgaaactgaacaagagcccggtgaccagggctctgaccatgtgctcttgaccctttaatatagaaggaatgggggaaaaaagagggaaattagaaagaatactccagagtagtgggatgggtccagagatatgagttgagacaatagagaagagtgagaaatattgctcagaggcattgccattttaatttatttcccacaagcatcatttaagttcacaggaaaaagtaatcacaattggaaatataaataaataagggggctgatagggatatgttcattctcagtgcaaggaacactattgagtgcctgtgtgttccaggaacttgggagatgcaaaggtgcttgaaatgcagcctttattctcgaggagttccaggtgcattttgcatgatactaagagtacaaaaataaaaaatgggaacaatccaattgaataatgagacattttatttttaatacattttaaaatttgtaacagtaccaaacttttagaaacattgcaagtacagaacagaacaaaaagtttttttgtttttctgacaattttagagtaagttgttgacctgatgtcttattacctgtaagtattttagtgtgtatttccctacaagcatattctcctacataatcacaatataaccatcaaaatcagaaaattaatactgatactgaagtacaatgccatgatcatagttcgctgcagcctcaaactcctgggctcaagcagtcctcctgcctcagccccctgagtagctgggactatagtttcacaccaccacgcccacctaattaatttttttttttttgtagcgatggggtctggctatgttgcctaggcttgtcttgaactcttggctttaagcaatcctctcaccataaccttccaaagcactgggactacagctgtgagccaccgcacctggcccattgctaactttaatcctcagaccccatttaagttttgctgatcatatgctttataacaaaagcttccagttcaaaatcacatatcacatttagttgtcattttagtttccttcagtctagaagaagtcctcattttttctttgactttcacaaccttgacacttttcaaaggctagttattttgtaaaatgtcatttaaattggggttgtctgatatttcttcatgattacactcaggtgatgcatctttggtaggtgtgatggttaatgttgggtgtgaacttgactagattaagggatacctagatagctggtaaagcattatttctgggtgtgtttgtgtgagtggtagactgagtgggaaagatttgccatcaatgtgggtgggcaccagacaatcatctgggggctcagatagaacaaaacgcagaggaaaggtgaattcagcttctctcctggagctgggacacccttcttctcctgcccttgaacggcagaactccaagcttcccagcctttgaactctgatttgcagtagcggccgactgggttcccaggccttcaaactcagactgagaattacaccatcagcttcaacactctgtgctgggaagctcccacgccttgatgttttcctcaccctctttgagctctggcagcccacagcagattgcccctttttggtggacactcttcttactgagctcaggctttaaaacccctgtgaggcagccatcttagagagtgtctgctctatctgagctctgacaccctgctctgggccatggtggctctcccctttgaggacaaatatttctcttactctgccccagttcatggttttaggactgcattatttggaagggaaggaaagagaaaaggggaaggaagaagaggaaaagaagataaaatctattttaaattatgaaaattggaagaaataacaatgtatattttgtatttgttttctatactaatgataaatgaggcctctagttatcttaaaagactaaaattttattcatgtttttaaactttacatttatttttttcttaggggactaatgtaatgctagataattaggctcagattccttatttatattcttatttggggccagaagggaaatatactttaatatataatctccccttttttaatatgcccagaaggattggaaaatattgggaattaacaattattagtgaagagactagattgtaaagctattatattttaaaataaagtcagcattgctccttttaatcatttcatgcaattttgccccaaaggcatttatccttgtcgttatccattgagttgcactgtaaaccctattaacttaatccagatgaagtcacagagttatttctgactccatgttgtggttctattgaggtaattactaccaagtgatcagtgattgaatttgaaaaaatgcatttaattattattaattgaataaccactgagttaataaaactgtcctaagatattatactggaaattaattgaatacaatatatctaccttctagaagttatgccctgaaggagataataaagaagtaacagtctttttcaggaaggtgaaagacacttaataaatgctcattaaattaaatgttttcctaacatttggaagctggggtggctcatgggagctaaatgacaatttcattcatacaaattcttaatatggcaagcatgtcaagttaatcaacaatgttaggcaatccagtgacttgtctgagatttttaatatctaaatagtaagctggatttaaaataatcagtctagtcaattatttattttcttttgtaaaatgtagtaataacatcaggttaaatcaaggtaaataacctaaagttaaaagattacaaatgtccacaatcccatccctttcttyttcttttaaaatgtaaggtgcctagtaattttcttaaataataatatagaataatagatagcttgtctgtctctgactggcttgaccttgacttgttccatgatttcagcttagaattcttactaaccataatgtggaagaattgcagggccttaatgcaagctgtgattctggaattgcctcataaatttacagataaaaaaaaaaagtgggatgttttgcgcttagtaatgtaaagaaagcatttgaagaagttatcacaatcaagtacatctgcaaaattcagaatccaggaagttaaaatttcccattgaaagaagagatgaccacaatacccaacaatacatttactgattcagcatgaccttaaaaatgcatttcactttttctctaaatgaatgtgtgtatttgttaagaacattaaacaaagtctgcatatagcttcaaggattcaataatagtaaagagcatcaaataacagagtcaaaagaaataaactgaaggaaactgtgagcaaagatgaaaaggcaaagtctctggaaacagtcaagaagaaagattactgaccactggactgaacttgagactttcagctggattcaggtgtgctcctcgggtctcctttctagacccaggccgaagtggctgcaccttcctatagcatgtttttctcatggtgatgaaggagaggtgggtgcaggacgtgcactgcccctgaagaccttggctcagaacaaacacactgtcacctccacccacatcccattggccaaaggaggtaacatggccaggcccacattagtaggatgcaaaatacaatcttcccgtagtaggaagattctgaagattcaagttttgagaagacagaaaagcaataaagtgatgcatcaataggaaaagtactttgctatgaggcaagaacaacacatttgctttcagaagcaaataaccctgagacttcaaagaaaaccttttgatttctatctttcatttatttttgttcaaatctttgtgtctgataacagattggaggactctgggaatccactgctttatgttggtattttaaggcagtcatttgcaatatcccttgtagtccctgtcctcctttcatcccccaaccaacctctggaccatttcctaacagacaccattctgaaattatttgaactaaaaaagcttgcctgaggaaacagggttcttttaaatttatggagcttaaggatcttaaataggtaatttttccaagcactacacttggttaggagggaagaaagggctgccttccagagggctagcttgtgttaaattcagttcagaaatataaaacttttgggcccatttgacaacaattcaacaacagtttaggagattaaaaaaggartgggtagagattcagaccactgactaatcattctgaacccggaagtctagagagtttctgaggttttagattgcatcatgtataatgtcaaattctcatacataggaaacccaaaccatctgactataaagtctatggttctcaataatgttaagaagtcttattctccctgcagtaaccaagattattgtccctagttcttcactttattctataataaaatgatatgttcttgtccttggccaggggaatttgaagtgcttcctactatgggaagattgtattttgcatcctactaatgtgggcctggccatgttacctcctttggccaatgggatgtgggtggaggtgacagtgtgtttgttctgagccaaggtcttcaggggcattgcatgtcgtgcacccacatctccttcatcaccatgagaaaaacatgctataggaaggtgcagccacttcagcctgggtctagaaaggagacccgaagagcacacctgaatccagctgaaagtctcaagttcagtctagccctactgagtccagatggcttgcagacctatgtggggatatataaatatttgttgtgtaagtcactaatatgctgcttcacaagcttgatttcaaaatttacttcttagtataagtcctaaagaacaaatgacactacaaatggcatgatcatcctgacatactccaaacgctctttcagaataaactgcctcagagcttccaaataaaaaatgtaagtcctagattaagttatgcttaatatcacttaaaagatctcaactattttcttcactgtgatggatgtatgagctgttactggactgtcaaattaaaaacagcaaatcattttacatgaaaaaatagcctaccatacagccattataaagacaaatccagaatcttgggacaacccgattctttggcttctctatccctgcacctgagcagctgaatgtggagggagaaaacaggtagaaaaaatccactctgctggctggtctacttaagatttattgcagcacagtcagacactcctaccccacttttatggtaggttactgtgttgggctgttcttgcactgttacaaagaaatactggagactaagtaatttataagaacagaggtttaattggcttatggttctgcaggctgtacaagaagcttagtgacatctgcctctggcgaggcctcagagagcttttacttattatggtgggaggcaaaatgggagcaggcacctcacagggtgaaagcaggagcaagagagtgaggagggaagtgctgcacacttttaaatgaccagatctcatgagaactcactcactatggcgaggacaatagtaacaagagggatggtgctaaaccattcatgagaaatctgcccccatgctccaatcacccaccaccaggccccatctccaacattggggattacctttcaatatgagatttggatgggaacacacattcaaactatatcagtcatcttttcctttcaccaggaaggaccatttcacatattctcctctcccctcagacctccagtaccttctcctctggcctcactcttagctgatgaccttgcttcttaatttactgagaaaatagaggcaatcaggagaggtttaccttatcttctatgtccaactccatctggctatgtgtctagatggtcttctctcttgttatcattcaaatggtcccagtccctgggcctatatgggacagcctctctcagcactgaatctttgaagcccatcctgggctgcatccttgagaactttgcttctgcaatcatgccctctcctttctgcagcatcaattttcacctttgagggatcattcccatcgggatacaatgtgtggtgtctctcccaagttctccccaagttattgctgttcttcatcaccaaaccagtaaaacagacagcctatatttgctgtttccatgtcctcaccttccattttctctttaactcattccaatcaggatgtcatcctcatggcttcaaggtaatgattctcatcagggtcactagggacctctatgctgccaaatcccttgggcaatactcctttttcttgaaatattctcttcacttagtttcccattcatcgtcctctcccagtttcttccttttactggaygtatcttctgcatttcctctgctggctgtatctgatctcctgaacttctaaatgttggaatgctataggacagtgtccttgactctctttggctgtctatcatacccctttctatgtgatcttaaccagccccaagggtatctattttcagacaaattccaaatgtatatctcctctaagctccaaactcacctttccatttgtatgtctaataagcatctcaaaccagacatgtccaaaaccaaactcttaccttccatacccacttcttcctcactttttccaatctcaataattataactctattgaccagtagctcaggccaaaacctaggtgtcatcctgatattgttctttccttctttccccatatcaatcagcaaaacccactggctctatcttcaaactatctgaaatctgatgacatctcactcttttcaccccaccacctcctgtgcccttttggcttccttttggattctgtcatgattggcaccagcacagatggacagagaaaggccaggtatttctcccccactccctctttgattcagggctgcatctctagaagtcgctgcattcgcgtgactccagataacccttgtccttggccccagctggcactgggctctcctgttctattctgtctttgctccttcagcccttggaatagtactgccttttctcttttgctttgcatcccatttatgcctccgtgaacttcaaatgaaatctcttcatctgattcatctgagggtgaagctctttttctgctggaaccctgactgacacactactctatctaaaatatcattcctcttcactccttatccctttaactattttttttcttagtatatactattaactaaaatgtatgatctgttgttttgtctttgctttttattttttgtcctccctctcctcttcctcaaaaggtaagctttctgggggcttttatttttatttccacatctttatccctggcccctggaagaacacctgatatagagtttcatgtaaatatgtttctatgaaagatggttctgaagtgttatggaatctggtgtcattacattgaggggaaatgaaaaagtgagttgaagaatatcatggcatggttatatttttaaacaatctacctattcagatataatatttgagtagtataaaagaagcatatacccccaaaatattaacaggggtcactttcctggaagtggatggtaggattcagtggattcagttttctgctttgtgcttatctgcacaatttgaatttgtaggagaaataagaccaccggaagcctctacgaagtttttagaaacattagaaaaactcttcccctaaccacagtggagacacagacctgctggcactaggaaagtggattttatttctcactggtcaccattttgaaaacacaactgtacaacattatgtgttggtgttgagaacaagtattttttttaagatcagaaaaaatatcatttatrtatgcctttcccctcaatttattttccaacccatcttttatgtttttttcaaaaatgtcttgacattacataaccaaaccaaaatttattaatagtcccttattactttttcttgacaaacagaaaaaaagtatactcatgagcaagaaagaaaacaaacaacaaacaaaatgaagtaggaaactcaatgttaacagcttaacacagaaagccactacaacaatgaacaaaaattgcaagttaatgataaagtaatgtagaaacaaaattacagactactaaaaacatgggattgccagttgttcagaaattccacagatggatcgtgagtggtaagtagcagaagggttctgggtaccctctacaggaaaagctaacgttgccagcagatctgattttaagttgtgtctcagatatttgacagatcccattgaattttgatgacttctggtcacgcacccaactagatattttagaaaaagtgagttcaagggaacttgaatgcaaaggtgctcaactaggcccaagagattttcatgtctggagagctgaattaagtgtcatggaatctggtatcattacataatatagagaaataagacttttgcatttccatctggtgcagcttagtaaaccccagaggcggcctctccaggtcagagttgagacacatggttggtgtctcctggatgatgtgggaaaagcatgccttgttgcttgagctgcgtccatcctgacaccggcaaagttgaccagagagccggaaaactggggttgatcctggataatcatgcctgccacagggaccaaagagagtttccaacacggccatgaagtctggtccacataatcaatgataggtgatgtaatagtgatggcctgcctgagtttcttccagcctgccctgccacctggtcctgagctttgtgctctctcctatttccttgatcttgtacctgcctttcccaaagaaacagccacactggttataaaggataaatattttgtaaaaagcgagttcataggaacaccaatgtgccagtacccatttgggccacaggctgcctggggatcaattgtcccactggttgcagagtggctgatgtcctctcccagatttttaatgatcacagcaaatgctttacagatggcattaatagatctggccagaacaatgattctctcagaagagttgccttctgagatgctgatatgtgcattatcctccccaagcagctccttaactgctgttacttcccacactctgcatggttctgccaaattcctttctacgtaatatgctttcggtcatcctggagtctgtggcaagcagtatctggagatttggatacttgttaagtggttgtttggtcactggtaggagtgaccaaacacttttcctctcagtcatcctgggaccacaaagcaagcctgctttgataaatagcgtgtaagtgaagatgttttatattcaggtgaaagggtttaagaatggaatatgattttccatgctcttttctctgggcatggtgattgtggaatgatattttgatacagatgtccacacgattgaatcatgcagggataccaagactccacatgaaggacagcttcattgaacctcacctgcctcagctttgtatgagtgacaaataaactgtgtgtagcatcactaagattttgggattgtttgttaccacagcataaattggcctatcttgactattcatttgtaaatattgtatacttatagtgcttatacagtttcaggcacattggcaatacatattcgttagttaaatggattgaattaagaataaatttaacattcactgaacaaatgactataaattatggaagtatattagctagaatagctcagttcagttttatttattgaccgatactgtggtagatattgagaatacaaagataaatttgtttttaacctggaagattttggttggaagataaaattggaaaggttgattactgtctggatgtggaggatcttaaattaaagactgrgccattttaattcatcttgtagacaatgggagggaaaagtaggtgtctatgggttttgagcaagggagaagtactattaaattgacattttaggaaaattaatctgctgatggtgaaggaggtataagcatacaagttgagaggctatttcaataatctaggtgtgaaaagataagggtccaggctggagtgttggtgattgaaatgaaaaggcataatcggaaatgagagaaattagaaagtaaaaacagggtattggatatgtgaggggtagggaggtgagaaggaagaatgattaacgaatgactcttagattccatgtctgtgatgccactggtggaggttgggaggatatagaagatgatgagttctttttgttgtgtgttgaatttgaggaatgacagctcattcatacagaaatrtccttaaggttagtttgtgaagtaggattggatggagcttggcagagaagttgatgccaaaactagattatagtgtagtgatcatactggaaacagtaagagtagatgaagtttctaaacgggagcttgtagagagaaaagcgtgggctttaagagagatcctcatttagggacatgagaatggagaggagttagcaaaggacacagggaagtaatcagtaggagaggtaatttttactgaacatttactatactaagaattttacatgcattttattatctaattctcacagcctcccctaggaggaagagttattccattttatggatgaacaaactgagactgataggagtttaagaattttcactgaggtyaaatagctactaaacaatgatgccaggtctgcttgacaacaaaatgttgtcattttgttcttaaccrttgcggttaaactcaaatgatccaagttttagatgaaccagcttgttattgaggaggggctggccaacagggtcatacgctataarttcaaaagaaatgatgtttgagaacaggccattgatttgatgaacaggaagtgatggttttgagtagaagtgggggtagtgagcaggagcatcactacaggggacaaggtaaaggcatgagtgggtgatgctgaaggaaggaatcggtggagacaaccaatcaagaaatgacaggggaaaggaacaagaggaagggatacatcctaggggggatctcagggttactttcacagatgtatttatttccaagacagaggcacaatttacatataagataaatggatccaatggagccagagaatggaaataccacaaagatggcaccagtggagttggtaattttttgaggaggatagaaagackgggatctaaagtccaggggaagggatcagctctggagggagaagagcaactgcttgcttcaagaccagaggggaagaccagctatattttaarctagagatactctggcatctcttgaatttactggatttgtggaagttcctttcaccacattgataccagtgaaagccaattttaacttagattagctcagaattaaaatttccagttactaaaatatgtatgtgaaaatgtgagattgttttttaaacttatagataaaarttggttttataagaaaaaattattataattctttcaagttacatcactgagtccttagtactttgttttagaaaacaactacctgttcacctgctgagctcatttccagtgtctggtttgagttctgaccctaaaaatgctatttaataaaatgctcttattttggatacatcttatgcatattttaaaaaacactctttatgaaaaacatctttgcatcttaagtttatttgctttgaaagctttaagtcttttttttttttttttttttttyttttttttttttttttttttgagatggagtctcgctctgttgcccagactggagtgcagtagtgtgatcctggctcatggcaccatccacctcccgggttcatgcaattctcctgcctcagcctcctgagtagctggcactacagatgcatgccaccatgcccagctaatttttgtggtttttttagtagagatggagtttcaccatgtgggctaggttggccttgagctcccgatctcaggtgatccgcctgcctcggccttccagagtgctgggattacaggcgtgagtcaccatacctggcctggcagctttcagtcataatatatacatctcaattatttttatactaacttattggtttcttatataaattccaaggcatgtctaatagtctgtcattgcaatctgaatcagctttttttttcctgagcaaacacaattaraagggctttaggattaattacatgattaaacatttagtgactcccaaaaacttagtgaaataaaatgcatagaaattgttgactcagtattctaaataaatctaatctttargawtgtccatggctttggcaggattcgaggaacatgaatattatggggaaatttttttatgagacttaaaaaggaacaagaacacaacaatataaaacataagaaaggaatctagtatttttgtcagaagcaagttttctcatgaaaatggaaaaaatatataatttaatttgcatgtttttttttggtcaactctggtttattttgttggttttgtttatttgtgtgcttgaaaggtttgctgctgggcccttggactaagacctgggaaactctaagcttcatttttcttcacgtgccaagtggtatagggaaagttgcttcatcttttatatttatgaatccctaggataaaaaaagaatataccacttacttttttgaaagtatttgtgagtttttatatgaaaaactgaacaatacttcaaattatagagcagcaggggaaaatcgagtggggctgaggagacagattatgctgcctaccttccatgggactctgttgggctcactttgtagttctgccattcagggctggcttccccagctcactccrcttgtggctttggacactgctttttctccacactctctcttcgttctccagcttctttgctgactcctcttccttgacccagccctgaaatgcaaagattctctgaaggtctatctccacacccttctcttctagcattatctatatgctagtgcagtctttttcacgcccaatgttcctgccacgtttccacataccagtcagacatctgtgcctatgtgccccacaggtactttaaacccagtgcccccaaagtttaacatgtcttccagtcctctatcaaaatgcttccctttctggactctttgtgttgattaaaagcttcaccttctcatagtcaacaaaactagaaatatgttcattttccttgcctctcacatctgatcaactatgtgttgttaatactayctcaaatgatttaatctccttcatttcccacatcttataagtagccacattctgtttatattatctctaaaatgttcgcagtgtctctctcttgtccattctatcttctgcccttgttctgacctcatcacctattgcatcagccagctacctggccttcttgcctccttctctgttcattccatcctgcacacagctgccagagttgttttctaaaatacaaatttaataataataatcttttgctgaaaaaccattggcttctgcagcagagtctggctgcagcctcattttctggctacactgtttctgcacccctttccgccccccgtgtaatacatgtgtgctctatcctgtacatccagcacaccataaactttcatggccccatgtttgtttggccttctgtaatgccctacctgtcttttctacttggtgaaattacaccaatctctcaaggtccagctctattgaaaagatataatagactatctttagaatatagtaggactctaataaatattttttggtaagttagttataaagaaaatacaaaarccttatggtaccagtaaaggatgagggattattttgttagctgagaaatataactgtgtcaagtctatactgtccaagatccctacctgccatttgcatggtctgcctcaggcaatgcttccttagttcccttattaaagakaattttagtttaaaaatatatatatatatatttttaatgaaaaatgatactgtaatgaacatattttatggaatacttttgcaagtatatctgtagtgtgcattcttttttgtttgtttttgagacagagtctcattctgtcatccaggctggaatgcagtggagtgatcttggctcactgcaatctctgcctcctggcttcaagcgattctcctgcctcagcytccagagtggctgggattataggcatgcatcaccacacccagctaattttttgtatttttagtagatacagggttttgccatgttgaccagactggtctcaatctcccggcctcaagatatctgcctgccttggcctcccagagtgttgggattacaggcgtgagccactgcacctggtatatacacattccttttaaatttaggaagctagccctttgtctacaatatgcgttgtaaacaatattgccagtttaccaattgtctttgattttgttcattattattttttgttgcatagaaatttaaaaatctytacagctaaatttattaatattcttcatgcttctatgttttgtgtcattctttaaaaagtcttcttcattctaagattatgaataaatacacccagttttctttaggcattattatagtttctttttcagggtttaaacctttgatctttatgaaatttactttgatataaggagtgagatgagatttgtcttttttccccaagttgttactagttataccaaatcaacttattgaatatgcttttcttcactagtctgaaacttagcttttatataaaattctattgcatagttatatgtatttctgaactctgtacaattcaattagtgaaaacttttgatgtcccaaaccagtagtttaggagatttcagcattaaatcagagttactctggatccagatctgttagcagatataaacttcacggtcacaaaattcaggtgagcaaagatgtaactttatttccctacaacccaacttagtttagctcttgagcccctatgtccattttgtggtagaactcttaatacagccaattcaaggtatctctgtgtcccatgggtgatataagacctgggggttggggatgagataacttttttctcatccaggatttcataaagaggatgattctggttgatagccatctctgtcttctggcatctataagatataactcaatctgtctggtccttctaattgtgcactggcatatggttatgtcctggccacgggccttcatttgctagttccaggcacctgtgcccaacatccccatctcaggacctctctttgctttcctgaacccttttcaaggggggccctgggaactcttgtctgctttcctataccactggaggtgctgagtctcactgaagctgtgctcaggccaatctaacagaacatctctcagactttgccggttttcagctgtagcctaatgttgaatataggcttctccaagaggctttaggtatttctgggaagggaagcagaagtttactatgctctcagttccttcccaaaactactttaaatttcttctagaggcttcaccccagctccatggaggcccctttctcaggaattcatatcaattacttgttttcttgctctcttttcccaattatcttctttcctcacaactgtgagatttgcctctgttctagggaggcagcagcggctgtgctgagaggaaagaaatggcttttacattaccctgtgatctttccaactccagtgtttatagtataaacttcttgttcagacctttagaaattgagcagagcttttggaaccaaaacaatcgtttgtctctaaacattttagcttttaatatgataatttctggtatgaattttgagagcctattttggtagtcatggccaataatttgattctttcttcttgctgcatcaagaagagtaatgggcacacagaagccctgggggaaggatgccttggaggagcccgtgttatctcaaatgattatctgcaacactgagtgagtccttgatctggctcctagaccgctgtctccatccttgtgatcactcccttggtcttgggattcatttcaactagctgctggtgctcttagttcctttcctctgcccttgtttagtccctgctttttttttgttttttcacaaattatattgtatgtggtttattatttgttttaaaattgacagataacattgcattgtggaatagttaaatctagctaattaacaaatgcattacctcacatagtaatcattttttgtggcaagagcacataacatctactctctttacatttttcaagaatattgtcattaactatagtcaccacgctatacaatagacctcttgaagtttcttcctcctatctaactgtaattttgtatactttgactaatgtcttcccacattccgctttccccaaccacccaagctggtaactactttactactctctacttctatgagagcaacttttttagattccatatatgagtgagatcatgcagtatttgtctttctgtgcctggcttatttcacttactataatgtcctccaagttcatccatgttgtgcaaatggcaggatttcattctcttgtatggatgaatagcattccattgagtatatatacaccacattttctttatcccttcatttgtcatgggtacttagattgtttccayattttgcctattgtaaatagtgctgtgaaaaatgagagaatgcagatatctctttgacttaactgatgttttttcatttggttatgtaaacagatgacctactgattacaattcctttagatatatactcagtagtggaattgctggatcatatgattgttatatttttaatatttttgaggaaacctaaatattgttttccacaatggctgtactaatttacattctcaccaacagtgtataagggttcccttttctccacatcctcaccagcacttgctatttttttgtctttttgttaatggccattctaactgggtgaggtgatatctcgttgtggttttgatttacacttccctggtgattagatttatatttccctggtgattagtaatgcagagcattttttagcagcaccccagtgctgcgctagtctctggggcatgggcttcgggtgcaacccagcactgcatcagcctgccttagggctccccctagtgctgcaatggctatagcagtaaccagtgtgggaaccttgcctgtcaacgagccctgaatctttggacaggcttactgctgaaggaagtacttgaacaaagtcccttactgccttttgaaatggggttctgcctaagttccctcaccacaaatcctctcagagatcacagtcctagaatctaccctctttggctgggtcatcattttgattgcaaagctgtctactttccaaacttttgcctactctctcttctgggagcctcctgatatagttctctatatgtctcctgttgcaggttgttggatctttccagatcaccacaccacatcacccagccactctgcccaatgggagggcagacagtgttccagtgtaggaggaaggggtrtaaggtgcgggcagtttgtgaggagggcaccaacgagagctactgtgagaaagtctgcatggtcaaaaagtggattaccaagaacaaagcatcataatgttgtccagtggaccccaggttagcttaaaaggtctagtctttgattctttatggattattgttttgatgtatgtcttagtctgtttatgctgctataacaaaataccttaggctgggtaatttataaagaasagaagtatatttctcacagttatggaggttggaaagtccaagatcaagatgctgacaggttttgtgtctggtgaagatatttctgcttccaagatggcatattgaatcctgcttcctccagagggaacaaacactgtgttctcacatggcagaagaacagaagagagagaacccactctctcaagccctcatataagggccttaatcctatccatgagagctttccccttatgatttaatcaccttcaaaatgccccacctcatgacactattacattggcaattaaatttcaacatatgaattttaggagaaacgttcagaccatagcacaatattttggtagtcagtgactcacttttagggcattatccttttccttcccatttattctcctactccgaaatattcttcatgcctaactctgaatatttagtcattatagggattttacttaatatcaggaggtaactatggtcatggtttttttgtgccatgagaagcttgatctttttctctggccctgtgtaaatggctgaggatttaaaaagccattttctctgaccagtttatgcttgttctcctatttgccattcagtaagtaaatggcctttaacacagacgttttgattttcaaacaataattaggaaagaaagcacttcatatgggggctgaagattacagggaaattgcaccatcttcttccttagtacaacaatatgttgctaaaccagcaagaacaactagttgcaatttctccaaaccaacaatattttcttttcagaatcctacctaaaagtgagattcaccaagaaagttttgtgtttttgagcaagtctaggttttaattttttttgactcatctgcttctttaattgaaaacaagacaaaacaaacatggagtagaagctttaatcaagtgtgttctaacacgcaaacactatggaacccacctgagtcccacttggatcatttcaaatggctccatatttttctgttcccaattaaacttcctagaaygtctcacaggaagctcacattgataaactttttgagtaatccaggaactcttagaacctgataaagtgaaaggatttggcaggaacgtttcagatatgaggaagatttctctgcagggtatgtttgtctattaattggatagtatacctgtcctaactatgaagaaattggctccgacttggagaatgactgaaaagtggctattactcattgatgattttggtgggaggaaagtaatagcttgtggactgttagttttgtcatcataacaaactagataccctgaaaaacctctcaatacaaaacacctagaaatgatgarttaaatataatacatagtctttaaaatattgagctcaaaggaaacagaagaaactctcatacaccagaagtggtgagatgatgcttatactagtccccaatcctgtttgagggtatttggtgatcttggcgatcaagaggtttgggtttctgacatgctagtacaataggcaaggccttggcctatgcaaggtrgggaggcagaatcaaggctctgcatratggctagggccctcaaaaggctatgctgccagaaaaaagatgctcaggcaaagggaaatgtcaagcaaagttgtctgtttcccctggcctctgggtagaaaagaattcagattctgcccatacacagctttgaggtttaatttatacaatctgagtggtcagaaactccaagtcaagatattaacatgaaattgttccagtttgatagcacgtccgccatctggcagaacaattaaaaaaaaaaaaaatcctttcctggcagccatgcggactcaccaagggctcctggccatgccctctcccaagattctccataaaattagttggttgcttcttgccctgaggcagcccagtgaagtctagggtgtggtgatcccatgttgttgatggggaaaaagggagtgatggggtgcttgagggcttcttaagccatagttcaagcatagygagtgccccctcttcttctgaaagggccagatacctggcctcatcctctccacaaagaactctcttgggatcctcaggggatccaggttagggcagagccctagggctcagagargggggtcagtaattaacctgggccctagcactgtaaaagtgacagtttgatctccccactgtccttcttcccctgcccaccagggacaaggcttccagaaagaggggaccactgggaaattctgcctcttgttcagataaagttcttcccgctgcaaggctycgagcttcattcttcatcctcagatctagaatgggatggagggcagttaatttacaaaaaaaattatataaaataattgtatgtaatatatattatcaaaatagctctcacagcataaatcttatagataaacctcaccaacatgaacttacaaaccaaaattatgaacacatgaaaaaataagctactaagagwaagaaattaaaactaataaggagcaaatgtggctgggcgcagtagctgatgtctgtaatcctagcactttgggaggctgaggtgggtgggtcacttgaggtcaggagttcaagacaagcctggccaacatggtgaaaccccatctctactaaaaatgcaaaaattagtcagacgtggtgatacatgcctgtagccccagctacttgggaggccgaggcaagagaatcacttgaacttaggagatgtaagttgcagtgagccaagaacatgccattgcacccagcctgggcgacagagtgatattccatctcaaaaaaaaaaaaaaaaaaaaaagcgcaaygtgattagtgctccccaaaagttcagaaaatgaacatattaaatgtaagatattttaagtaattaaaacggtaaaatatggattaaacaataagagaaaggaataagatactattaaaagtacctgaaatattaaaaaaaggaaccaagtaaaaattctagaaatgaaaatataaccattgaaatgaaaactcagtgtatgggacaaacagcaggacacagttggagaaggaatgagtgaattgggtaacaaatctaaggagattctgtagaatgtagtacaaagagatgaaaaggtgaaaatatgaaagataggataaaacatatggaaggtaagacgtgtagaaggtatttcattcaattcctaggtattttacccaaaagaactgaaaatatgtcacaaaggaatttgtacaataatgtttatagtcaccttactagcaatagccaaataccagaaataattaaaatgtctatctgctggagaatggataaagagattttggtatattcatacaatggaattgtactcagcagtaaaaaagaataaattactaatatacataaccacatggatgaatctcaaaaacattaagttaagagaaagaagccaaacacaaaaaattacatactatataattccatttatgtattttttttatttttttaattttgagatggagttttactttggccaggctggtctcaaactcctgacctcaggtgatccacctgcctcggcctcccaaagtgctgggattacaggcatgagccaccgtgcccagcctcatttatgtaaccttacagaatatgccagtctaatctatgttgattgcctctgtggaggggcatgaggaactttctgagatgagtgtaatattctatattttgttttgggtattgatatctttggcttttacaattgtcaaaactcatgaactgaacatatgtaatatgaaattatattgtatgtaaactatacccttcaaaaaaattacaaagtaaaaagtaaaacaaagaatagaaacttgtctggtgcagtggctcacacctgtaatcccagcactttgggagactaaggtgggtggatcgtttgagcctaggagtttgagaccagcctgggcaacatggagaaaccccatctctactaaaaatacaaaaattagtcatgtgtgcacgtgtgcctatggttccagccactcaggggctgagggaggaggatcacctgagccttgggaggtcgaggctgcaggctgcagttagtcgtgattgcgccactgcactccagcctgggggacagagtgtgatcctgtctccaaaaaaaaaaaaaaaaaaaaaagaagagaaaccaactaagggagacatgcctggaaaatgtaaagagccccttaaaaattgatgtgaaaaaagaaacaacttaaaagaagaatgtgcaaaaaaaatataaagaggaatttcaaaggagagaaaatttgtagagtcaataaatacatggaaaggggaaagtagcagtaatcagaggaatacagattaaaacaatgccactttggcacctatcagatataaaaaaaattaagtctgaaccaagttcaaaatgctgacaacaatgtaaacaatgggcatttcgatacactgcaagtgagagtttaaattgatagaatcattttagagaataacttggtaaatacttggtaaaggtaaattatgatctagcaattctactctcgtgtataccctaagtcagcagttctgagactctttggtcccaggagccttttaaactttaaaacatttttgaggataccaaagagcttttggttatgtgagttgtttctattgatatttaccatattagaaaataaaattgagaaattaaaaatacattcattaagtcatttaaaaggcagtaagaaactgattacatattaacatgagtgatgtatttttataaactcattatattttccaaaacaaaaattttagtgagaagagtggcattatgttacatttctgtaactgtgcttggcttaatacaagacagctggattctgtttctacattcagtctattgtggtatactgttttgattgaagtccataaagaaaataaagatacacacaaatattgatttggaaaagagaggagaattttaatggccttttcagatagttgtggcaattcttctttgatactctacccaaaactaacaagtggtagtttcttaaatgttaatttgaamccatatcaatgaatttttcatactctgttaaattaaaatgcatagtttatattataccgtgagtggattttttacccatgcataattttgtaacattttgcattggtcatttggaaattattggtttactgaattacatagattttcaaaatgttgatacattatacaatgtcaaaaatcaccacccttatcattagagaaatcatgaaatattgagaagctgtaagatataaaaatccagggttggattcaagttttcaaaatttctaatttttttgaaagctcaaattttatcatcaacaacaatacagtcagctttctttggagtagcaggctcacatcattcacttttgagaaaatgtctgccaaaccccaagagtttaataatcatagtctcaatcatcctcctaaaaataatgtttagtgaaaaaagtagtagttaatctcacaactcaatcacacaaatgctttttcttgagatgaccattgcactttggcatgtaacagagtactttgtgctgacttcttattttaatatamaaaatattaaatagatgactatgtaacagttgaaatttagtaaaattaatattcttcagtgattttttttaaaaccacaagtgcatggtggtgaagaatacamtgattactagtattgctggatgctgctgccttgattcctgctaaggtgccagcagcatcagtgcaaatgttaacacggtgaaaaagataaatggtattattttcttcttctcatgaaaatggttttgacctcatgatttgcttgaaagagtcttgggcccatgaggggtctgtggaccatactttgagaattgytgaccaaataaccatttgactttgcacacaaagaaccagtatttccatagcaacatttttttttttttgccattgcaaagattagaaataatcatcccctagaaagtggataaaaaattgaatgatatttgaacctgaatccgaatacctaaaaacaatggaatgatacaaaggaattatatacagcactgaaaatcagttagacctagatgcaaacatgagatgtgaaaacagaacgattcatgctgtatgacactacgtgaagtttaaatatatgcaaaacatactatgtatttttaaagcataaaaatgggtggtaagtgtgtatagaaatatattagaataataattaacaaattcaggatggtagttacctgtgtgagatagggaaggaattacatttgtggaggagatacatagagggcttcagatgcacatgtactgctttatttcataggctgaggggtggttgtaaggggtttattatgttattttctatagctctttctattctgaagaattttgtaataaacagcagcctgtctataatcatattctttcaaatacttgcttgtgaatttaagcagtcatatagataaactattagtattgaaactttggcatgtagatataaagtcagtgaataacttcacagtaatgatgtaattctccttaataacacacacacacacacacacacacacacacacacacacacaaattctgctmtaaaggtctcttcattttcrttacgtgcaatgcctactaaaactcactgtttaaatgaaatgatgctcccaaggcatccattctcaattacagaaagcatctctcaatacccctctcaaggttgtaggtctgagattattgtgttstgcctccacagtgttccagatcatcaatttagcctctggatattttcagctttctctgccgacagagctctgtgtgcatytgctattttatttatttattatttttgagacaaagtctcactctgttgcccaggctggagtgatcaagtggcatgatctcggctcactgcaacctctacctcctgggttcaagcaattcttctgcctcagcctcccgagtagctgggattacaggtgcccacgaccacacccggctaatttttgtattttagtagagaaggggttttgccatgttggccagggtggtctcaaactcctgacctcaggtgatccacccgccttggcctcccaaagttctgggattataggcatgagccatggcgactggccatgctatttagtttcatcttcaggaggctctttgccctcttaaactttgtatctgaagtggccttactttgctctgctcctgtcactagaacccagaaacctctgaacttccacgtatttcccccgagcctgtcctttctagtggtttgaaatttaaaacaaactggctggacttcagcttagttaatggtggcagagaacaaaatagacataattttcataatgactttttcattttgggggacatcacatttttcacagcagcttttggttaaacaacagaggcaaaaccttcactacctccctaacttcctgtttttctgaaactgatatcctgcatttggaaatatataaataaataatagagaatcctgattccacttggataagccttgtttgaaagttgaacagtctgtccattcctccacattaaaatatattcctgactccattgtgacttactgcacgctgtctgtttgggccacatggttctgagcacccaccccagtcacttttatttttttctatgtactagcattgtactagtggttttcctgaggaatgttattttgaaacattgtaacaatcagtttgtttataacaatcagtctgttaacccatgtttttttttttagttccttgttattagtttagtcttctgcagtgccctttggcccatcccctggcctttctaccccttcaaattaggcagaaggcatccattgcctcagaaaaaggatgttgaaaagaaatcagaagtaacagtaaactgtaagtttcaaaaatctattctgaaacttacctgttaatactttgagaaaagtaagattaagtctcaaaggtcaggattaaaattttttgacttttatttttagagacagggttctgttctgtcacccaggctatggtgcagtggtacagtcattgcttactgcaacctcaaattcctgggctaaagtgatcttcccgcctcagcctcctgagtagctggaactataggcaagtgccattgtgtctggctaatggaagtcaaaatttcgaggttaaaaaattcataactctggctgggcatggtggcttacatttgtaatcccagcactttgggaggccaaggtgggagggttgcttgaggccagaagtttgaggctgcagttagttagaattgtgccacttcactccagcctgggcaacagagtaagaccccgtctctctaaaaataaaacgaaataaaataaaaaaataaaaaaattcataactctgaagaactagattatgaatcttgtggcataaataatacatttggaagaatacttgttgagaagagaaactagaaaaaacctgaataaatggagaatattctgagtttgactgrgtttatcctgaatcaatgaacaytgctttttttgctctcaagtgaaatgggatccagcactcaagcaataaattaattaaaacataaggaaataaagaaaattatattatttgtatgtttgaatttgtaactagggtttgcacccttacatatccttctgaaacatgctgttgcacttatggagagatattgaagctgttgttactatattacagtgttctctttgtaaggccgataggaaaaaaattcttgggtctcattgttgagagagcttttcttcctctgggcaactggtttatttttagcctggggaaactctgactcatgaatctgattgaatgcctcccttaactggctgcatgaaagcatggtgtcaactctgaacgctgtcttttgctgggatcgagtttcatctacttaccttatcccagtgactattcttcttcccactttgttttccttttgcctttatgtctttacttactctcaatctgtttggacttcctgggaagcagactctgaggcagtgtttaaggcgcaggatgcctattaaggagcaccttggggaccaacacctgcagaagggagtggagaggaatcagtaaggggcaggtggagaaactgagcttcagtgtcgccccagtgatagtctcaactgaccatgtggagagctctgcaggtagaatggtccctcagagttgtctcaacttgggcctgaatgtccaggtctttacactctcccattaactgttcactagatgtcaggtgccccaggcatgaccttggccaggaggcagtccttgaggggaatggcagctgaaggctgtctgccaacagcagtcccagcagctggggcaccaggtccttcagtgagggatgttggtgatgcatcagtgcccaccatacttactttaaaaaatctagtatatatttctacaagaatttggaacaaaaacaccrataaaataagtaattaaagttaagtgactcttgttctcatccttgcccatttatgttgtctcatcttaagtgtgatcctgagtcttggcatatgtcatttctcttttttgactgtgagagtgtgaaaggcgaggtctaaaatataagaaaattatattcttccttcaacatscagcatatcatcaactcttcagtggaggtttagttgactccccaggcagagccagcagcyccctcctctgtctccatcatgcccccacatcacagtgttgtgatctccacacatctgtttctttcatgggcaagatgtccctcaaacctgatcccttttgaatgctccttttatcatgaatggagctaccgccaacccacrggtgccgggattctggagacaattcccgtcaatcaccaagtcctgcaatttgcatttctaaagtctctctctaaccctctatttctctccatttccagtgctgctactttctttcaagctttcgttatacctctcacctggactattgtaatagccttctatttttctctcagtttctattattgctttctcagcaaaccattctctacacagcaggtagaaccatcttacggaattgcagatctaatcataccatccctgttttaaacccaacagtagctctcccacagccttcatgacttgcccrcctcccagcctcaccactctcatccaccacactagcctgttttggttcctctaatgtgctacatgccttttctctccaaggtcttctcacattcagttcttcctggtctgcttttcttctacctctccctttgactagtaatttcctgttcatctttcagatctcaggcatatgtctctttgtccaggaagctgtccctaacttcctaattagatcagacctctcctttcacaatctcatatcagttgtgcttctttgtaggataggtcgcatggcaatttcataattaagataatactttaacatttttctcttctactaggataygtatcccrcaaagtttgagacatcttggtcacctcagcatttctaatgcccagcacaggtcctgcacataggagatgttttatgtatggatttacttattaaataaaatatacttattgtgttggtccatttgggctgcaataacaaactgtcttagattgggtaacttataaacaacagaaatttatttctcacagttctggaggccgagaagtccaacatcagggtgctggtagatttgctgtctggtgagggcttgttcctcagagctggcgccttctagctgtgtcttcacgttgggaaggacaaacaagctccttttggcctcttttataagggcactaatcccattcatgagggcagaaccctcattatctaatcacctcctagaggccccacttcttaataccaccacattggtattgacatatactactacctaatggttttaacatataaatttgggaaggggggtcacaaacattcagatcataacatttatttactgagtttgttaaaggcatggacaatttatttatcatttttgagtccccatgccctagtatatgttggatgctcagtaaatggtctctcctttccttccttccttccttctctctctttctttcttctttctttctttctctttctttctcttctttctttctttctttcctttcttctttccttctttcttttctttctctttctttcctttcctttctttctttccttctctctttctttctctctctttttctcctttcttcccttccctccgtccctccctccctccctccctcccttccttccttccttctttccttccttctttctcttgctatgttgcccaggctggagtgcagtggttattcacaggcacaatcatactgcactatatccttgaactactgggctgaagtgatcttcctacctcagcctcctgagtagctaggactacaggcatgtgccaccatgcctggctaataagtatttgttgaatgaatgtttgaatcaaactatgtaaaaggttgtcttggggaagagggagcagacattatgtctggctgcaggagggagaacctggactaaaggttagaaatgatggaacggcagaatttttcagaaaataattatatggtatgaataacctaatgggaattatatttgaacatttctatattgttgggttctgaatgatcagacgattatgaataatttttataattttagtagtttttggtattttctgcaataaacgttttcataaacagaaaaaatttattttaaaaagatgtgaactgatgataaattaatgagytctctatccctagaagggtttgcgcggttgggaatgccacctgccartgatgacaagaaagggacttctccatggggtggagaggtttggcctggcaagtgttaagattcttccaactccaatagcctgtgatactgttaactgaatgataaatgccaaatctccttgcttagaagaacttggcctagtttatttggctgcctcacattctgctagtggcttcgttacattggaaccttactgtgacactattggctacagtggaatttgatttgtatttacctgaggatggtacaactgcaggatttctggagatgacagtattatagtgataacaaaaacatgaatatataggtaagagttgtttatgtggaaaattacatgatatccctccatgaagagtttgggggagtcgtgatgaaaatgttctcaaatcaacacatacccttagtattatggttaattttccaaaacaggcattgccaaactgtggttttggctaaattttaaaaatggaccttctgatttttgtgtttatgagctagtttggcaaacagaatcattgtttctctctcttaagagaaatgacatttagactatttcctcatatagcaatagctctgaattaagagggaacagaacactcccaaaggaaatctggtgtatagaagtggatctccgttaagaatagtggaacacacataagagtttcttctgattacatgaagtgccagcrgagagagagagagaggagagggggagagggagagagagagagagagagagagagagagagagagagagagagagagagagaggacagatataaatagaatataagataatgaagtaataggattgatttctacaaagcacatgtgaaaacaatagttctgttgtcataatacctgtgtgatagtaaatgtgtgtttatatatatgtgtgtgtgtgtcttatagatattctacttaatgttagtgaaatggtagttaaaaataaaacaaggcaaagaataattctagaataattcaaaaatggaaaaattagaatttacttttattagcacccactcccccttaatttccagtgtggtctcatggagcactgttattcctaggcatgcattagcctaccatgtgtttgaatactttacatttttacattatttgaaaattttataactcttctagattctcagtaccaaaatgaattctaatccttttattgcttgaaagacagaaaaaatgcatttttaaatttgatgtaagattttcaaagatttgtccataaagtcataaataagctatgtaaacacaatgcatctgattatcattttatagaaagttcaaagatttccatcccccctgctctcagaaagtttttctttgaagcagacaaattcaatagtactggggtgcaggggcaaggggcatgagaagaatgttcttgtggaatgtcctctgccaaggctggggttctcatggcgggacccgggagctaaggttatcatcagagctggttgcctgttgtgcttagcacgtggctatagggccttgcataaccagggactagaaggacatttatgaggaggtgtacctgtttcatcaaagaacatttaacagaaccccccgcccccccgccgccacttcgcctaggcaagtacctgtaaaaatcaagccataagggtggtcttgctcttctgaagttcgtgcaaccctctgcccattccactcactctgctctgtgcctttctctgctcttccctgcttctccaacttccgacttgactctaggccttgcctttctactcctgtctttggtatggttgactttgaaggtstcatctgaaaatgctcctcctacttgatctggaattcctcctcagacaccattctaagttcacctctagggtccccaatctgtgatagtgggtaaaagacatatcatatttttatggttttgggttttatatttaaatctttaatccatctttggttaattgttgtatatggggtaaggaaggggtccagtttcaattttctgcatgtggctagccagttatcccagcacaatttattgaatagggaatcctttgtccattgcttgtttttgtcaggttagttgaagatcagatagttgtaggcgtgcggtcttatttctgggttctctatttggctctgttggtctatgtgtctgtttttgtacaactatcatactgttttggttactgtatccctgtagtatagtttgaagtcaggtagcatgatgctgccagctttgttctttttgcttaggattgccttggctatttaaaatcttttttggttacatatgaattttaaaatagttttctttagttgcgagaatgtcagcagcagtttaataggaatagcattgaatctacaaattgctttgggcagtatggccattttcatgatattgatttttcctatccatgagcatggaatgtttttccatttgtttgtgtcatttctggtttctttgaacagtggtttgtagctctccttgtagagatcttttatctccctagctagctgtattcctaggtattttattctttttgtggcaattgtgaatgggagtttgttcctgatttggctcttggcttgactgttgaatgctagtaatttttgcacattgattttgtatcctgatactttgctgaaggtgtttgtcagcttaagaatctattgggatgagactatggggttttctaggcactatcatttaggacataggcacaggcaaagatttcatgatgaagatgctaaaagcaattgcaacaaaatcaaaaattgacaaatgggatctaattatactaaagagcttctgcatgggaaaagaaactaacaacagagtaaacagacaacctactgaatgggagaaaatttttgcaaactacgcacccaacaaaggtctaatatccagcatctataaggaacttaaacaaatttacaagcaaaaaacaaacaacctcataaaaaagtgggtaaaggacataaacagacacttctcaaaagaagacatacatgtggccaacactcatgaaataaagctcagtatcattgatcattagagaaatgcaattcaaaaccacwatgagataccatctcacgccagtcagagtggctattattaaaaagtcaaaaaacaacagatgctggtgaggttgtggagaaaaaggcacacttttacactgttgatgggaatgtaaattagttcaaccattgtggaagacagtgcaatgactcctcaaagacttagaggcagaaataccatttgacccagcaatcccattactgggtatatacccagaggaatataaatcattctattacaaagatgcatgcacatgtatgttcattgcagcactattcacaatagcaaagtcatggaatcaatctaaatgcccatcatttgggcaatgatagactggataaagaaaatgtggttcatggaatatcatgcagccacaaaaaggaacaagatcatgtgctttgcaggaacagaaaaccaaatactgcatgttctcttttataagtgggagctaaatgataagaagacatggacacatagaggggaacaacacacactggggcctttcggggagttgagggtggaaggaaggagaggatcaggaaaaataaccagtgggtactaggcttaatacctggatgatgaaataatctatactacaaatccccgatgacacaagtttacctatgtaatgaacctgtacttgtacccctgaacttaaaatgaaagtgaaaaaataaaaagacacaccgtgtgcacccctgcctccatctctgctatcttggcccattctttacccagcttccctttcaggaaaggaaacttggacaaaggagagcacaggcagggggatatagagaccataaacatggcttgtatgtggacatcagccatccttagtcctgtcaaaagagagggtaagcaactataggcaaagctgacctcacacctttgaggatgggcrcactgggggcattttaatcattatgttttaaaatttgttacatttgcaatatgctctactgttcacaaaaatgttaacatacagttttgattactgtgaaacaaacctgtgtggaactcttaatacttccttctgstaactgctttacattttcttcccccacatttaaatatctctgaaattagtacatgttttacaatcactatgcartgggaatggctgtgatggggtttctgttgttgcctattgatgtgcaaatrctatcttagctctttgtgttgtcacatccattcagatatgtggatagttgacagcacacgggctaattgctgtttactatgtcttaaacaggttacaatttggtttgactttgaaacaaaaagttatcatgtacacagaaaagcacagaagcagaggagtggaatgaagtgtgatattagtgaacgaaagagccaacattgaagtgaccacagttccatatggtcttgcaaagcaaccactgaatgttttgcctaaaaaggaagacatcaacatgtaattatcattaagacatggtatcatagttacttaatggtacataaaaactggagtgtctttttcaagcacctattatgttaaaggttctctgctggttaaggttataggttttgtgcttttgcacgacatgtgtgtctcacatcaattccactctgtggataatattatccccaaaccagggatgaaggatgaataactgtctcaggttggtaatctagttttgatagagtgagggattgactcttcacgtgcccagagcctgtgcccctttccctaccttggtagacgtcttctggattttccaacccctttgtctttcaggagcatctttgggaaggatttgttccaarggatctatactctggtgctattctgaaacaagatgacagtttgtttttttcttggtttctcttctaaaaatttagattttgggaactggaaatccttattagggcatttaaaccatggtatttatttgtctgcaatgcactttgaattcagctcacattctctcaccttatctcacaattgtttcctaaagtgggtaatgcttccttaaacatgtaatccttatttatgtctgagaataagtcatcaccacaaacaggtctgtgggtacctatggaaagtaggtgagttggagatgacccagtaaatgccccttgacatcaccngctraggattttctagaaagctcagtattagaaaagtattgaacatttgtttttaccaaactccaggttctcaagaagtagctagataagcttctcatacataaacatttatatttccaatgctatctgggagggaaaaagaataaaaattaaattaaaatgaaagccacttcaatttcggtccatgattataattttattcataccaacatttttaaaggtttaagcatgtttaggaaagtggtttcttcttagatcgggaagaaatggcagcccttttgggaaaggccggtctgtggtaaactcaccagcaaccagggtggaagtgccagaaatattcgcgggaagctgatgattctgagattcctagtgtgattctgaacccaggagaatttacttgcattggaattattgcatcatggaatgaaaccaraaagttcattatttacacttcacasatttactttttttaagatctggctcaaaggcactgagaattatgttgtagattagaggcatccagttaattaaatcacaaggactttgtagcaagtagtaaaaataattctttccccacaaattgagctgagggggccattctcttctttctgaggccaaacattcagcataaccactgttttaccacgagctctctgctgtgaaaggtttaagcacactgttggcattcaaatttttaatagctaatgcaaggtcacctaatactttgtcagtgtttgtctgttaccaattgttcctaattgactaaaacagctagagttattcactgactcttaagtatggggcggtaagttttaaaagaatatttagagaatcatttacaactatactcattctcatccttttcgtgcccaacttcacaggagttgtctgtctgcaaggttagtcccctatctgttccctgaatgtatacatcaaaattaaatttaccatctgcttatctctcaaaatgctgcttctgaattttctatttcagtgaatatcatcattatcatcatctaccaagtttcccaagcaagcacctagggatcagcagaaactctttcctttccattcccatactccaactccatccaatccgccagtgttctgtccatttaactaaatcagtatttttcctgcctgttcatttatctctatttcctttggtactacatcagtccaggtcctcactaccttagaagaacctcccaaatggtctccctgctacaatttttgatattcttataatccattctctataccactattaagattacctttctaaatgcaaatctgcttaaaaccttttaatggtgcttcatcatcttatttgtgatttttttttcttttttatctttattgctgccacacaaattaatgcctcatcatgttaaggaaaaagtttagacccttggcatggaaccaagtcctaaatcctgtggtcctgcaggccttttcagcatgactctgaaccattttccatacaccccttatgtttcaaccctagggaaaagcttacgttttgcaaatggaccatgttccttctccctcttttgcatttgtagcgtggttcaccctactgaccatttgctccttgtttgtccacagcaatcctactagttctttaagactagctcattttctatcacctctgggaagcagtgagggagtccactctgagtttaaagtcacttacaatggtgtcttctcttgtgtttccacaggaccctgtgcataccttcatcaaggcacttgctgcgtagcacttatatttctgttgtacgtatatgtctcttccactaaactttaaacttcttgaagagaaaaactgtgtcttttatctttgtatctccaggccaagcatggcaactgttgcttagcacctgctcagttaattgctgcagaataaaggagttttaatcccttcctatcacttctggaaactttactcaagcaaagtcatttttttcctctttctttctgtatttttaactccttcatctttcccttaattcttactcatcttaaaaagagcaagaaaacacttgctccatcttagccccttcatcgtagccccattttgttgaaagaatagtccaattattgctttaaastccwaacctcccattgacacttcagcctactaaaatttgatgtttactccctcactcaaatggaattgttcttcccaatgacaccaattgcttcctgattgtggaagtcaggctttatcttaagtgattactcttcaggatttcaaattgttgccctgtttttcctgaaaaatccttattaatttggcttttgtgacattgtttctcctggtctacataatctctcaacactaatcagatacaccagctgcctttacttaaatgctggtgtctcaaggaacccttattaattcttttgtcttcttattctctctgggtaatttcatctaattttgcayctttggtgactacctatatatccagtgatcctgaattttgacctccagaactctatttccaatgtgtaataaattctgtgactcacaataccctcaaactttacttgttaaaatggaattgtttcctttcgcaaacatggccccttttatatttcctatcctagtaagttagcaggagggtcaaggtgttgaccattcataatctttctccaggtttctatactagactacataatcaataaatttcaaggaaaaagttatcccttgtatgtagcccaacttagcttttgtattagttaacactgcataacaaatcaccacaatttagatttaaaacagcatacatttattatctgaaagtttctgtgggtcaggagtccaaacgtgatttagctgggtcctctgctcagagtttcacaaagctgcaagcaaggcgttggctggggctgggcttttatctgaggttcagatgcttcttccaagatcacatggttgttcacaaaacttatttccttgcagccgtagagctcatggcagcttgcttatttaaggctaataggagagagagtctctgactggttcactctcttttaaaggactagtctgattaggtcaggcccacccaggggatctctttgattaactcaaagtcagctgattagaaaccttatgtatatctgcaacttctcttcacttttgttatataacataacataatatgggagagatgatcccatcacttttgccatattctgttggttagaagcaggttacatgtcccacccacactcaatgggggagaggattataccaaggcatggattattgagaatcactctagaattctgtctatcatagtgtaattatatatctatgtagtgaaaaaaatagatgtttgtaatttggaggtattaaaaagttgaatacaaagaaaaaattatagaactttaaagtcttaattttaayggagatggcacattattttgaagatagagaaaatggctttctatccttttcctatattacacttagtgccttgggcaggatatatgtccaagtatctaaactgtagattatattatatgaacttaaatggaataattaaataagtaattctgaaagacaagtatttaatgacataactggcttgatttgggaaccattttaccatgtgttagcctcagttgtagtaagagaggatcatgtaattatatgtctataagtaagttatatggtttttctcagtgtacattagttcaacgtttctaaaggtttttttttttaaagttttcttttaatacctttgacagactgtgattttcatcagaagtgctaatctttcctcaggatggagagttcaggcatcttttcatgttgttttctcacagttttaaatgacatatctacagaagttcttttatcagtgacttttcccttcctggccccacactatctgagggcatactctstagctccttttattttattttatttttgtgggcatcagatatattctgaagtcaatactaaagctgttagagtatgacatttactaagaatcctgccattttaggcccttcttcttaaaggacaacaattccattggtatttagtaaaaaacaacatggcttggtaaatttagctctttttcttgacattggcaatgataatacaatgcctgtggtgtataattgtcatggctgacttataaatccctacagatatgtggttacttctctactttccctttctttggcttgggcaactgccacgttgatgcactggagccattcttctgcattcttctcatccttggccttaaagacataggttttattgtctgtgaagatttcgaaagcccgggggagagagcggtccctgcgtttcttggccacagccttcacactctgtactttgctgagttctattgggcagtcgtcagggtcatctttctgaaaggcatgggaagaaaagaacatgggctggctgttactgtaggcaaggatctctggctactggagaactttctaagagggccagaatcctttcactttttatgtctcaagacctttgttattttgggtgctaaggcctcagaatcattagaataactgaaggagtgagcaattgggcctttgttagagtatcataagttgacacaagataattaatttaaaggatattattataaagtgggatttgggaaaaattcagagttctttcattttctattaacgttatattaatagagcaaggtgcaacggtacaatttggagtgctattaacttataacttcaggtagtttgggaggcatgaaattgaattttcctttgtgctacctctgagaaagattttgccaaaccttaattgaatagagaggcttccagtgtttgcatagaccaaactgtttttgaaactctctgcagctttggaagcatgctttgtctacaaacagtaagagaagaaatatttaatgatgttacatttgccttttattaaagcaaaaatttaaggacctctacaataccaaagtcatcacactgggctaagaygaataattttaaggggccagatatttctttgaagtaatttcaggtctttcacatgaatacattttgtctactagagaaagtacctgtggttgagaatcttgccaattctccttgcccacctctcctgttgcaatcaccctcctttcactttgcaatgaaaaagcatcctcttcactcatcccatactttctatgatgttttgtccaatgtaaacaaatctcagaagcaccaaacaaaaaagcaattccaactattgacrtcagggaagtatccatcagccaaggcaatgtaatcactcctcatctatttcattatgagatacattttcaataatatttcaatttttaatgtttaataattattaagcttggcattatacttatggattttcatgaaggatataactttttaaaaagataactaaatcagaaaaaataacacttggaracggatggtcacaaggaatttaaacaattaaatttcaatttatacatatagttttactcagtgaaaaatgaaatgccattcaggataaaatgctgtgatagaggtagaacagaaacatgatttaaaaaaaaaaagagaaacaatgtgaacacttctatttaaaaaagagttaatttatgtattaaaaatagtgttaggtgttaaactgctatggtattttaatccaatggttacatttaatggagagatgtaatccttttgttttaaaatgtcaatatttacaattcaacagaaattacagtccgggcaaatgtttaaacttatgataaaagtgttgctgcaacttaaaatgctgcaaggtattacatagatttttcaaaattcttttagggtacacaggataaagtttgaagacatacacactagacaatactttgttagcctaatttggtttacagtaagtatctgacagtaataaaattgcatttctttgaagtagtctatagtacagagattgatacgaaaataaaaagttaccatagtaatttaaagatggacagtgaatcaactgagacaggaatagatagaaagtcaaaggacactattgcctagctrgttkgtggagatcaaggtcttaaaaatgcaaaagtgaaagattagagtcttccactagagtctttcaacctcagctctaattttaaaatgcacatttctttcatttaaaaggggcccttttacaaggacctgaagcttcagcaggattgttgaccactggtaggttattgtttccctggagattagaggtattttgctgtggccttcatgctatattaaattatttcccactatttgagccgcaagttttgtcagagttatggaatgtcagaccattatttcctgataaacatgtcaaacaagttacctaattataaaattgctttttctttaaaccttattaaaaaagccatgaatcagaaagtataaaggtcattatttgagttcagaaaaacattctcatagattaactctgctttgtcttaagggatctggaaaattactaygtcttcatttctattcttgatttcttgaataaaaacagaaaattcaggtagtcattttaaacactttaaacatgctttagtgtgaacctatgctaaaaaaatttctttaagtttccaatagctgtctaaattgaactgccctttcaaaaagatgttcagctacagaaaagtccatctgtatatgttataacacacacagatgaagaaagtagcatgastacacagtaggtatcacaaaaaatattctttttcattcaaaaagttaacagaagtcttattaattaaaagagcactggtcagaatacacgatacttgattcatactgattaaaatgttcaaatacattttataatgagtactctaaagatatagtgcatatggccgagaatgaattataatttttaactaatttaccacttttcattaattaattcagacagtttggtttatgtgatggttaatttatgtgtcaacttgactgggctaatgggtacccagacagctgggaaagcattatttccgcatgtgtctgtgaggtgtttctggaagaggctggcatttgaattagtggactgagtgaagaagatccatgctccccattgtgggtgggcatcatgcaatctattggggacctggatagaataacaagttggaggaaagataaatttgctttttcttcttgcactgagacatgcattctctcctgcctgtggatatcagagctcctggttttggggccttcagactctgggacttacatccctccccccagctcacygccatacccaggttctcaggcctttggccttggactgggagttatatcattgactcccttaattttctggccttaggacacagactgaattacaccaccagttttcctggttctccagcttgcacacagcatatcatggaacttcacaccctccataatttcatgagccaattcccatagtaaatctcgtatatgtctttatatatcctattggttccatttctatggagatccctggtgagtacagtttaccactgactctgtattttaagtatacatgggaagcagtaaactcatttaagaacatgctttggtgtaacactgcctgatcttgaccccagttataccctttctcaccttattagctttatccttggacaatccaatcagtttctttgactcagtttcctcatctgtgaaatggcaataatagcagtggtggcctaataggattgttttgaggattgtttgaggcaatccaaggtgttgcatagtaggcactgaaaaaatgctagtcattatgattattttctaaaatagccaagaagtaggtcaagatttgattcctcttgatcctgaatcaggagagtttaatgatacataaaaccaatttgaaaagaagagaaggtaactttgcattattgattgcaatggaatgctacttcagaggtttcccactgaaaattcacaatacaaataattactgaacatcctattcaaatggaaaattatattaaatatttattaatttgatcataattctattatattcattaactgaatattaaatagatgaaagacagtaatattttaatcagaattaaactttgttgactataaaaagtacctaaagtaaatcagccttcattctttcctccttgtctatgtcctccttttttggacccccatttccaaatataaactatagctataaaaaaatcagagccaatatcataagtcataaatttgtgtacgtggtccacaaggaaacaaagggcacggtgtctgagtcaagacttgcagtccctctgcagttcaactaaaaagtcaactaaaacaagcttccataataaactggaaggggacagtgaatcaactaacataggaataaacagactagacacagaaatgtgtgataaaacaatkctgtaagatggtgaaatggagatggaaaaattattagagtttaaacccaagacaaaacgtttagctattggtggagatcaaraccttaaaaatgcaagtgtaaaagatgatggaggaacttacagactttcctttttgaaacagaagttgatttccagccagtgtaaaatagcgtgttttccaccttttgatgaacttccatctgacttgcttctctttaagytttccttctatgagaggctggccatcttgatttacaactgttgaaggtagmagaataatcatgccatgtattttccaatatttactaggtaggtgatcaaaagtcagaactgtacagtgtaccagaacccagttagcacacctggaaagtaggctaataaatgatgaatttggttaacctttcctcctttgtccctaaaagaatgcacaattcagatatgacaatggaaaactgttgaaagccctcattgccattttcaaaagaaattggttcacacaaagagcatctgttagcagtatttaaagtttatctggatatttagctttcygtgcttggtttctttgtttcatagtgttctgtttctaatgttggaataaccaaattaatttggaacagtttgaaatgttggcacaaagtatctagtatgccataagcttcattttgattttgccagtaactaggtaataaaaaacaaatttccatgctttatgacacatgaactgctggaaatatagctttataaataatcataaacccaagtatatttagctatttggcagcaaaagtcaatgcagcactccaaaagacatggttcctaaagcggtaacaccaagcagcaaaggcaaacttacccaactcttgtacatgctagtctcactctctggaacacatgtactctctttcccctctctgtattcccatcttcacctagtcaacaactgatcacttcacatttcaacttaaatgttgcttcctttggaaagccctctccaaatccagatgagggtggctttcccccatrtgttctcatggcacatggcatgtttcttatatatcagggattatcatttgtagatagatattagtgcttatctgattaatatctttctgtctcattcagttgaaagctccacaagggcagggtctttgctttgttctctgttgaatcaccaagcatctaacatggtgcctggcaaatagtaggaagtctataaatatttgttgactgaatggactaattttacattgaagcagagtgtgcatgattacaaatgatcatagaattagaagatccattgcaatgtcagagtttagacgctgaactgaataattttattccttttaccaacaacataagattcactcttcaaattcagatgaaagcatctgatttcagcagaaggggacaatggaaagctccatctgtagtaggacaatgtttatttatatatatttatcttcaattttcatagcaccttgaaagtaataaaatttgttccatcagtttggaaaaattctggactgtgcctgtttgaccctatgaacacaacctgccttttgtrcactaccatttcttttttctaatataggtctaataattgcctcacaggattgtccactttcacagagcattttcaggataaaaataataaaatgtatagttttcttttcttttcttttctttttcttttttttcttttttttttttttttgacagtttactctgtcaccgaggctggagtgcagtggcacgatctcagctcattgcaacctccacctctcgggctcaagtgattcccctgcctcagtctcccgagtagctgagactacaggtattcgccaccacgctcggctaaatttttgtatttttagtagagacagggttttgccatgttggccaggctggtctcaaactcctggcctcaggtgatccatccaccctggcgtcccaaagtgctgggattacaggtgtgagccaccatgcccagccgaaatgtagagttttcataaacaaagtactattaaggctatttttttttccggatgactattcaattggctgttccattgtcaactccaaattaaggctaaaaactggccaggcgcagcagctcatgcctgtaatcccagcactttgggaggccgaggtgggtggatctcctgaggtcaggagtttgagaccagcctggccaacttggcgaaagcccatctctaccaaaaatacaaaaattagctgggtgtaatcccagctatttgggaagctaggcaggagaattgcttgggcctggcaggtggaggttgcagtgagctgagattacgccactgcactccaggctgggcaacagagtgagactccgtctcaaaaaccaaacaaacaaacaaacactgaaaatacatatcaaatatattgtaagatagtgataaggactatgatgaatatagaatagggagtaagtgacttgggggcttggtgtacatgcatgcatttcagtggtcaggaaagagcttggatgtttgaggtgatgacatttgatctgacacctcagtgataagacccccaatcttctgagaagctctggtggaggctactactgagcatagcagaggcaaaagaaagcaggaactcatgaaatataaacttacaattaatatcaagaaaataatttcagagttctgctttgctttgataggaattgtctgatgtggagcattcttaaagctagtaatgmtctttgcaaatttaaattttccataaacatggtgatttcctttgtgcaaccacatctacagagacttcagttaaagtgcttagggcactgtgtctccccactgggttatgcgttccttgagatcaggaacagccttaacacagtgcctgccgggctagagcctcagtaaatgtttattaacagtacaccattgagtcacaaagggtgcagcagactatctgggatgaggaaagaaggtttcaagaggtgatccaagaggagaaaaaaggggaaaaataagttaaaacaaacaacaaaaacaaaataccaaagccaaaattaatttaaaaaatttaaaagcacccatttttcatattttcaggtgagagaaaatggtaatctaattgtaatatctgaaggtttttaatattaacttagaagatttagatttgaatcctctaaattacaattttctaatcagcaagagaaaataataatgccccctgggattctgggaggtcaaaaatcaaaagaaagaaatttatgtgaggacactaggtaaatagcaaagcacaaggcactgcttctccctcaccctagccccacttctaggaaagacttgactttacagtttttttgttttgttttcctaagacagggtgtcactctgtcacccaggctggagtgcagtggtgagattttggctcactgcaacctctgcctcccaggctcaggtgatcctcccacctcagcctcccgagtagctgggaccacaggtgcacaccaccacacttggctaattttttaatatttttttgtatagacaaggtttcatcatgttgctcaggatgataccatggttttaatgacaagatgatttaatgtaatgctatttaatartgatacatttttcctgtctcagtctttcatatttactcaaagaaacatttgaaatagttatgatatctgagatgatttgaaataatgattgacttaggtaatatttaagtacatggatccttttggatctgacatagaggattaactactttattttttctcaaggcagatccaratgtttcacttgaagagtaatgtgtgacaaaagtttacaatgaacactgggcaaaattgttggagtccttaaagacatgggtgaatgggatataataactatgatgagacagtcaagaccaaatgataggcttactaacaacaaaggatgaaggacttcagagacaagctgggaagcaaagacttttcaccgtagcccagtgaaaatcagccctaggggaaaaaaatcaatgaaaatggttttagaaaggaaacattagcagaactttaaagtagctgaatgtgaggccccaaatttaggtgttagagtcagtttcagagaagtcagtaaaagccaggctatttggagctgtgagattaatttaaaaataatttcaaaaaacaaaacaaaatttttatatcccgtatcttaaaaaactgtttgtttgtttgttttttgtttttgtttttgttgttttttttttttttttttgctattacatctaacatatgcatggctggggamgtgtcattttaaaggtctattgcccatagtacgtccttttaagcaggtgattcagatatgttatcacagcctcttcacagctaaaacaagaaactatttttctaagatcatcatattccatttgaaaaataacatgtggaatgatctacragggtatgatcatgtatcatctaaaataaattgtttgcatgtagaacatagaggatattcaatcattttctcactttccaattaacacattatttcatttaaagcaccacaatttggccaggtgtggtggctcatgcctgtaatcccagtgctttgggaggccragacagagggatcatttgaggccaggagttgagaccaggagtttgtgaccaggctgagcaacatagcgagaccctgtctctacagaaaaataaaataaaataattagctgggcacggtggcatgcacctgtagtcccaggtactcacgggggtgaaggggtgcagaggtgggaggatcgcttgagcctcagaggtcaaagtgtgcagtgagctatgatcatgccactgcactccagcctgggtgacagagtgaaatgccatctcttaaaaaaaaaaagcaaaacaaaacaaaacaaaacaccaaaaaacaaagcaccacaatttggctaggacattctctactaacatggatctgtttattttttaaaatatcaactggctataaaagctatgggttattaaactgaattttctagtgcaattggaacccaaactgttactgtgtttgtcaacttaaaagtttttcagaatgctaatacaaatgtttatatgttaattttatcccttttctgcaccaagttaaaaatatttgttgctaaaaaaatgaattttgaaggggttggtcttattcaacatgaagttgatgagtaagtataataataacaggtctcccagagctgagaagacccacagcaggaagaataaaaaataaagaatattcatctgctcatttatcaatcatccacccaccccgtatgtattttcgagcacagataagctgtaaggcactatatttggatctgaggggtcataaaatcaccctcacagggagctttaatttatcatctagggaagatatggcattttacaaattctactgctcagtgtagggtttggcaagtgccaccgagaagtayaagccacrtgttacagcatttgaagagcagaaattccacttctagttgagacaaggtgacatgagagctgggaccctcatgaagaagagagaattttccagatagagtgcagaaaaggatcagataggattttccagatagagtggtagcaaggtaggtgtgtgggggaaaacacacaaaagaacctgaagaagccggaagaatcagcaaactcagaaacaagtaaagcaggtgctctcgaacacccctcatgggctgaggggtgaagggagaagtcaattcaaggctttctaggtgtaagatccaggaaagagattgagtaacagtcacagagaggtcatattggactttatgggaaagtttttctgaagcccctttagaaaggactaagaaagggcctagagcctgcgagggtccagctagcccagcatgaagcctcatgggccccagatgggatcaatgatgtgtcaggcagggtcttggcaggaaacagatggcatctcaaactgagcagtggaggagagttaatagagttactagattatttactcagatgtgggcagggcgtaggaaaagcgccatagtactctggggccagtaaccatgcaggcctaacactcctccgcctgaagaggaaagggcagagaacagttaggacttagtgggagacctgtatggagagcaccgtttgataacagctgtggcctggaatagaggacactgtcgaccctcggtgtccaagcagggaggcagccagcaaatcaataactcaacctctctctcctccctccctctgcttactggtgtccccagtggtggaaggtacctgaaagccagagctaaaagagcctattgaaacaatcactacatggcagcctgtgggacatggagctgggcaggagagatggaaaacagaagcgatcaggcactgattatatgtcaaattcaacaaagttcagatatacgagggaacttcaaaagttcatgaaaaaaatggaattagaagataaaaataaaaagtggaaactgtatttctcaacataaactccatcaagttcaagacactttggtaagtggtaatatcagccatttagtccattattaaagagctaagggtcctgggaatttaaccatgttgatgcagtcgttttaacattattaactgaaacaaaataagtgccctttgcagattttttaagattaggaaacaaaaagtcagaaggagccaaatcaggactgtaaggtggatgcctaataattttccatggaaactcttgcaaaatcgcccttgtttgaagagaagaaccagcaggagcattgtcttagtggacaaggactctctagtaaagttttcctgggtgtttgtctcttttcttcttccttccttccttccttccttccttccttccttccttccttccttccttccttcccttcctctctctctctctccctctctctctctctttctttytttctctttttctctctctttctttctttctctttcttttctttctttctttctttctttctttctttctttctttctttctttctttctttctttctttccttctctctctctctttcttctcccyttctttttttttttcagggtctcactctgtcacccaggctggagtgcagtgacacaatcatgactcactgcagcctccagatcctgggctcaagtgattctcccacatcagcctccctagtagctgggaccacaggcacgtgtcaccacatctggctggttttaaaaattttttatttttgtagaaatggggttaggccatgtcgcccatggtcctcaaactcctgggctcaagcaatctgcccaccttagcttcccaaagttctgggattacaggcatgagcccctgtgcctagcccctgggtgtttttctgctaaaacttttgctagctttctcaaaacactctcataataagcagatgttgtcattctttggccctttagaaagacaacaagcaaaatccctcaagcatcctgaaacacttgccatsacctttcttcttgacagatctgcttttgactagaccaaagtacgcctacaacttgccaatttgcaggtagtttgtactacagacatggtggtgattcccttattatggaagaagggtagaaaggagttagagggggaaaaccatgggtctaaagaatagagaaaaatccttttatctcctggcggtggaattgactagaaatgaataagatgcccccagtggtttcttctcagttaataagagaatttagcattcatgttattcttgtcatggaagactgagttccagtttttattaatacccattgccattcattgattctcccattcttctattcaaaatgcctttatggttaccatgcactaggcacatgccaggtaaaggggatataaacacaaatatgacagtctyarttattgagatgcagagaaatgcagtaagcaagtgagtacagagtgggataagtaccaggctagatctgtgcacagggtctaactggaacacactgagaggcacttattctaaactggggcatacaaagcagaaaagcttgctagagtagatgctgtctgggctgaattctcagggacaagttgcagctatgaaggcaaaggaaggaaggtcattgagccaaaaaaagaagtaaaaaagaataaaagttcatagcaaaggaccaaagctgaggaagggaggcataaaatgcattctaggaactgtaactcattctgggagggagcagggtgggagagaagaggcaagagatgaggtgtgagaatcagagagaccaatcctaaagagccttgggcaccatgcagagtggaatgtaatgctttgtagtgtaacataatgaaaaaaagcttgtatagtcatagacctctttyatttcaagagcacaagagttcaataattcactctctacctggttttaagatttgttgcaattctgaatgtctttaaccaattataatttatttaaccagtgtgctgaatgccatgtttactctttattataatagatcacatgagactgtaccaaagactttctctagtataggcctatggtttatgtggtaagagcactgtctttggaggccgacctcagttgaagtccagaatctgccacttaccagctgactggtcctggacaagctatttaaagtcactgagcttccctttcctactccctagagttatacttaacacaacacaaatggctgtgggggttttgctagtgaagccatacatccccgtgaggattacatgcaccataaatgaaagcacataaaagtgccacaacagttgacagtggccttgcttagctgagacctggtcacaataaaggatcaataaatagtagctactgtcatcatgattgacatcatggatcaatgcaaatcataatcatcttttcactgtgatgaacaggtggttttagaaataccatgtcctaatggcctatatcaaagtgtgaggaatagtaagagaattcagagtaagagagggactcctgcagtctttgaacttggacctttaataaaaatggaggtatgaaaggcaattccaagtgtctcaaatggaaggtgaactctctstctctctgtctgcatgtgtgtgtgttttaaagacagggtctcttttgttgctyaggctggaatacagtggcttgatcatagcttactggaaccttgaactcctgggctcaagcgattctcctgcctcagccccccaagtaactaggactacaagtgcatgccatcacacctggataatttttaatttttttttgtagagatggggtcttaccatgctgcccaggctggacttgaacttttgacctcaagtgatcctcccatttctgcctcccaaagttttgggattataagcatgagccactgcacctggcyctcttctgtttttgagtaactcatccacgtattcattgaaacttccatttacaagacagtaaactkccatttacaagactgtaaacttccatttacaagacagtaaatcaatctacaacccagtaatagattgagctgctttgggagaatttcctgttatctgtggttgcttccttctcttcctagactttctgcttgtttctgcttgttctcrtgacagtctggaaggaatgacaatagacaataacctccacataactactgttcacatggcacactgactttcatccagactcagaaattactcatactgtgtgctttttggcttatgccagttttgtcttgaaagtattgcactgtgcatgaataactcatatttgagactgtcatgagtttaatttgtgatatttgaatttctagatactcttttctgattgttaaagataaatgccttcaaaagaaaacatattctggaagaaaaaatataaaccccaggccaggcaaggtggctcacccctgtaatcgcagcactttgggaggctgaggcgggtggattgcctgagctcaggagttcaagaccagcctgggcaacatggtgaaattctgtttctgctaaaatacaaaaaattagccgggtgtggtggcatgcgcctgtagtcccagctactcgggagactgaggcaggaaaattgcttgaacctgggaggcggaggttgcagtgagccaagattgtgccattgcataccagtctggtggcacagggacactccatttcaaaaaaaaccaacaaaaaawatatatatataatgattgacatgtatagatatatatcaatatatagatatgtagatattgattagatattgaaatataaattaactccaaattcttagtttttaagtaagaactgagaaaaagtatagtatgtcattttttcccccttgaaaacactgcttctgggaattatgaatcctatacagtctatggggaatttctttgtatgtatttaaagtttcaaatttacttcaatctccttccatggttttactgatttttttttctttggtgtgtgtgccagttctaataaagcaaactataattccagaggatatgcaaaaagagggctagaagcattaaatgaaggggtcgtaggagccacatttactagactgagtgtctgtggtttttgaaattgctaaggatcataacaaatggcatgtttcttaagaatctccaggcagcgtttgagagtgcaatatttctctactggcagtgaataaaccaggaggcatgatcctcactgactttgtaacatcctacacaatattgtggggaccaaaattggacagccaagctaagtttgacagcagccctttgagggcactgccacatgtgactgaatggcttcctttctcagtaatttcatacccatcaaaacatatgcttctctgaccaattactgatgtactgatgcaaaaaagcttcagaaatacggtgttgtaagcatttagggctatgtttcctgaactgtgttgtgagaaccagagaatcagaattatctgccagcttgttagaatgcacatttccaggaaccaccctaaactcactgaatcaaaattttgggatagggtgagaagccttgcatkttaaacaaggtccacaggtgattcttatgttgctcaaaaacttctaggaaataattagtatcttcgtggtagatgacagtaataggttatatgatatacgaaagagtaaaactgcaaaaccaattgtagggagaaaactatgaccttttgataaaattaaagacaaggatggcagtataagcttacattcatgttcttggtttcaatcaatagggttacagaaaaaatgttcagaattagtgtttgtggaattttgcttatttttttattgtgttaatagtgagacaaaaattttaagggcactttccaagatggtaacctgtttaatagttctgagtagtacatgtctttatgagaaactcatcaaagaagatttgcctgggactgctgtgcaatgactgatagagaccaataggaaaagatcaggagagtggcaatgaagaagataatttttttttttttttttgagataggatctcactctgtcacccaggttggaatgcagtggcatgttctcagctcactgcaacgtctggctcccaggttcaaatgattctctcatctcagccctgcaagtagctgggactacaggcatgcgccaccacaggctaatttttgtatttttygtagakatggggttatgccatattgcttaagctgatctccaactcctgggatcaagtgatccacccacctgggcctcccaaaatgctgggattacagatgtgagcccctgtgcctggctgataattgtctaattgtargattaacttttaataagaaagggtttcacacatatccgatgttggtcctactgagtctcattaataagatcgcgtggatagatattactgatgggatctggccataggactttagttttaaatgttgagcactttcccatactgcctgcagattgtagagtttgcctggggttggaaaaaatagatctgacaagcttgtgccccgtctgtgataaggaggaccaacttgtttgggttgtaccatttgaacacattgtaaccattgtcctacctgcctgtaaattcttgtattctggaacatattaaggtgttacctacaccacttttatggaatttttaaacaggagttccatctgttgtggttcagcacttggcctcaaaccttttgacaatgaatagatgtttataatgtctgcactggaagccttagcagttacataaacaccatcacatgctgtatgttatatatgaaacacacacatgtatatacacatatatgtgtacatatccatgtgtatgtatatttttaatacacatatatatgaatatatcacacattctattaacatgatctgtttattatagtacttatgaaaagaacttatttaagaagagactgcttatataaagaatatatttggcacaaaagagatgctgtaaatgtcatcatatgaatatctacctttttcttgtaaaatgagtcattgttaattcatttatctgttttttgtcatcacttgactgagaaaaaaattattactgaaaattttctgagaagacactaactttggccattcgtttattggtacatatttattgagcatctgttgtgtgctaggggctgaggatagatggatgaggagagtccacttcatagaacttactatttactggaggaagtagacattgatctaaaagtcacacataaaagaacaagacagcagctgtaaccaatgttatggagaagaagtttggggtgctttgaggacctcagtatgcatcggggggttacaaaaggcttccaatactgaagctgtgaatttgatttgtaataagaaggctaagatctactttaactaagtgaagaagggagagagggaattcttggtagaagaaaaagtacatataaaagcattgtggcaggaagaagtacagtgagtctgagaaactttaagagtgttcttctaggcaaagcaaagagagcagagggaatgtgggacaggataaagctggagaagctgggagagaccattccatgtgaaaccgtgaaggrtatgttatgaagtttggtctttaagagctatgggaagctacctaagatttcatgcaaggggtggcacaacagatttgtgttttgaagagttcactctggctgcatcgtgggagggagattggaagggttcagagtagttcagtgaggaggctatggccattattgtaggtaaaaggtgatggcaacttgcactagtgctgtggagagaaatggacagatttgagagcaattgagaaagtaaaatcctcaatcttgtggtgatagattggatgggggtggtggagaaggcagtgagtgggcctctggttggtacaatagattgagtgatgttgcattcactgagctaaggaatgctggaagaagagtaagtgtttgggggaagcaaagagacaatcatgagttttaatttaaatgaactgatgctggggagtggtgcatgcttgtaatctcagctactctggagtctgaggtgggatgattgcttgagcccaggagtttgagagcagtctgggcaacatagcaagatcctatcttaaaaaataaaacaaaataaaataactgattttggggtgccttagaagcagtcaagtaagtggtaggtgatgtaaatcttgaattcagaggagaggccaggccaggaccgcatatatagatctggaagttgttgcatagaggtgattactgtagtaagagcgttactccaacaatgactagctrggtaaagaaaggtgggataagaaggagtgtccagagagtaggaaggaagctagaggagtgttgtgtcacagaaactgaagaagaagaatgctttaaggaggaattggtttacggaatggaatattgccaagagacaaataacatgaagactgaaccatgtgcagtgcatgggtgacttgcaggttgttaatgactacagagagagatgatagagttagaaacaaggttagagagggttgagtcatgagaaggaggcaaggcagtggatagagagagacaactctcttggctttaaaggggaagtgagagataaggcagtagatggagggaaaggggaggataagccacttaattatgtttagaagccaatgggaggactcagttggaaggggaatattgaatagagaagagaaaaaggttaatctaatctatactgggaagtttctgagaaggtgggaaggatgaaatccgaggcaaaatatgaccatcctttgatgactttattctctgtggctgctaaaaagtaccagtatgtcagttgggcctggtggctcacgctggtaatcccagcactttgggaggccgaggcgggcggatcacgaggtcaagagattgagatcatcctggccaacatggtgaaaccctgtatctactaaaaatacaaaaattagctgagtgtggtggcgcatgtctgtagtcccagctactcgggaggctgaggcaggagaatcgcttgaacccgggaggtggaggtagcagtgagcagagactgtgccactgcactccagcctggcgacagagcaagactctgtttcaaaaaaaaaaaaaaaaaaaggaccagtatagtaccagtatttcttttaaataggtgtatttgtggctgataaacaaatttcattcttagtgtacttacataggtcaatacaaaaaggattactctgcaatatgatggctagagctcttttaaaatatactaagtattttattttaaaaactgcacaaaattcttgaaatcaatgtcatcttatgcttgtatgatgatgaaactaatgtactcacattagtctgcctttccaaagcttctcctcatctatatattggcttgactcagcttgttctctatgtggaaaaggacacattactacgtatagtgatttgttagtggataatcacagaatgactgatgctttgttgcaagtatatggcctatctgacacttttcctctgtatcaagacaagattgttgacccaatatggaaaggcagaggagtaggaaagtgatgctggatgaaaaatagaagttaatccctgaggggtgttaggttactgatcttagcttgtttctcttcaagatttacaagttattagcatgtttactatgagctctttgcctatgtgtatattgtaacattttagcataatactaaaattcagtttccacaacatgttgaaaccttgtatacagcaatgttttcttctcatgaaagctaattttccaaaagatgctatttccaggtttcagttcagttagttgtttttaattttgagaaagagttagatttttaaaagttagattttcaagttgcatttcaaaacaaattcgattttttcccatgggtattctatcacttaagtgattaatgaatttctcaatcactcatctatttgccaaatgcttattaaacactataatgtgccaggcactggttaagatgtacaaagatgaggcataatccatggttcttcttgtagtttactgtccagagggaaagactgatggccacatgccaagtgcaatacagaagtgtaggcagaggatggaaaggacagagagagagaaattaattctgcttaggggtggtatgtaggtgtgtgtgcatatgtgtgcgtgtgtgtgtgtgtgagagagagagagagagacagagaaagacagagagagaaagagggagagagaaatgagagtgtgtggagaggtttaagagggagagaagaatgttcataccacagagacataaaataggaagatggaagatggggaaagggagaaaaggaagatttcaagataataaattatctgagtttgtaagtgtgtttttattttgtctttaagtattgcaaagtatctgaacaaaaagctgaggttcaattttacataatcaatatatactcagtagtcccagtatatcagtgtgaaaatgtgaagttattgtataaaaagcattccgttgtttttggtgctctaccaacacttagcacgtaggacagtgctctaacacatgtggtagaagaaaagacatcatactacaatgctagccaccacatacatcaaaatcgagttttcttttttttttttcttttgagatggagtctcgcttgccacccggctggagtgcagtggcatgatcttggctcactgcaacctccaactccctggttcaagcgattctcctgcctcagcctcctgagtagctgggattacaggcacacaccaccacagccagctaatttttgtatttttagtagagatggggtttcaccatgttggccaggatggtctcgatttcctgaccttgtgatccgcctgcctcggcctcccaaagtgctgggattacaggcgtgagccactacrcccggccaaaattgagttttcttttatcacttttaaagttctatgaaagttgacattgaaatttaatggaaaagcttcatattcatagactcacaaggctattggtggccttatgggctaggtcctctcagaggtcatttagttcattttcacattggcatctagagtggaaaaataatctagctcgcatgaagggtgcccccaaaggagacccacaactgctgttaccaattcttttgactgtctgaaaaaactctcctgacacaggaggcattttgaaaccatctccatttgcccatgtattcataatctaatataatataataaatagcacattctttttttattcatatttatttatttagttaattagtttagatttagagacagggtctatgctatgttggccaggctggagtgcagtggctattcataggcatgatcatggtacaccacagcttcaaactcctggccttaagcaatcttcccgccactctttcctgagtagctgggactacaggcacgtgccattgcactcagcttgacagtatgttcttataacacaactatttgaaatcaagttctaaagatgaatcatgatagaaagttgtttgaaaaaattgttccattttcttttagaacccaagaagaccttctactgatgatcacattcaaattttaaatgtctagtgactaagagactaatcacatggggctgcttagatttatcgaggaggacaggagtgccaaaactctaagttgttttttgtagggtgtaagaacaaaggcatctcatgtgtctcgagaaatgagtgaaagtcatgacccagttcttcctcctactttaacaaaatgtgactgaagaggaagccagatgtgttctaggacagaccagctgactaactcttactgtcaacatacactgtgcaattccaagacacaagggcaactgataaagaagattagcttggttttccagaaataagttctgctctgttcaatctccttgctcaatctccattctctcattcatgtggaataacaagatctgcaataaacaccaccaggcaagtctctgaggattactgagttatttcagaaattttctaatcttctactctgaacttttataaaatgattatcagaaaatgaatcagcagttggaagaataggaaatagattctactgtaatcatttcctgcaagtaataatttctcacacattatcataataaagtctctgttcttctttaagtagagtaagtcatcgaggaagtagatcacttctaaaaaattaaacttgtctctgggtctttataatatattataacattactgaatgattgctcttgaaatttccaatatttcatgtccttaacttgaattttccctacaggttgaaaagtcaggttctggaattggctgtctggattaaaatactggttccatcactgagaagctgtgtgaccttgcgaaaattacttaatctctttgtgtttcagttttctgatctgtaaaatgaagtcaataatggtgagaaaatgagaaaaatgcatgcaagcttagcatattattagagtgataaatgctaacaattataaatcatgtcagggcctctacattattttagcatttactttcctctgactatctgtacattactggataaaaatattttattgatcaccagatattaaactcctgtgaatttctgtgtgttgatggtgaagttggtgggaggatggtgatgagacttacttgaagacaggaatgtatgtgagttgaccatgtcagtaagctgagatactgtcaatttctgaaggattcctctggctgagtctacacagttaagaagtattatatatttcttgatgtctttcctaatgtctaactgaaattctctaattgtctcatgttttattcctcatttatggagatgctggacagcattaaaaaatattgaaacgtgaatacttgaaaacaattactgtatcatttgtcaattcttttaaaaaatatcaaaaacccagtttatttggccttttgttctagacttcaattctacttctttggaccccttctccctgaggctgatagggcagctggcccctgtgtgggtgttgatgaaacccagaccagtacatagtactcagttgggcatagtacattctaggcgctaagacaggcaggtaagtggatcaagcctttacaagcggtgacttctctcagggaggaaacagccctaatcttcatttaccaggttcagaatgctttgggtatggtatagtgatgaatttgatatcgttaccatataatcacaatcttgaaacatcacattttaacattcaaggaatatttgacattgccatttaaaaatattattcattcattcattcattcactcactcaacaaatatagcatgctaaaaacataaaagaagtatgctagattttttcgaatacaccttttggctctaactggattatgaatttcttttagagcagagacactgtaccttattcatatttctatcccaagggtcagcctgtagaagacactcacctaatgcaacaaacatgcattgcataaatgaaaaattggatgcaaggaatatgctagctgtgcatgaccaataaagcatttgttgctatgtctcatctttaaactttgaatttaagcagaacttgaatgcaaatactgtctccatgaaaaatatatttggcaacaatattatgttagacctttcacttagattaaatatataatttaagtgcttatataaaaaagaagatgaaatcaacaacctatataaactatccagggagtcaagggttttggtgaaaaaaaaaaaaaacagtttaaaataggacttttcttaaactcaaatcctctttcatgtagcaaaaggaaatgagcaaagaaatccaaacccactgaagttttcagggccaaacattttgattcaatatgctctgctataaaatatttggccttgtttgaatttttattgctatatgttctcagtctatatttaactgtgaggaacacaaataagaaagagtaaatgtgcagaacgttcatttcaagagcatggcagtgaatttgagaaaacatgtattaaaggaacactttgtgtttttaactttcagccccttttctgaggcctcccttggccagatatgattaaatatttatcaaactaaggactcagcttacttggagtgaaaactcttcagggcctctcagagatacctaagataagtaccttattttagtagctctcaaataaagcttcttttatgctctgtctttttcatatataaaataaggtctaattagaaagttttataatggaggcagtcaattccccaattccttatttgtttgaattaacttttaaaaaattggggtgttcactctggcgttggctcaatccagactctgtaatcagccaacaatctgtgcttcacaaaggctggcgtcctaactgccagcttctgccatccgcaccttttccgtggggtaatacattttaattggtacttctctgagagccctacacatctccatctggccaaataaacatacttttactattcagcctcaacatcttggcagttaacaagaggacagacttgccacaatgggtaatctttaagatgcataaaatcctaaaattaaaggaccaggtacaggtggtataatcaatggctgcctagaagatggctcatctacaaagtggctttgtgttccacagtctttttaacactgctcttgtgatcctaaatgcagttcctgagccgagtcagcattgagagctctctcctctcaaagggcacattagtgatgaaatatttcacttccaatgacagcataactttttggatataggcttattagcaacgtgtttccactggttggattgagcaagtgtaaccagaaggcagaatggtgaaatggttaagagcatgggttctagagtcaggctgcgttcaaattctgctgctgttaatttatctttgtgaccttgggcagttaccatacctctctgtgcctcagtttcctcatcagtaaagcagagataatgtcagtattttcctcataagagtattgcaaggactgattaaatgagataaggtgtctgatatgtttagcacagggcatgacttgtatttgctaacaattatttttaggcaaggtcagtagaccaaataacttgagcagcagaaaggaagtggaaggcgaataaccagctatgaggttatttctcagataatttcttcctatttcaatgcttcactttttacagtttaatcatcaagcaacagtgttagggattacgtgagataatatggtctgtgtgctgattcactcatttagtgtggtctcatttccttaaagaacacatcttgagagaacactttttttctctctaaccctcagggtcatctggatgaaatgaatacttttagggcaaaatggctgatactgcttccttgataaccacatataggtaagggattgtttctctgcctcccaaagttttccctttttcctacgaccactttggtgagacgcctttctcagcacaaagcagggacatgactctgtgcattattacaactggggatgtttatgcaagaggaaggccacctagaaaaatggagctgacagatccctgtaatttggggcacaaatggttcttagcagcaggtaagggtctctcaccagttgctttctcaggattgttgcacatgaagcattgccatgctcctgctgtttcactgaagccaaacacgtcaaagaacctcacttcttccagatggagctgtacctggtccagatcctgtgtcaggaacacaaagcacaaagaacataagctgctctgcctgctacctaacattctgagactgggagaaggggatgtggatcaggatggtcaatgctcaatctcagtactaaagactaagaggcagcattgaaaaaatttctcttggccaaccttaaaaaaagcattcagctaaacttttccagaagagtattcataaatgcagcgggagcgagcacaggccccagggctgagtgtcagggttgaggtgtcagagcttgaaatggcccagaattttcttgcatctagcagtggctccagattttctaaaaagaagggatatccaagtggcaatgtggttggaagacatgctgctgggggatttacatttatataaaattgagaaccaattatccatatcaaaaaatattattggccgggcgtggtgggtcatgcctgtaatcccaacactctgggaggctgaggcaggcagattgcctgaactcaggagttcaagaccagcctgggcaacatggcaaaacctcgtctctaccaaaaatacaaaaacattagccaggcatggtggtatatgcctgtggtcccagctactcaggaggctgaggtgagaggatcgcttgagcctgtgaggcggaggttgcagtgaggcaagattgcaccactgtactccagcccgggtgacagagtgagaccctgtctcaaaaaatatatatatatataatatttattatgttggctttacagggggctgatggaaaatatgggggtggggcttaatccctcagcccttggctccaggactgtttagttcttttgctttattctaaaagtgtatgcaaattttgcattctattacataatataagctacattgatttttttttaatttttacttttatttttttactgagatagagtctcactctgttgtccaggttggagtgcagtggtgtgatcttggcttactgcaaccttcacctcctgggttcaagtgattctcgtgtgtcagcctcctgagcagctgggtttacgggtgcctgccaccacacctggctaatttttgtatatctagtagagacagggttatgccgtgttggccaggctggtctccaactcctgatctcaagtgatccaccttccttggcctcccaaaaggctgggattgcaggcatgagccaccgtgcatggcctgcattggttttaatggaaaataatgcattgaattatttaccaataaattagttaacttttttcctccaagtggttgagtagaattgacactccaagaagactgcacatgttttatgtgccctgtggcaccatgccaatgagttcctctttaaggggcagggcagagaggttctgttagactgtaaatggatggaaaactattagcctaaccaaattaaatagctctactgtcctcctgaggctttcctcttatgtaaatgacttgtatcctttggtataggatggatgaccagaaactgcattcttaaaaggctcctcctcctaagagggacttaatgttcttattggccttgcatgtacccagccaactaacatgtttgtgctctgttgagctgtgattttatttcctttcctttagcctacacactcttatcttctctctgtataggaatagttcttagaattttcaaggctgaggcgtgtaggcactgtttgcactgcttataagggatctaaatagagaatgatcaagtggctatcctgattgcatcccaaagctcctaattctcagttctaaatttcttgacagaggtaagaagtatgtccaactatcagttcactgagaacagaaacatatttttttttttcataatacccccagagtccagtccagcatcattaatggattagcattggtttgtagacccagcacaaagttttttactaacgaactatataaaagatagtacaaaaagttaaagggaa

SEQ ID NO: 17866 - DNA, 33302 bp, Homo sapiens
ggggctgtctgtggctgtctctgtgtgtgtgtatctgctgtgtagtgcatacgggcatctccatgaagtgtgccaggtgtgtgtgtctctctgtgccatgagtgtgtgtacatctgggtgtgtgtgagcaagtgtgcagagggtgcgtgtgcacaggtacgggcaggtgcatgtgtgcgagtggctgtgtgagtgggtgtgtgagaaggtgaatgtgagagctggtgtggctgagagtgggtgtggccatgtttgtgtgtctgtcaacacatgaatgtatttcagtgcgtgtgagcagctgtgcacgtatgatgtcagtgggtgtcagcagtgtgtgggtgtgcctgtgtgagcagggatgtgagcatggtatatgtgagtggctgtaagcaggcatgtgtgagtgatatgtgtgagtgggggtgtgacagcaggtgtgtgagcaagtgtatatgtgtgaatgtgtatgtaagcagggatgtgtgtgatataagtgtgtgtgaatgggcataggtgtgtgtcagtggatgtgtgagtgggtgtgaacatgtttgagggtgtatgtaagcaggtgtgtgtgagcaggaaggtgtgagctggggtgtgtgagcatgtatgtgtatatgtgagcaggtctgtgcatgtatgtgagtggatatgtgttttaacatgtgtaagcatgtgtgtgttcccatgtgtgagcaggtgtgtgtggggggtgaggacgtgcttaagcacctgcgtgtgtgagcaggtgtgcatgtgtgtgaacaggtatgtgtatgtgtgaaagcaggtgtgtgaatgagtgtgtgagcatgaatgggtgtgagtgggccgggcgtggtggctcacgcctgtatcccagcactttgggaggctgaggcaggcggatcacctgaggtcaggtgttcgagaccagcctggccaacatggcgaaaccccgtctccactaaaaatacaaaaattagtcaggcgtggtggtgaacgcctgtaatcccagctacttggaaggctgagacaggagaattgcttgaacccgggaggtggaggttgcagtgagccgagatcgtgccattgcactccagcctgggcaacaagagcaactccatctcaaaaacaagagaatgggtgtgatgtgtgagtgtgagagcaggtgtgtgtgagcatgcatgagtgtgagctgctgtgagtggatgtgagagcagaatgtgtgtgagcatttgagtgtgcaagtaggtgtctgagtggttgtgtgtgaacaggcgtgtaagcatgcaagtggatatgcatgagcagaatgtatgtgcatgcgtgagcaggtgtgaggtgcaagtgtgtgtaagtggtgtgaaatatgagtgagcaggtgtcaatgaggtgtgaaagagctggtgtgagcgtgtgagtgataagtgagcagctgtgaggtgtgagcatgtatgtgagcaggtatgtgtgatgtgtgagcatatgtgtgagcatgtgtgtgtgcagatatgtgtgggcaggtgtgtgtgagtgggtgtgagatgtgagcatgtgtgtgaggtatgaggtgtgagcatgtgtgaggtgtgagcatgtgagtgggtgtgaatgtgtgaggtgttagcatgtgtgaagtgttagcatgtgtgtgagcatgagtttgtaagcataagtgtgtgtgagacttggtgtgaggtgtgtgaggaagtgtgtgtatggataggtgagcatgtgtgtgagcagacgtgagcatgtgtgagtgggtgtgtgcgtgagtgaatggtgtgaggtgtgtgagcacaagtgtgtgagcaggggcgtgtgtgtgtagctgagtaatgtgagatgtgtgtgagcaggtgtgtgcgtgtggggctgagtaacgtgagatgtgtgtaagcaggtgtgtgcgtgcaagtgtgtgtgaggtgtgggtaggtgcgatcatatgtgagtggatatgtgtgagtgaatggtgtggtgtaagcatgtgtgtgtgagcaggggcatgtgtgtgcaagggtgagcaatgtaaggtgtgagggtgagcagtgtaagatgtgtaagcaggtgtgtttgtgcaagcatgtgtaagcaagtataagcaggtgtgattatgagacctggtgtgaggtgtatgagcaggtgtgtgaacatgagtgtgtgaacctggtgtgaggtgtgtgtgagcaggtgtgagtgggcatatgagtgtgagaaggtgcattgggtgtgaccgtgtgtgggggcagtaagtgggtctgagtgtgtgtgcatgtgtgtgagtgggtgcattgggtgggtgtgagtgtgcatgtgagtgggtgtgaatgaggtgtgagcatgagtgggtgtgaccaggtgtgtgtgagtgggttgtgaatgtgtaagcagatgcagtgtgggtttgaacatgtgggtgggtgcaagcatgtgagtgggtgtgtcgtgtgggtgccagtgtgtgggggcatgttagtgaatgagtgtgtgagcatgtgtgtgagtgtgagctggtgcattgtgtgggtgtgtgagaaagtgacagtgtgtgagggcagatgtgggtgtgaatgtgcaagtgggtgggtgtgggtgcaatctggcgtttgggtgcattgcacaagcatgtgtgtgagcatgtgggtgtgagtctgtgagcacgtgcattgtgtgtgcatgtgtgtgacagcatgtgtgtgatcagatacattgtacgtgtgagcgtgtgtgggtgtgagcatgagtgagtggttgcattgtgtttaagcatgagtgtgagtgggtgtgagaaggtgcgttgtgtgagcacgtgtgtgagtgggtgtgggcgtgatgtgtgagcatgtgtaaggaggtgtgggtgcgttatgtggatgtgagcatgtgtgtgtacttggtgcactgtgtgggtgcgagtgtgtgcgcgtggggggggtgagtgcgtgggtgtgagtgggtgtgtgtgaacgggtgtgtgtgcgcaagcaggtgtgtgtgtgtgagtgtgggtgcgttgtgtatgcacgcccggcgcggggtggggcagccgttcccctgcccttcccggccaccccgtccccgggcccctgtgcgtacgcaaggcggtgggggcggctcccatgtgggccccgggccccctcccaccgggccctcccccccgcaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatccatcctcttgcagcacagagtctcttttaaaatttgttgtgtatctcttttggcccctgtgtgctgcgacgtctctttttgtcatttgtccatcgggtgtttaccgaggactgtacccaatgctggaccctgggaacatgaggaccaatgacacagagcgcctgaacaggagttagagtttggtggaaagaacaagtcctcaattgtgattaggagagcagatcctatttaaaagctctctactcctgatagttgttgtttttaagccttgatgaggtttgaactcatgatgatgatgatgatgatgatgatgaccatgaccagcaacaacatttgatattctggtcaattagtatctgccaaccttgagatgtggagtctaatatcactccattttatagaatgggaaactgaggcttgtagaggtcaaattatttccccaaggtcacagccgttgagtggccaagttggatcacactccaggtctgtcccgacacgtcaacatggagtgggaggccttgcttatctggaagaggatactcttcagcattccgaggacaggaattaagccccaaagctcctgtgggccgcaaagggttctcacgagctgcacgcccagcaggactttagacccaagtgaatccctggtgggacccccaggttctatttgctttctagctcctagccacagcaggggagaaacagaccaagctgagcggagaagcctgtaagtcctgtgttttcctccagacggtagcaagtagtggcagtagacagcctgggagtgagggacttcccaacgctgtcaaagaccttagggaacccagattctggggccattatcgtagggacaaatacccgccccacacctcctcaaccccagagggctcactgcagcccaaccctgcagctccctagtcctactgcagggccacaagagaaggcaaaatggtgttgtgtcttcattcttctatttttatttttttttttttgagacagggtcttactttgttgcccaggctggagtgcagtggcacgaacatggctcactgcagccctgaccccccgggctcaagtgattctcctgcctcagcctcccgagcatctgggactacaggtgtgcgtcacatgcctgactgatttttgtattttttgtacagatggggtttcatcatgttgcccaggctggtctcgaactcctgagctcaagtgatctgcccgcctcagcctcccaaagtgctgggattacaggtgtgagccacttcgcccagcccatttttatttttttattattattctttgagatattaataataaaaaataataataaataatatttttattattattatcactctgtcacccaggctgcagtgcagtggtgcgattttggctcactgcagcccggaactccttggactcaagcgatcctcccacctcagcctcctgggtagctgatactacaggtccacaccaccacacctggctaatttgtgtgtgtgtgtgtatttattttattttttatttttttagtagagatggggttttgccatgttgcccaggctggtctcaaactcctggcctcaaataatctgcctgcctcggcctcccaaagtgctgggattacagatgagccaccacacccggcctaacatttttaaaattataaacccacttcatacgtgtgacaatcctgtgcagtgggtgctgctttcacccaccccgctttacagatgaggaaaccaggtgctttgagattaaagagatggcagtgctaggactcagagacaccctggccccagggtctgtggacatgaccactgcctgaactgcctgcgaggatgctcctgacccgttagccttagggttatgggcccagcatgctcccaccgtacaatttgctgtaagagggacacacacggggcttggagtacccctgaggcttgccaaaggttggggaggcagaattgtgctgcggggggtgagggggaagggacaggagccagccagggacaatgtggccctaccttctccctggagagacctcagctctctggaattcatctatatttagcaggtggctggacaggaggcagataagcagagcctggggaggggggaggtccccatatatagtgggaaggacaggaccccactcagtccctctttgggtgacctgtgcctgcttcgtgcctggtgtgacgtctctcaggatgcctgagccggggaagaagccaggtagctttaggactggggttgggtctaagtgtgggagcaggggggtgtctacaattggggagcagggctaggagggagttcttgagggggttgacgaggacgtggcctctgagccccaggacaggggcagccagtcctccagggtccttttttgattctcggtttctttttcccatccctctgatgagaggtgaaggtaaacccaaggtcagggacgcagagaggggacacagccaagacaggaagcacccggggtcaacccattctgagaatgcaaagggaccccttccctgtcccattgccttcaccttccacagcaaggttccccgcggacagarcccacgtttagtatggagctgagccaggctcacggcatgccttcagaccagtctctacccactatgggtctcagtctcccaacctggggtgccgggggtggtggtggcattgggttggttcctcctggctgtgacattatctgcttcatgagcctgtacggtgtggcccccatgttgagggtgacacagcccctcttctctgagagaggacagtcaggagcccctgaacccaggccaagggcagggaaaatcacagcccagggacctgggcctgggctgtgcccttatgaaggttgtccagggcagagatccaggtccccatcccccagcgccctcccaggccagctttatctcagttgctgatacccagcctgaggtccttggaggacaaatttggccacattccaagtrggcagacttccccgccccctgccaagggcccgaaatggttgggggaaagggagctgggttcatcacgggtgtctccaagcagggaaagtggacacatgcagaaaaagtcttgttgggaggtcaggaccacagccctggctctcccgactgctagctgtgtgatcttggaggagccgcttagcttctctgagcctcagtgtcctcctctgagaaatgaacagaataactgcaactacctcagagaactggtagagtattacgtgaggggatgcatagaaagtgctagcacagtatttactgagaggggctgcaggggcggggtgcacgctccaaccaggggccgctgtagcctccacctggcccttcagtctcagcytttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccrcagagggcacacggcatacgctgacagtgcgggaagtgggccctgccgaccagggatcttacgcagtcattgctggctcctccaaggtcaagttcgacctcaaggtcatagaggcaggtaagatcctgatcagccttccctgaggtttgggctgctgsgggaggggcagcccagcgactctccatccatccagggaacaggaggtgctttcacactttcttgcctttgctgtggctgtgccccccgccaggaacgccctttcccccttttctgcacatgacctctctgagtacccccatgtgccatcctggcttgttccagccatggggtaggtgggagagatgaacaagacacaaccccactctccccctgcagacctccctggggagatgaccctgcacagacggccgggaagccccaggagctgtggatgaggggagtgcagcccagtctgaggggctgctctaaggctggggcagagcagggatggacctggagctgttcagggcagatgcagaggacatgggaastgatggcctgggacggggaggagaatgtgagaggcaggctggctctccagctcagcatgagctgcctctgaggggcccaggcagcgggaggacagccatggcagactttcctcatccacagcgggctcatgggtccaatgctcaggagagagagggtggaggggtctctggttagtggctgcaccacgactcccatctgatcccctccagagaaggcagagcccatgctggcccctgcccctgcccctgctgaggccactggagcccctggagaagccccggccccagccgctgagctgggagaaagtgccccaagtcccaaaggtgagaggggctgggcagggaggggcaggatccgtgggtagggcgtgtccagggcaggtctcaaaagcctttgctgggccaggtgcggtggctcaggcctataatccccagtactttgggaggccgaggtgggcggatcatgaggtcaggagattgagaccatcctggctaacatgatgaaaccccatctctactaaaaatacaaaaaattagccgggcgtggtggcgggcacctgcggtcccagctaacttgggaggctgaggcaggagaatggtgtgaacctgggaggcggagcttgcagtgagccgagattgtgcctctgcactccagcctgggtgacagagcaagactccatctcaaacaaacagaaaaagcctttgctcacagggtcaagctcagcagctctcaatggtcctacccctggagcccccgatgaccccattggcctcttcgtgatgcggccacaggatggygaggtgaccgtgggtgagtgtgagctgctgtgcccagcattggggtgggaagggggggcagcaggacactccccaagccgggcctgtcgccctgcctttgcaggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtgggtccaccggggtcgtggagacacggagagaggggacatggagagccctagaaggcacaaggcacacagagggcaccatgagacccagaggcacacacgagctgcaagcaaggggtgtggggaatctgggaggcaggtggaggggccaggggcccacagggagatcccggaggcctgggggccagggagtgcgatgaggctcatgggagcactgtcggggacctgggagacttggtggacatgatcacctcaagggggcacctaataaggtttggccgggggtggggggkcgcccagggtggtcaggaagcctggaggacactgtgaagcatgggggcaccagctagtggggttgtaaagcccckggatgggtgagtatcagggctaagggctcaagggactctcagggattaaccagaacaattcctcattatacagacacggaaaccaaagcttgagaggttaagtggctgctccaaggtcacttagacataggcctagaaccttaagccttcgttttttgtgttttgtttttttccgccctgcccaccagaaccttaaggcttaagtccccttgtttgttcactccaagcctctgcttttcccaaccttccccagtcctgggctaggcaagggggcctctagcaagagaggccaacatgttctgctgtgcggggctgtgcattgcacaaaagcctgtatttcaccacaaccrtgtgccagcagatggcaatcatgggtttcgagatagtcccctttctctgtacaaaaactctgtatgggttaactaaagcctgagggtgcgaagatcgatgagcatttgtcactcccagcctcctttaaatatatatatatatatataatttgagacagggtctcgctctgtcgctcaggctggagtgcagtggctcaatctcggctcactgcaacctccacctcctgggttcaagcgattctcccacctcagcctcccgagtagctgaaactagaggtgtgcaccaccatacttggctaattttcgttatttttagtagagacggaatttcaccacgttggccaggctggtctggagctcctggtcttatgtgatccgcccgcctcagcctcccaaagtggggattacaggcctgagccaccgcgcccggccactcccagtctcctttaagggtgcggagccttgtctcccggcccctggtgtcccctgacgccccgtccctccatgcacacaggtctatctgttcgagctgcacatcaccgatgcccagcctgccttcactggcrgctaccgctgtgaggtgtccaccaaggacaaatttgamtgctccaacttcaatctcactgtccacrgtgagggggccctggtgtctgtcctgggctcgggctccccatgggtcctggtctcctacctccttttcccaacactaaggaggatgcctcgtcccatccagacatgagtgctggccacgtgcccagtgctgcacacacagggtgtgagagaaaccccaaggcttgcagggtaggcgtgggggcttagggctgartccgggtctcatctgggtgggactctgttttatcatcttggtgtcacggctcctggcccayggcctggcactgtctgaatgtttgggcgatgggtgaaggtgagttgagagatgggtgggaattggggacaataaaccgtcccacctgcctggtaccttgaccctgggaaaggctgggaaggtgagatcctggggcrgatgcccagcctcatggggtcatgaatgggcaagtctstgaatactcagaggccgcccccagggcagggcttctcaaacggccccctctgaagccccttcccccatctctccaccctttgaacccagaggccatgggcacyggagacctggacctcctatcagccttccgccgcacgtgagtggccatcctcagggcctgggggaggccagtgctggagtctgaggcccttcagggtctcgactgggggtcagggctggggatgatttgcggggcggarctgaagtcagtgggggctgcaggggagagcaagcttcccaggcaggtgaggatactgagtctaacccccacaggagcctggctggaggtggtcggcggatcaggtacccctgccccaggccctacctgcaccatccgcagacccccaggggtctgagacgggtgggagcccaatctggctagtgtcccyttctccctscccactccactcccatcctgctcctaatccctttccagtccctcactgcagcctcactgggggtccctctccatagtgatagccatgaggacactgggattctggacttcagctcactgctgaaaaagaggtgagtcctgggtggcagttcctggggcakctggtgaggcctggctccaaatcccagcactgtggtttgccagctgtgtgaccctgagcacaacactgcacctctctgagttggtttccttgtctgtcgaggggatgatcccagtgtggaaggagttaaagggctctgcagacattatgtcccgtcaacagtcatcctcacagtgtcccccacggccactccacacttgaggctgcaaaagctccctccgtaaactccggggacccagaaggaacagagagagggtccccagagctgcagggtctaccaggtcggcccaactgacttatgttctctctgccctctctctccctctcccccggcccctccattatggctgctgctgctgtggcccagagagtaagaatcggggtctgggtgtttgggggcggcagggcgctggtgggtgcagaggggattcccgtcccctctctgagaggctgtggtgagagactcagagcagggtgcggctccccacggacaggggtgagtctctgtgccttgggcttctcctgccacccacctatctgtcagagcttaggagggataagaaaaagtaatgcacacaggaggtcctgccagagcctccggagcagcatgggtgccccacaacacagggagtgcaagtgcggaaaatagggaggaagtaaaggcccatgggtggggtccaggtctttgagggaaggtggccatacctctcatgtgccacctaccctttctcccacccccacccctggagcagcagtttccggaccccgaggtgagtgcccaacatagcacagcamcctcatcacccctaattctgccaggagcccctccagatccccagcccctcttcagctcccttggcccccagtcctgcctggcctgggacccagascagctccagctgccccaccagaagggaaggggcagagggacaggggtggctacagctccttggtcctgggcccaggaagccccgcccagggggctgcagtcttgcccccggccacagcctagactgcgggacacagggactcgaagctggaggcaccagcagaggaggacgtgtgggagatcctacrgcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaasaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaamagagcctggctaatctttctctcaggcaaacaaagcaggakggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccrcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcctgtaatcccagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaacaaaacaaaaagaaatagagacacagagaagtggaagcggggcggcacagaggggattggagggggggacctgggccccagccacagccacagtagcttggcctgggggagcagggtgcgggcggtggggtggycggggctgaggggtggtgctcagcctttcagaagaagctggagccggcctaccaggtgagcaaaggccacaagatccggctgaccgtggaactggctgaccatgacgctgaggtcaaatggctcaagaatggccaggagatccagatgagcggcaggtgcagcctggggtggggaggggggctcgggtggaggtggggacccccatagccttgcctcctgcccctctccacatgmgtatctctgactcggtgtggctctcagccccatctctctgggcctaatttcccatccttttgctcctgccggtccctctctctctctccttttgtctcgggctcacttcctcccgtcgggaacacttcaacggccccttctgttctacagcaagtaagttcccctctggatggcttggggtggggggcacagggattatcayggggcgcactgggcccggaggggtgtccgcagctttcctgccacttccctgcggcccccacccaggtacatctttgagtccatcggtgccaagcgtaccctgaccatcagcyagtgctcattggcggacgacgcagcctaccagtgcgtggtgggtggcgagaagtgtagcacggagctctttgtgaaasgtgggcctgggacctgaggatgtgggaacctggggaggagatggcctcaggggagccaaccctcatgctcaccctgcctggacagagccccctgtgctcatcacgcgccccttggaggaccagctggtgatggtggggcagcgggtggagtttgagtgtgaagtatcggaggagggggcgcaagtcaaatggtgagttccagaagcacggggcatgggtgttgggggcatctgcccagaagaggccacagcacttgccayccacccacccggctaggctgaaggayggggtggagctgacccgggaggagaccttcaaataccrgttcaagaaggacrggcagagacaccacctgatcatcaacgaggccatgctggaggacrcggggcactatgcactgtgcactagcgggggccaggcgctggctgagctcattgtgcagsgtgagcctggctgggggggcacatgaggctttagggcttggacccctcagcccccaccccacctagccctgtaggggagcaggcaaacctgggctcaaggcctctgtgaccttgggcctttgacagcctaaacctcatccttctcatctctaaaatgacgatgctgaggtgaccgctccagagggtactgagagggtcatacgggcctggtgagcatcaccacccctcagacacttgaggttccttatgtgcactgcaccatcacaggcaaacatggcacacacaggcacacgtgttttcacatgcccacatgcacccagacacgtgcgcaccagcgcccatgggcccacacgccctccacagggattcacgccacacccacacaccctcccgagctcaatggctctgccctgccctgcagaaaagaagctggaggtgtaccagagcatcgcagacctgatggtgggcgcaaaggaccaggcggtgttcaaaygtgaggtctcagatgagaatgttcggggtgtgtggctgaagaatgggaaggagctggtgcccgacagccgcataaaggtgtcccacatcgggcggtgagtgtgcagggcaggtggatgggacaggtggagactgagatggagacagagagagacacagggagaaacagagagagagagataaagacaggtggacagagaggcagatgcacagagacaggacagagactgagacagagacccacagagagggagaaacagacagacccaaaaagacaaagagacagaaagacagaaatagttctatagagacagaaagatatgcacagggaggcacacacataggagagttygtcagagacagagaagaacagagggacagagacaaagaggcagcagggagagacacggacggggtcgagmgctccccagcaccctcccccagcttgtgaccagggcagggcaggaggccaccaaggaggccggctctggccagaggccctcactgcctctcccgccctcttgctcatccctggagcaactgggctggcygtgctgggcccaagttcacagagattaatgagacccagcccctgcccagtctccaagggcccagccaaggagatgctttgatgtagaaatcacttttacgctgcctacctctgaaggcacattaaaaagctggaaaattagataatatagaaaaaaaaaggcatttttaaaaatcagaataccaacaagccaggacaaggtgagggcctcctgggaccctggctggggtatctggcaaggccaggggtgtgtggcccagtggggtcccctgagccactgctcccctgcagggtccacaaactgaccattgacgacgtcacacctgccgacgaggctgactacagctttgtgcccgagggcttcgcctgcaacctgtcagccaagctccacttcatgggtgagcctgctccagggtagggtgggtcggggcagtggggccaggarcccctgtcactgggccctgcctttgcccccgtgctacttgctcttccttctcttgcagaggtcaagattgacttcgtacccaggcagggtaagtcttggggcccctgagtcttggttctgctcactttcccgcaacccacccacgcaggcctcccctccactcacagagggaaragsaaggatcaaaaktgggggtcctggggcccagctycagctttgccactcatgaccatgggtcarttataatctctgtgagcctcagtttcctcttctctaaaatgggaaccctgatagtgccacctyataggatagttataaagatgaggtgacatgatgtatcagacctgtcaagtgctgtcacaygtgtgactgttattattacatcttttcttcttcttcctttttttttatttttattttttttgagacggagtctccctctgtcgcccacgctggagagaagtggcgcgatctcggctcactgcaagctcygcctcccaggttcacaccactctcctgcctcagcctcctgagtagctgggactacaggcgcccgccaccatgcccagctaattattttttgtatttttagtagagacggggtttcaccatgttagccaggatggtttcgatctcctgatctcatgatctgcctgcctcggcctcccaaagtgctgggattacaggcgtgagccactgcgtccagactgctttgctttgtttaactgagggcagattcytgatttatttggccagggaaccyttttaatgtgtgcatgtgtgcgtgcatgtgtgcgcgcgtgygtgtgtgtgcatgtgtctgtgtgtgtatgtatatatgtgtgtctgtgtctgtgtgtgtgcgtgtatgtatgtgtatttgtgtctgtgtgcatgtgtgtgtctgtgtgtgcatgtgtgtatgtgtatgtgtgtctgtgtgtatgtgtatatgcgtgtgtgtgtgtgtattgtgtgtgtgtgtatgtgtgtggcaagacactgatgttcccccagttttcaaaatgctatgctaggtgacctgacctgaatattacaagcctcccagccaacgtcctggggtgatgggaatgttccagatcttggttggattaataattgcatgggtgtattcatctgtcagaactcagcctactgtcagatctgagcataaactatacctcaatacaaatctaaaaaaccaataaccaggggcccaggctcttgagcagccccgccccagtgacctgtgctcctcctggctctcccgtttctctgaactacattgtgtcttctgcagaacctcccaagatccacctggactgcccaggccrcataccagacaccattgtggttgtagctggaaataagctacgtctggacgtccctatctctggggaccctgctcccactgtgatctggcagaaggctatcamgcaggtactgtgggtccctcctcagtctccccatctataagatgggtgtgtggaaccagccaagtgctaggacctgctgcacaccccacccacatgtgcacgccctgctgttggctaccccrtgggagagactggtcagggggcaggcaaggtgggcagtgtgggtcagggggtggaagaakcagcagagggscgcttccaggctgagtcagctcctctgctccctacttccctcctgccctgttcccaggggaataaggccccagccaggccagccccagatgccccagaggacacaggtgacagcgatgagtgggtgtttgacaagaaggtgagtgagactgaggtcaggaggaggctcgtttgtctttcatcactttctacctacgtggtgccgagcccttggcgaggtctccatggaggtgccacacttggccgggtgtgttgctgcccccagcagggtccctgtggggccctcacacctcaggcagagggtctctgtgaagtgtgctgatggccatcacaaggatgtggacaccctctcattgccaggaagccctcatgactgggctgctccctggctcccttcatcctaagctgaccttgaccttgaccttgtgctccctctcaactcaggagtagtttctgagacacttttctgccagtgtagctgccggggtcttgctcctgcctggcactgttggttcttctgaaggctggggtcttgaggggtcctcatgatagctcatctgagaggacaggtggttgccccaggtccygtgacaaagctagarcccgagcccctgccctcagtcggtgccacagagatgattttgaactagatgctgacgtggatgcagtcttcccacagrctrtgttccccccatggacccccgggacatctggctgttggcggaggctgcaaggrcctctkgggtctgacttggatctcaccccaactctgcacccccccagctgctgtgtgagaccgagggccgggtccgcgtggagaccaccaaggaccgcagcatcttcacggtcgagggggcagagaaggaagatgagggcgtctacacggtcacagtgaagaamcctgtgggcgaggaccaggtcaacctcacagtcaaggtcatcggtgaggccggccggggtscaagctggagaacacagaggggcagccccaaggagggcccatccgttcgctcattcagccactcgacaaacatcacgggcatgctccctgagccgagcrgcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatggtgaggaaaggcatcccaggcagaggaaactgtgtacaaaggggtggaggagggaaagggccttttgggtgtggagaatgaatgaaacatgtcaggagaggactgggtggggttgggaggatcagagccaggacaggggtgaatatgggcagtgagaagccttaaagggttgacggagggctggcgacatgatcagaaatgcatcctgttgagacccagcctggacaacacagtgagactccatatcactaaaaaaaaaaaaaaaaaaaggaaaagaagaaagaaatgcattctagaaagatctctttggatctgggggtggtgggggcagcctgtggcggttagttggagtgggaaggggacgagcaacgttactcaaggccctgagcggggcagggctgatgtgggtccatcccaccccatccagacgtgccagacgcacctgcggcccccaagatcagcaacgtgggagaggactcctgcacagtacagtgggagccgcctgcctacgatggcgggcagcccatcmtgggtgagtgcaagggcaccggatggaggtgtgagggcgccaaacagatcckagggaaggtggtgtggggatgcctgggttccagaccagagctgccacctcccctgagccaggctacatcctggagcgcaagaagaagaagagctaccggtggatgcrgctgaacttcgacctgattcaggagctgagtcatgaagygcggcgcatgatcgagggcgtggtgtacgagatgcgcgtctacgcggtyaacgccatcggcatgtccaggcccagccctgcctcccagcccttcatgcctatyggtgagcctgcctggcctggtcctgccccccgccccctccccagttaaaaacctccaataatagcaggtgctctgcaggcagccatgctagacactcacatccacagtctcctttcatcctcgactggggatactcagccgcattttacagatgaggaaacaggctccaagcagttaaatgacctgcttgagatctcccagctggttggggtggagctgactctcacactacgccgacccctagttcacgtttcaagcctctctttccatgtctacaaaatgggaataatgacactgcctatctcagagagctgttaggatgatatgggatgaccaggcaggccatctggcatctaacaggtgctcaataaatgttcattgtcccctgttctccacacccttcaacccagggttttcacctatgggatggggcaagggctgtagttagtggaggggtctcaggggcatctgtctgtggaaagagtcctggaccaagactcagagatggcagaggcagctccatggtccccggggggccaactggagtcatccctccctgaagcctcagcttcctcatctgtataatggggtctgagtgggcagaacaggtgttgagactgtggcagggctcaggaggacacctgttcccactagggtgggtgagtccgggggcagctgcctgtggcaagggcaggccaaggacccctgggcccagggatggggcacagcttgggaagatggcaggaatcggggcctgtggggagaagggtccaggcctctcgttttagggactgattcctggtttgttcagttcttagtcaactcacctaatcatacgtgccaggaaattcccatgttttctgtagttttagttttagtttttkttttttttttttttttttgagatrgagtctcgctctgtcacccagactggagtgcagtcctggcgcgatctggggtcactgtaaccttcacctcccaggttcaagcaattctcccacctcagccttctgagtagctgggattacaggcatccaccaccatgcccagctaatttttgtatttttgtagagacggagtttcaccatgttggccaggctggtcttgaactcctgacctcaggtgatcctcccacctcggcctcccaaagtgctgggattacaggcgtgagccaccgtgcctggctgctgttgctgtttgtttttaagccaatytacagacatgtcttgtaacagggacaaaatattccttaaagtggccaaaagccagctgaacaggaagtgccccctatgtgaccagtgggcagttcagagtctagggcatggatctccagcttccccaggcttgctcagacccctctctgacctctcctctgcccaggtccccccagcgaacccacccacctggcagtagaggacgtctctgacaccacggtctccctcaagtggcggcccccagagcgcrtgggagcaggaggcctggatggctacagcgtggagtactgcccagagggctgtgagtgtcccygcccccaacccccctccccaaaggaagaacatgctcaccttgccatygagcagattcacctgtagtcaagttttttaggcccacttttgccgaaagttgaggacacccagagaaatatctgtcctgttttcagaagtaaaaaagcttgcctagtgaaaaacaaatgcagagtaaagctgactgtaacacttctttgagcagtgcgaaatcagcaactacattttaaaaacatatttaaggccaggygcgatggcttacgcctgtaatcccagcactttgggaggccaaggtgggcggatcacctgaggtcgggagttcgagaccagtctgaccaacgtggagaaaccccgtctctactaaaaatacaaaattagccgggtgtggtggtgggcacctgtgatcccagctacgcgggaggctgaggcaggagaatcacttgaactcgggaggcagaagttgcggtgagccaagatcatgccattgcactccagcctgggagacaagagcgaaactccatctcaaaaataaataaacaaataaaaattwaaaaaaacatatttaaatcctggagattcctatcagaggagtgggcagtgggagtggggtgtcagtggtgacacagcctgtgsscttgcctccccctccccacccccaggctcagagtgggtggctgccctgcaggggctgacagagcacacatcgatactggtgaaggacctgcccacgggggcccggctgcttttccgagtgcgggcacacamtatggcagggcctggagcccctgttaccaccacggagccggtgacagtgcaggagatcctgygtgagtgcccctttgtgcagtcacaagacccgccattgacaccccaggcccttggtgtccagtggaggtggggacagttggggaggcccagaatgctctgcccagaaygctgggcagagacaggaggggttggagccatcgtccatgcgctaggcctagggaaaaagtgcagagagggtggccaggcacagtggctcaagcctgtaatcccagcactttaggaggccaaggcaggcagatcacttgaggtcaggagtttgagaccagcctggccaacatagtgaaaccctgtctctactaaaaatacaaaaactagccaggtgtggtggcgcgtgcctgtagtccctcaactacttgggaggctgaggcagaagaatcgcttggacccgggaggtggcagttgcaatgagctgagatcacactattgcactccagtctgggtgacagagtgagacaacgtctcaaaaaaaaaaaaagtgcagaaagggctctcttggtgtatgtcagtcccttagttctggaacagggaaagtaaaagccacagtacccaagctctcttccaggagtgtctcagctccaacaggtaaatattgtctatgtagtcagattggtccctctgggatccacttcccattcctttgttccttgtcccaacaaagggtccatcttttgtaaggattggttctcaaagctggaacgaggcagcaaactcaggtggtaacaacacagggcatagggtgtcaaagcccaggcttacaccctggtctatgacttactagctgtgtgacttcagtcaagttgcttaccctctctgatccctgccttttgaagtggtgaggctcggggaagccagctgggcttgggcagcctggagttgctgtgttagcaggagctaaaggaggcgcagggcccagcaggcagcttttttcttagctgcagctctctgggccttgtctcaagggaggttggagctgtggagcccctcagagctgtggcgggccctcacttagctacccactytatacccacagaacggccacggcttcagctgcccaggcacctgcgccagaccattcagaagaaggtcggggagcctgtgaaccttctcatccctttccaggtgggactggcccccttccctgtcccccaggggagagaggctatagtgtgttgttcccatccagtggactgatgtctcagggctggcctgatctgaggtaccagaggctggggtggcggccggcccttggagtgatccaggttcagggttaagcttttcctcccctcagggcaagcccyrgcctcaggtgacctggaccaaagaggggcagcccctggcaggcgaggaggtgagcatccgcaacagccccacagacaccatcctgttcatccgggccgctygccgcgtgcattcaggcacttaccaggtgacggtgcgcattgagaacatggaggacaaggccacgctggtgctgyaggttgttggtgcgtggccaaggcctccttgagcccccttgtttcccttccctgggctgggctgctggggccaagggtggggccaggggayccaacccacagctcacattttccagtccactgccccagcaggcctggccctggttggcaggggtggggtggtccctggagccagtgaccccctgctcactgtcaggaggcgtggtgacccractgggtctgtctcccgcagacaagccaagtcctccccaggatctccgggtgactgacgcctggggtcttaatgtggctctggagtggaagccaccccaggatgtcggcaacacgkarctctgggggtacacagtgcagaaagccgacaagaagaccatggtgagcccagggtctggggtccccacgtgcaccctgcctaggcccggcagacccaggccgcagctacccttcactgtcctcaccgtggacccctcaccctccctctgctgatctgaatccctccatagtaggggtggagatgccaagggcacccaggagaggctctcggcatcaggaagggcctggcccagagatgcctcccctccctccctgcccccaggagtggttcaccrtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggtgctgtaccctcattcttccaaccaggggctggggcagggaggctgtgggaacagggagaggggcctagctttgtgtggccctctcggtaccaagtcctgtcaccaacaggcatcacctatgagccacccaactataaggccctggacttctccgaggccccaagcttcacccagcccctggtgaaccgctcggtcatcgcgggctacactgctatgctctgctgtgctgtccggggtagccccaaggtagggaactttaggcgctggtccaggccgaccaggaggcagggctcayaggccccgacgttgagcagtcctctccccagcctgtctcccctgctttctctccaccttggggtgtatggaccgggttcctccccctgggcagggccatggtactcactcttggttccatgtttgtttccagccttgggcatagtcagggactctcgtgggaccccccragtagaaacacagatgtgtctccctgggtccctgccaggtcccctctcagcctggatggcttccctccctctctttaccttatttatagcccaagatttcctggttcaagaatggcctggacctgggagaagacgcccgcttccgcatgttcagcaagyagggagtgttgactctggagattagaaagccctgcccctttgacgggggcatctatgtctgcagggccaccaacttacagggcgaggcacggtgtgagtgccgcctggaggtgcgaggtgaggagccctcggggccagggcctgggagatgggaagagcgggcggcagtggggaccctgggctttgctccgttgtcctcggccaagcacctgccctggctgcaagggcacggaccctgccaygcccagatgggcaatagcttccagaaggctgggaggacacagtgacatggcctcctcttctgcagtgcctcagtgaccaggctggctcctggggatggccaggtatgtaccacccgacacccagggcacaagtcagtggctgagccctggcccttggtcctggggcagccatcagtaaatgggaggmtgtaggggccctccattcactcgtaagataacctgtgttgcaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaatttcggtgtgcctgttttcataaaaatgcacaggggatggccaggtgcggtggctcatgcctgttatcccagcactttgggaggcggaggcgggccgatcacctgaggtcaggagatcaagaccagcctggccaacatggtgaaaccccgtctctactaaaaatacaaaaattagctgggcaaggtggcgcgcctataatcccagctatttggaaggctgaggcaggagaatcacctgaacccaggaggtagagtttgaggtgggccgagatcatgccactgcacttcagcctgggtgatggagtgagaccatgtctcaaaaaaaaaaaaagaaaaaagcccagggacattgatcttcacagcaaagtgagagcagatactgttttttgttttgttttcccgatgattaaaccaggcccagagtggtttctgagttcataaaacattaacgctagaaggaacctgtcttcccctacagcattcactcttcagatgatgaaactgagctgtgacagcggaaagtgcatttaactggtcccaggtgctcagcgtgatccttgtgccaggggccgtggtcacaaccgcctggaggtggggtgaggcagaatctcagtgttgtgattgtgctggggtggagctgcactaggtggctttggagtcccagccagcaataagccagcagcgggttcagacccatatccccggtgggagacagcaacccaatccagtccaggacgctgggcaccagaaaggtgtcagggccagggccccactctgctctcacttcccccatggggagcctaaatccgagcatctgtttccttttgggcgcgggaagccagcaggtctcaaattccctgagagtgcagccaggtttttccaggacagaattccatgaaggcagctcctaggggagcttctgggagttctatgcagtggaagacactcctggccaggagtccggggccctgtgggaggccctggctgaatcaccacacctctctcgaccatacccacctgtaagggaacggagagggccagggccttggctttctttcacttaatctcagttcaggtgaggacgcccagtctggctgctccctctagcagcctgttcattcatggcagcccagctctctgcagggccctcaggtgcccaggaaggaaagctcctcccgcagccttgctctaggagcccagaacaggggagctggggcctccgtgtgccaaagcttggacatggatgacctcatctccttccttccttccagcctgaggtgactttttagagtccagggatagctttcctcaggcctgagccaagaggaggtgtcatttaacacaaggcagccagggagcctgaagggagttgaggacatttatttcacattcacacaactgtacattttctataaataatgtggggctgaaatatttacagtcatttcttgcccatacccaggctgtctctccctcctgacaccccgtgcctggagagacagcctgcagacagatgtgcaaacccagcttggtctttcctgccccctccctgatgctcaggcagagcagccagcggtccctgggactccactagcctcgaccactccatcctctgatgccgaaggcgtggcaggccacagggaattcgccgctccactgcagtcacagaggctgtggcaggcagcagccaacactgcgggccctgggcagtagctgccggcttgggaatgcagaaggaagcagggaggctgccactcactccggctgccccccaattcttcccttcctctctgtgcccttcctctgagagggtgagccccagggttccctcactcctcacagagtgaaactgctccaggcgcccagtcatgccgggtcacagagaagggagagccagactcttgcagtggacagttataacgccagggacaaggacaaggaaccacaacacaaatgtctcaaggacacaaaatagtgggttcacaccggccccacagactgtacacattcttgagccctgaggggaaggcagtttggtcttctgggagtggagagggagaaggtggacacgctcaagacacactcagagggacacataaccggtaaccaaccaagccacagcagggggcttgcagaggacacacgagcatcatccactcctcagtcacagcagcatcgtgcacttgggaacagcaaggggccaggggcgtgccctgggctggggcagctgcgtagcccctctccatcagctagagacaggccggggcggggttctgagatcttcctcactgctatgaactgcagccacgtacgagaagagacataatacggagtagcagatttcgtgggcctagaggagagaaaaccaggcggatcacgatactgagactcctccatctccatatgtgaaggatctgccaatgggcaactcctgccctaacactgggcatgggcctctgggctaaacgtgagctccaagcaaggaagctgtccccatgggagaggggatccgtgtgtgtgtgtctgtctctcagggctcaagacctgtttcagcctgagttgaacctttggcaacaaaacgaggtccccactcacccctgtgcgctcagagggccctcccctcctcctgtccgaaggtcccccagggagccctgcgcaccgtggcccatcagggttgagcggcacactcaccattggtgtcttgtacttgtggctcaccacttctttaatttcaggaactaaaaccggacgggcaagagacaaaacagaaagttcaacactaagagcaatcgtgccatgctcccccaggcggcagcgcccggcgtcagggtccccttcccctctgtggcctctcacagtggctgcagcagcttaggctatgacagggcagaggccaccagaggctctgtccagactctgccagctgggaggacatggccctagcctcctcagctaggcctctgtcatccgcagtggcgtttacttgatggccgtgattctacccacttctttgaaagccctggatgggagggacgggcctttcaccagcctggtcacagctactgtccagggcccctgaggagctgcagtggggaattcccaggttttggctgggaggagagagctctctctagcttgtgtccaactttgctgagacacccgtgaactcgtcaccagcctgaaaattgggtcatgttaaacacagttcccgttattcccagccccctacacagagggtcttgaggctggatgaagaggtaacatgatataaacccacaggatgtggcagtgtccttccctgagtggcaggagaagcccagacctgcctgtgtgagggagagcgtctgagggctctggagcaacacacccagcagaagacaggcgagtacagcacccagggagggaggtgacagggagcatcaggcaaaatacacacatgtccacagcccagaaggcaagagtgagagtccccccgctccagccatgcaggggttctgcttggccagaggaaggagtaggccccccaggctcagccaccatcatggccccttgagactgggagcagaggggcctggcatctccctgggggccagaaaaggcaggaggagaattggccgtaccttcttctgaccctgggaggtagaatttgggggaacccagggtcagcagggaataaactcatcaaaggtagagcaagaagccccaggccattctcccgagttggaagattcccccaagtatctctctgacagaagagagaagggaacacacggggaggaaagtccagtgagccggtgagaagggggaggcaaggtaggaagaaagagggtaggggagaaaggaagagacgagctggcagtgtgaggagctggttcgatgggagctacccacccagggcagggcccaaggcagagacctggggagaggcagcacgagccgaggtcactttacctgctggagaacgaaggttttcatagcagcgatgaggggcacaaaagaatgaagcacaaacacagcaggaactcaaagccccagggtgagaacccactacaccactccctagcgctggctcccagcttccggctacagctgtcccgctagactcctctgtccctcaagtgagtctgcctgcgacgcccggtgcccctttgtctggcacagaggccaggtggagaccagagcggcgccagggaggctggctagcgcactgggctgctagagagattgcagcaggtgacatggacatagtggagcttgggggtcgccagtctgctgtgtcccaaactttctgaccactggctggcccagcacggggaggtggtgctacttcactgagctgcttcaggaccacctctaaactcgaaacccacctgaggccccatttgctcttctgcgatccattatctatctttcccttccacatcccggctctcatctcaggggtcccttttcttccttgtcactcctgctcctcctgacttctctacagaggttcttcttctccctgcccctagaccctcctctggagctccgaggtttgagttactgccatgtgagtccagacctaagagcaaaatagtgtaattaccaaattcctccaggacaaagacgcctcgaactgtattgcactttttaatgtgattcagctctatgaaaacctgcaagagagggagggaggccggggtaaggcccacaggctccacccctgccccacacagcacactctcccagctacagccccacccacacaaagaaagtctatttcccaaagagaggacagaagaatccacacgcacacaactcaaaagcgctaagaagcgaagatagcagaaagggcatgtaccttccgctcctggccggaggagaaagcatgggagagaaatgaaggcgttagtttgaatggtcaaacccaacccgaaggccctgctgctggcctgggctgcccgcccgtaccctctgcccagggcagtgcttgtaagacacagtgccccaggggtccccactcagcccattaggtctctacccttccatgcatcctcctccggcgcagagggctggcacgggcgcaaagctcccctcagactgtcctcagggtgggaggtgttggtatcctccttgaaacaggatccaggatctcccaagaggtatgtggtgataataatatcagctaccacttgctgagcacctacttggggttttacaaatacgatttctaatctctgcacctactacgtgacacagtaaatagtattacccccattttctacatgaggaaactatggatcagaaagtttctttgcccatgaacgtggaagctgggcttcaaatccaagcatgtcctcacaccgaagcctgtgcttttcccatttaccccagactgcacagctccaccaggaggtctgctgcctcctccactccaactgaacactgtgtggcagaatagggggcaggtcgctatctcattactaactgtgaggtgagattgagaacccgggctttcctccccttctctgcagtctatcttctaggggccaagccttcaaccacagactggcttggatggctgcccagtggggctatgccaagggcaggacgaggaacagggcagagcacctgggcgttgctcagcaagatctcatcttcagaggccacggcgctaaaatgtggtcagaagtctgctccccaagaagtactgacacctttgtggtccagaaaagcacttaggtagacccctctctgggatggtcctaaggtctttggggttggctactgccctaagtcctaaattgaaaatatactaaggggctgctggcagcctgcgcagccatttcctgttaaaccaaagctgcccagctacgttcctgaaagagagctacaacggctagcggagggagggagacagccacgtcagtcaggcatccacctcccctgagggtctgcggcctggccagggtctgtggggcttcacacatttgggtctggctcagagcctcaggg

SEQ ID NO: 17867 - DNA, 27403 bp, Homo sapiens
actcctttaatgtccatctactaaactcatctgtgtgcttgcttgcttgctttttttttttttttttttgagacagagtctcactctgtcattcaggctggagtgcactggcaccatcatgactcactgcagccatcatggctcacagcagccttaacctcccaggctcaagctatcctcccacctcagcctcccaagtagctgagaccacaggaacgcaccaccatgcctggctaatttttaaaaatttttatagaaatggggtctcggccaggcgcagtggctcatgcctataatcccagcactttgggaggccgaggcaggcgcatcacgaggtcaggagttccagaccagcctaaccaacatggtgaaaccccgtctctactaaaaatacaaaaaaattaaaaaaattagcagggggtggtggtgcgtgcctgtaatcccagctacttaggaggctgaggcaggagaatggcttgaacccgggaggcggaggttgcagtgagatgagattgcaccattgcactccagcctgggtgacagagcaagactccacctcaaaaaaaaaagaactgaggtctccctttgttgcccaggctggtgtcaaactcctggcaccgaggatccacctgcttctccttccaaaagcattgggattacagacatgagccaccatgcccggcctgtgtgcttttcagaatatcatagtcaacactgaattgtgtgtgatactgagaaagaggtgaagtatcataactgaaaatgcaaatgatgcagaaataacatctgctgcaaacttgtatcaatggcaggagaaacttcagtgccatttgtagatgatgacactatggccctgagctcccacatggagccagtgaatttcagtggtctcacttccatcccattcctactttccctctttacgttcgaaaatgtgtttattatacatgtatctgttattctaaaaaatttccttcaaatagaataagaaatcaaactcaaaacagctgcaggagatggaggtgtatctggtgtttctctccatctcccttctcccagaggaggacctcaggacctgtagctctctccagcttctcccaggagaaaggaggatattaaaggagtggttgcaagagggcttcccagcaccaacattaaacaagggaaatgcagtcccatgccaaggctgtaatcatacacagcaggagcaacctggtgaagaccaagcaggcagggtctggcaaagtagctaggccatcaggcagagtgcagatccacccccaggatacagaagagaccctgtcacaagaccccacattcacattaagacagctaagatgcagacttctgctgcctttgaaccaaaccaaaccaaaccaaacccactcccagctgagcacacccactattagaagcatccccacactcactgtgagccccactgacctccagggatttgggctgtgggtgtctgtggaacccgagtggaacctctgctccagcagctggggctttgtttcacttaatcaaatctttaaatgttatagagatgagacaattattatatttgctttctcacccttttctaccctcagttccactcaccccaccctgaaaactagtttttattcaagataaaacttacattctttgttttctatccataccatttcttcagaatccattttggtcaaaaataatttaaactccactggttgcaccagacacatttcaatataacttcccaattttaaaactttactatcaacaaattcaattttctttagaaaaggagatttttaaaattctacttagactgggcacagtggctcatacctataatccaaggggatttaggaggccaaaacaagtaaattccttgggcccaggagtttgacaccagcctgggcaaaatagtgagactccatgtctaaaataaaaaatttttttttagttagacaagcaagatggcacattcctgtggtcccagctactcaggaggctgagattagaaggatcgtttgggaagctgaggctgtagtaagccatgatcacagtattgcacttcaatctaggtgacagagaaaaactctatcttgaaaaaaaaagtgtattaattaataaaataccatatcaatatacgaaataatgacaatttagaagggttagtgattgcttgggtggtaactgaaactgactttggaaatctcactctcaagtcacacacgtgcttttcttttgctttcagttcctccttactccaccctggttttctacctcattgaggcttccagtccctaaactctatttttctaaagacttatttttcaactctctctcagtttcagtctttcatgttatcaaactgcaacacacacttatcacccactgaccatggtttcattggagctttccaacctcctcatcatttttgctaacttgaatcattctccaacctggaactggagaacatttacagaaataagctaatagtttagttgtctcccctcactgaataccaccttccccccagaaagccctcttatcactatattatggacagagaacctcagaggagctactccatttgcccaagtcctcctctaggaaagggtagaactggaatttgaaccccactacatgcactggcccttgcctcccacctcctcggctcctgtccaggtttgacagcaagtctggaggaaatacaggaacaaagcacttaactgcactgggcattgccatcgccacctgattgccttaacctggctcctctctctttccattcctagtcctagaaacttttaaaggatcctctgagtgtctgacaatcaccagggcccatagagctcagaaaatgccctcccatgactccacttctgcaaatcctccaaagctgcttctttggaataagctacaaggttaacaaactattgttttttcagaaataggattataaaatgtgagaacacaatgcactattttgaaacattgaaaataccatatctggcccggcacggtggctcactcttgtaatcccagcactttgggaggctgaggcaggtggatcacttgaggtcaggagttcgagaacagcctggccaatatggtgaaaccccgtctctactaaaaatacaaaaattagccgggcgtggtggcacgcacttgtagtcccaactactcgggaggctgagacaggagaattgcttgaacccaggaggcagaggttgcagtgagtgaagatcatgccattgcactccagcctgggcattacagcaaaatgctgtcaaaaaaaaaaaaaggagagagagagaaaagagaaagaaagagagagagaaagaaagaaagagaaagagaaagaaagaaagaaagaaagaaagaaagaaagaaagaaagaaagaaagaaagaaagaaaagagaaagaaagaaagagaaagaaagaaagaaaataccatatctaagggatatacatctctgctgctaattcaagttggtttatagaatatgtgtttctgggccaggcgtggtggcttacgtctgtaatcccaacattttgggaggctaaagctcgcagatcacttgaggtcaggaggtcgagaccagcctggccaacacagtgaaaccccatctctactaaacatacaaaaataagccaggcatggtggtacacacctgtaatcccagctacttgggatgctgaggcaggagaatcacttgaacccaggaggcagaggttgcagtaagccaagatcgtgccactgcactccagcctaggccacagagcaacactctgtctcaaaaaaaaaaaaagaaaagaaaagaaaagaaaagaaaaagaatatgtatttctagggtaattacagtttctggttcactcatcactctgtatttatttccattctacaataaattctggcaaacaagaggcttctccattgtcattaatttctcaggggatatcttagaaatatcctacaagtagaaacagactttggttttgaaatttgtcaggaataactgtcagaactgtaagagtccaagcagtgcatgtggcaccttacaattatcttcatattcttctagaaaaccacagcaattaaataactttcacagagtccaaagagacatgccacagaggtcaaggcacctgtcatctgacttcaggctcctggatctccaaacctcttcctgcgcaaactccacagccaaaagaacacaggtaccccacgtggcacaagcagccttcttctaaaagatttcagaaaattaaataagcactagcatcatacctgtaggctaactacatgcccttcatgcaaatacaatctaactttatttttttgaggcagcatctccatctgtcaccttggctggagtgatgtggctcactgcagcctcagcttcctgggctcaagctatcctctctcttcagcttaccaaattgttgggactacaggtgcacaccaccacatccagctaatttttaattttttatagagacagggtcttgctaattgcccaggctggtcttgaacttctggactcaagcaatcctcccatcttggcctcccaaatttctcggattacaggcataaaccactcactcaaaccacaatctaattttttgctctacaggcttccattctactcagttactttctacttagcactttagatgtttttatcctcatttttacaactatcccttgatattttctatgtatgtttcaaaggccacaaagaggttaatgtaaccattctcccaggctcccctgataaagctgaactttaaatttaggttttctgaaggccaagtccaaggaaatcttctacataggaaaaaaacaatcaacccaagaagaaaggtgtaaaacatcagccaggaaggacgtccagcctttcccatgccattgtccctgttgttcttgggggaacctccctccgcattagcagaatatgatcagctattctagcttcccaggaagtgtgcatgaggcctttctaattaatgtacttgttaaaaacataaactcattaaatggtactacttattctgaatttgtgttaattactcaaactatagctcattaataaagacagtttattatagacctaatccttatttttcaactgctgtcaatcccacatttcaaatcagaaagtgggatttgtagccaccattgcatctgtctactttgctactttcagttcaccatccacgtctaccctcattttaactggacttacaataggtaaagatgagaaaggagattcaatgctgaattacacaaaagtttagaaaaatggtttaaacattgcagctttgttctatattctaggaatctcgttccattatgaatatccaaaccacctcccctcaggccataatgccttgcacctaacaggtgcttaaatatgtatatttgtgcaacaaaacccaaaatgaacccaatttttgttttttctttttctttttctttttttttttttttttttttttttttgagacagagtctcactctgtcacccaggctggaatacagtggcaagatctcagctcactgcagcctcctcctccctggttcaaacaattcttatgcctcagctgggactacaggcgcacaccaccactcctgactaatttttgtatttttagtagagaaaacgcttcaccattttggccaggctggtcttgaactcctgacctcaggtgatctgcccgcctcggcctcccaaagtgctgggattacaggcgtgagccactgcgcctgactccaattttctaaatctgaaaaattgctctgaaattagttaacctgggaggcctatcttatttgaggagctctcaaccaaggagaaacctcaagtcactctacacttgatcctgagatctcatatggctccctagtgtattctagaacagttgcttctcaaattctgatgtgaacaagagttgccttggaatcctgcctactgcagattacagtgctgcaggtctggagtggggctgagacttcgcgtcttaacaagctgctctcagttgatgctgatcctcatggtaccttggttcccagaccccattttaagcagcaaggctgcagaaaayagatgccctaggttaaatatgggggagtcctctccatggccaggcctggtaccagcgcccacaccaattctggatagctctttcccatctgttatcttcttttcacacgtggaaaaaaccttgcgccatggatctgaggatgcagcacacaatcctctgtagggaagctccaaattagacccctagtggaggaaaatttagatcaacagggacaggacccacctcagtgtggagttaggtttaaccacaaagtcttagacatttattattcatttcactttactttgaggaaggactcgttattggttgctctgtacatgttaaaagtcaaggatggggccaggtatggtggctcacgcctgtaatcccarcactttgggaagccaaggcaggtrgatcacaaagtcaggagttcgagaccagcctggccaacrtggtgaaaccctgtcactactaaaaatacaaaaattagccaggcatggtggcaggtgcctgtaatcccagctacttgggaggctgagggaggagaatcgcttgaacacgggaggcagaggttgcagtgagctgagatcgcgccattgcactccagcctgggcaacagagcaagactctgcctcaagaaaaaaacctcaaggatgggtaacgatcaatgactttgcacagaatcaagggcccataatggcacactgtttctttgtttaaaatatcaggacccagaggagaaagagagctcatgtaccatttggcatgggmtacacagtgatccatagtaccttctaatgtggatgcagaacttttaacatataagactttgacatgatgttggaatcatggtctgttaaaatatgaagctaaattggtgttccaggcattgtatgggttgcatacatattggcatgcacacacatacacacaatgcacacactattaaacttctggcaarcaatgacttttgacccaagcagagagaatttggaaactgaaaggaggcaagagagggtgagtcacagttaacatcaatcaaaggtccagtgtcaagccaggctcaacagcaaagtctacatatttggctccaggacaaaacatgatacttgatctcaacttcttttctgttgacctcaaataaagttttcagtttccgaacattggaatactccctctgagtctaccagtctatgttggacagacaagaacacctgtttagttctaattttttctttctttctttctttyttttttttttttttttgagaygaagtttcactcttgttgcccaggctggagtgcaatggcgatcttggctcactgcaacctccaccttccaggtacaaacaattctcctgactcagcctcccgagtagctgggactacaggcacacgccaccaccatgcccgcctaatttttgtatttttagtagagatggggtttcgccatgttgaccagtctggtctcaaactcctgacctcagatgatccacccacctcggcctcccaaagtgctgggattacaggcgtgagtcaccacacccagcctagttctaatttttacatagaagaagacttcttaaaataattacgggtttttatttcattcaaaagcactaagaggccaggagcggtggctcacgcctataattccagaacttttggaggctgaggcgggcrggtcacttgaggccaggagtttgagaccagcccagccaacatggcaaaaccccgtctctactaaaaatacaaaaattagccaggcgtggtggtgcacacctgtaatcccagttacttaggaggctaaggcaggaggatctcttgaacccaggaggcggaggttgcagtgagccaagatcatgccactgcactccagcctgggtgagagagagagagagagagagagagagaaagagaaaggaaggaaggaaggaaggaaggaaggaaggaaggaaggaaggaaggaaggaactaagagaactcaatagcactctgtcagagcatcattatccaaggaaacaatcaaagtgactacataagatatgtgaacgtgacttacgcacctttgtttttctcctactagagttagttttatgtaaaaacttaaatgatcaaagatattaggtatcctgcattcacaattacttacaaaaactgtgcctgggaaaggagcccagtgatcacttgttcactgtgtgtgtctgggaaaaagtacatagataatatataagtactatataaataawtttttttttttttttgagatggaatatcgctctgtcacccaggctggagtgcagtggcgcgatcttggctcactgcaagttctgcctccctggttcatgccattctcctgcctcagcctcctgagtagctgggactacaagtgcctgccaccacgcccagctaattttttgtatttttagtagagacggggtttcaccgtgttagccaggatggtctccatctcctgacctcatgatccacccrccttggcctcccaaagtgctgggattacaagtgtgagccaccacacccagccaataaatgctttcttaaagcaatttacagaattctattttayagtaaaaatgaattttcagcagtacagtgttcacagtgagattggattttattaaattatatatgatagaaaaaatgttacttatakgtataaagtaaaataaacgtgattggcatttttaaacaaaatttttaaaataaaggtatacaatatgcccagattacataattcaaaaagtgcatgccactcaacaatgctggcacttaaaagactattttggaaaatgtaaggttatacctgtgtgacaacgatctgtgggcatggctttatcctccgactcttcagctgtgaaagatgttgtcacttgtgtattggcacaaatccatcctgggttagtcgttgactactccaacacccacttcaggctttatagccaagggcaactttaaataaacatttaaacatccyaagtggtcaattcaatgacacccctcacaggtccaatgtatgacaatgctgttgaatgtgcctcttcatttcagcacactgccttcaggcaggtaagtgttttattagatctttttccagaactgcaaccactcctgctctctcatcaccctttaacacaatcctcacgtcctcctctcgccrcaagcacatgggagaatgggaggaattacagaaaacaggaaggcaagctcactgcctcacaaaagattccttggtggaagactttcccagttcccttcygcagaaacaatgaaggtctgaggacatggggttatcatcaatctcttcattacagtcactcatctcagagaccagcattgcaactggagggcagctgctcccattcgagagtcacctggggcgaccaggaccccagaactctgctagagtctcacagtgctcacaatggcacttagccttggctgccatcagccttccaggctccttatgcagttcagaaacatgtgtttggaagtaagaaaggcactagggccgggcgtggtggctcacacttgtaatcccaacactttgggaggctgaggcaggtggatcacgaggtcaggagttcaagaccagcctggccaatgtggtgaaaccctgtctgtactaaaaatgcaaaaattagccgggtgtggtgccgggcacttgtagtcccagctactcaagagactgaggcaggagaatcacctgaacccaggaggcagaggttgcagtaaaccaagatcgtgccactgccctccagtctgggcaacagggcaagacttcgaaagaaagaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaggaaagaaggaaggaaggaaggaaggaaggaaggaaggaaggaaggaaggaaagcaagcaagcaagcgagagagagagaaagaaagaaacaaacaaagaaacaaagaagaaagaaagaaagagaagaaagtgagaaagagaagaaagagagaaaggaaggaaggatggaaggaaggaaggagagagagagagaaagaaagaagaaggaaagaaagaaagaaagaaaggaaagaaggagggaaggcaggcaggcaggcactgacacctggtttcaggtgactttaaaaggracctattctgagagactccgtttcacaggagcttctttcagtgtggccagggccctctaggatctcaytgccctttcctccgtctcctcccagcctccctgcacttgctgtcctccagccattccttgccatttcttttcaaaggcacgcycctrcctcagggcctttgcacttactgtcttcccccacaaatagccctgttgctcactcccctcatatcstctggtctctgctcagatgctgccctatcagagagaatctcctgacacaaccactctcccctttccttttctttcagggaatgggccactcctggcaycctgcacattttagcatttgtttcctgtctctccccactagaatgcawgctgcagaggaattgtatccrtagcacctggtaagtgctcaatgaccactttttcaaggaccacatttccataatattaaaatgtattatgagagggaagagcagtgaattttcctgttatctgcactggccacgtgttgcctgagcatgtgcctytatgtgtgtaattgagtctctctgtgcctcactttccttrtctgttaaatgggagttacaatattatcacctccacaaagttatggaaattaaatcacaggtggggattgtgcctggcaggcagcaagcactcggtaagtgttagctatctgatattaactattattttgctatggatatgggtgtggaccatgtaaaaatgcaaggcttcaaaagtagacaacaacctgcttcaaaagtagacaacaacctacttcaaaagtaggtataaacacttggggttcatacctaatgtgccacgagatgggctttggaccttccagatctgagccacctttgggagggtcgcgtgaagggaagctaggcactcctgctcagcatgattggcaaggtccttatgccagcactagtgcccagaaagtgcaggcagttccagctgttgccacaactgctgcctagacaattggcctatcagggcagtgttgggggaccagggrttgcaagagaaccagcttttaaaaacagcattgaagataaaatggcaaataaagactaaaagttttcagaatccttgtctcagaaggttctaggctgatctgaaggttctgaaacacagacatgagtcttgtcttgcttgaacttatcctgtttttcactttccttgacaactagaagttattttatttaccatataaatacttttccaatgctgtctaaaaccatgcttgtaattaatatatctggaaacaacaattaataaatgatgtgtgtattactttaaaataaaaataaaggtttctatgtaatttccgtaattaaggagattaatatcttacttaacagacttacatccagaactgctctcagaactgttgtcctgtcttaaatgaaaacaaaggtcaggaaatgcacacactgaataaagagtagaaatgatttattttaaaaatcatacattttgtaaaasagatccaaactcaattaatttcttttctaaattctccctgagtccacaaccagtctgtttcacatcaaaggagcctgttcrtctttgaaaatggataaaagagaatttaattgtttgaatttgagctcaaatcacaagtctggctttaatactaatttcatttggtgtcacccaagtcctacccagccttgactcggccctgctcctccagtcttacccctctacccacacatctagaaggctsacatgcacgacttcaatgatacaaccttgcagaaagctggagtgggaatgccatttctccattggccttctcgttcttctctgtcatcccacctccarctgctaacgccccaggccycactgcccactcccagcctcctttccacgttgagagcccagggagggcatctaacctactccccaatctgcaaatctaatctccacccccagaagcacccracgtctctcctactcgacctcacaggtgcgccccatgcacagtcctgcccagcacaagcacatggcctcactcccacgtctccttatttccctgacacagcctcaccctccactcaggctcaggattaaatgaggaaatatagggaaagatatgaacactattctcaaatctttccctccctccatataactatagacaaccagaaccaaggatcggcagttgttacatggaggaaggaaaaagatttgaactaatgaaaagaacaataataatagcagctaatagcggcatattttttttcttttttgagacaagatctcactatgttgcccaggctgaactcaaagaactcctgggctcaagagatcctcctgacttagcctcagaagtagctggaactgcaggtgggcaccaccgcacatggctaatagcagatttttgtgagtgcccactatgtggtaggcactgtctatatattctcatatacacatatgactaatatgcatatacttgtgtgtgtctacataagcacaaacacttcgcatatatctcaataatgggggtggggctcagctaaccagttgaaggctttaagagcaaaaattgaggttttagagggaaggaattctgccgcgactttagcatcaattcttgcacatttcctgcctgtcctgyacatttcagacttgccagtccccacaatcacacaggccaattccttgaaatgaatcttttctatatcttacatacaaatgcatatgtttctctagagaaccctgatacatacaggggaaatctgaaaatggattatctgcggcagcaggaggaagaaaaagagaggcacaagtggccctgtgatggttaatattatgtgtcggcttgactggcctgcagcacctgaaccctgccaggcaccaggaggcttcagggagaacacgagcttgctcagataatgaggtcaagtcctctaagcccctctgccctgcaccaggtaaaagatcagaacaggacagtgggaagggcccggagaagcatctgcacctgactccccaggggcaaggtgggctggaggtaggtgacaaggtttggctcccaaacrggcactggccaaaaacaaatggaccagcagggccaagtgacatggcagaagaccaggtgggkgactcggtcamcactttcaaacatccccaaagttatagtaagcatcaagagaccacttactagagtctcactgttaagagtaaaaagagattgtgtatgcaaacaattagaaaaatcagaaataactaatgtttaaacaaaacctaacaccgtaatacttcaagacctttgggctcatagtctgcctgacwcataggaagtggacaggatggctcagagcactgtcaaggacctcacttgacctcctgcaagtcagttcttctcaggacaaagtggacttttccacaagtttgcctttagcaatattataataaactgcacttcaactgtcttgaacaaactcacagctccacaccaatgcagtcttaaaaatgagactggccagtggctcacacctgtcatctcagcactttgcgaggccgaggtgggtggatcacctgaggttgggagttcgagaccagcctgaccaaaatggagaaaccccatctctactaaaaatacaaaattagctgggcatggtggtgcatgcctgtaatcccagctactcaggaggctgaggcaggagaatcgcttgagcccyrgaagcggaggttgcggtgagccaagatcaagccattgcactccagcctgggcaacaagagtaaaactctgtctcaaaaaaaaaaaagagacaggcatcccacatcaatgcttccaaggtgtgtacccttttgatctggcaattctgcctagaaggtcatctgaggaagtggccaggagagcacaaacacacacatttacagatgctcatcacagtgtcactttgagracttaaacagaaactctgtgagttataagatcattgaagagctgtgactttaacctctccaccttacttcctccctagattcctctaggaacagaaaaatacagattcctcaagaactattagaatacatacataaaacttactgacacggaagatgcccacttcatatgcggtgtgcgtcatggccccattgtagagccttctttcattttaaacagcattactggccrggcacggtggctcatgcctgtaatcccagaactttgggaggccaaggcaggtaaatcacctgaggtcaggagttcaagaccagcctgaccaacatggtgaaaccctgtctctactaaaaatataaaaagttggcggggcgcggcggctcacacctgtaatcccagcacattgggaggccgaggcagcggatcacgaggtcaggagattgagaccatcctggctaacatggtgaaaccccgtatttactaaaatacaaaaaattagcgggtgtggtggtgggcgcctgtagtcccagctactcgggaggctgaggcaggagaatggcatgaayccggraagcagagcctgcagtgagccaagatcccgccactgcactccagcctgggggacagagcaagactctgtctcaaaaaaaacaaaacaacaacaacaaaaaagttagccgggcgttgtggtgcatgcctgtaatcccagctactcgggaggctgaggcaggagaattgcttgaatctgggaggcagaggttgcagaaagcggagatcgcaacattggactccagcctggtcaagaagagcaaaactccatctcaaataataataataataataataaaataataaataaamagcattactgtggctggccacacaggagcctcctagaagagtctacagcattgtgaggtgttcattatctttgggcagaaggaatacatgtgatctttattttcttctttcttcttacattactctacattttctgaacttttgcaaatcatataaataacttagaaatcacaataaacaaagctattgttgtgcatctgcaggtgtctcctaaatgttataagccctaagattacccataagggtaattgagagtactgagaggcttcaatatcatcaaattcataattacatcaaacaatatatttatgaatagaygtatttccaaaacaggccccctcaccttttctagagctaagattttgatccataaagacttacttctccattgccttcaattagaccaacctgcagaaaataataataataataagtacaatatctagaagaactgcaaggcaaatgttagcaaaatcatccttgtcaaatgtttctataaaatatcagaagcagatacatgactgacatgcaaactccaccaacaaccagaagaacgcctaagtctttggagcaatgctgaaactgtggttacttccagttaccaaaatgccacactctcctagaaaatggttatgacttggagaatccattaaaaatcaagaaagttttcataacagaggaacattttcaaaaaaatagaatgttaaatgaaaagtagcatatgtttataatacagaatatgaacacatagtcaagcatcctaagaaggaatcttacaggaattgtcagccttatctggcttctccagaaatgcaagaccttccattctgtccctattctaagggaaatgtcagttcccaggggcagggctcttccacggatccacaacctaagaggaagcctcagaggcacaggctctgggagtaccaggtggcagcttcaacccagaagcgcactcgagtgcagtgcrcttgaactctccaggtcaactgtggaaggccccttagctcaggcagtgggatgggtgataggaatgggtttattgacttcatagagtataaaataaacaattcaaatacacccaaatgcactctttcataaaagaaackgaagtaacaaattctgaccccatgatgagaccccagataaacgttaggggtcaccaggggtgaagggaactggcaacaagtcaggtggccaagactcaaagcctgccaagaccactgggcacttttttggacttcctgaaaactccacrtkcctataaaatacgagaaaaacaagagcttcccatgagctcttgactatcccaggatcacacccagtttgggctagaaagacccccatragggatccaccacagygaaaccagttgaactgccctttcctgagcctctctgtgctccaggcactgccccatccctcccacgagacctgaygggaagcgggttaaggtggtttcatgttgaccatgtgtccacaggcttcgcagaccaagagcaagtcggcacaccaggacaggcaytygcatgggtgcccagaagtttcaagatctgaccttggagagaccaggtccgggaggctgccgggaagtctccatcacaccggcctcagccgagtcacaggaacgcaggctctgccatgcccagaagcctgagatgcaacttcaaggacaacgggagccagaacgcttgryctcacacggaaggtgactcctaaccaccaccacacttgacgtagcaccagcacacggagattaggtgagagtgggctctggtgcaaagataacagtgctggggacctgtaagccagtcactgaccaaaggtggatgtggcctgctggataagggcagggggaaaggctggagggaaaggccacaaggttaagagcaggtagtaagaccaggtgactgaggcctggtgtgtgaggctagaaggacagagcacccagttaaggcagggtggttaaagcaaagtgggcaaggccaggagaataagactgggtgagtaggactagggggctgataaggccaagtagaaactctaggtaagtaaggcaaagtggtatggccaaaagctagtgccaggtgagtaaggcctaattgctaaggccaggagatcaaaaccaggtggataataccagrtgggtaagcacaatgggtaagaccatgaggttaagaccaggtgagtaacaccagaaggttaatagaaacaggctggtaaggcaaggaggttaaggccaggtaagtaagaacaggtaggtaagactagggggtaagaccgggggacaaggtcaggaagctatggccagattggtaaaaccagaaggttaaggccactagttgggtaaggaacagtgggtacaaccagaagtggaaagctaaatctgaaggccagatgtaaaggtcaggtgtgtaaagtacgatgaagaccaggtaagtaaactaggaggataatgcaagttggtaaagccatgagaataaagccagcagggaaagcccgatctgtgtagtgtgagtcagagcacacactttagagccagaaggttgggctcagatttcagtttcaccctttcctagatgaagactggagcaagtggagtagcttctcagaggttctttgtccatcacatagtgataaggccaggtgcagtggcccatacctgtaatctcagtgctttgggaggccaaggtgagcagatcatttgagcccagaagtttgagaccagcctgcgcaacatggcaaaaccccatctctaacaacaacaacaacaaactcatagtgataagagggtttgttagggaaatatgttattcagtgaggagaggcagttaaaccactagcttagttctgtaaatgctgagtcatttccagattggagaatgatttaagcaaagatggtgaggaggttagaaagctcttaggaaacggttgtcaacggtaaactcaygtcccagtttgaaacatgaaacactgtgaaactatgagagggcagaaaaataagacttcggaaaaatggaggtgagggtctagaagcctcaatgaagtagtaaaacagggtctggaaggcggggctggtagcaaaagaaaagaaggtgtgtgattccagatgcggattcccaaggtcaaagtttcagttgccactcaagcaatctaacccttctaactgtcatcattttgtatcttgatattgtatattatcaactaatacaactttttaatttaaaaagttttcttaaaggaaactgatattaaggattcacttttaaaattataaagtttgccaggtacagtggctcacacctgtaatcctagcactttagcactttgggagacagaggcagcaggatggcttcagaccaagattcaagaacagcctgggccccctagcaagacctccatctctacaaaaaataaacattagcctggtgtggtggtgtgtacctgtagccagctacttggaaggctgaggcaggatctcttgggcccaggagtttaaggctgcagtgagctatgattgcaccactgcactccagcctgagcaacagagtaagaccctgtctcaaaaaataatacataaaatagttatattgaagtgtatccagagaaaccagtgggaatttaaattacttttggttgaaatggattctgaggaaattatacggacagaaaactgagataatgtaagttgtatcttgaataaaaactctgattttggctgggcatggtcacttacacctgtaatctcagagctttgggaggctgaggcaggaggatcacttgagcccaggggttcaagaccagcctgggcaacatagggagaccctcatgtctaaaaaaatttttaaataaataaactggttttggggtggggtgggtggagctggggacggaggagtaaaaaacataattgtcccatcactatagcatttaaagatttgactaagcaaaacaaaagccccagcttctggagcagaggtgctggcactggttccacaggcacccacagcacaaatccctggaggtcagtggggtgcacagctagtgtgggaacacttcaaatagtcggtgtgctcagccaggagtggaattggtttgctttggtctgttttagcagtgcagaagcttgattgatttgatttcttcatcctttacattttggattatatttcacatctttcccaataagtaacacacacaacccagtattggttatcatatcattctgaaaagcatcacaaggggctaagtagctggacatcaaaggagttttaacccactcttctctttcttctgtcctccagaatttgtttgtttgcttgtttgttttttggagatggagtctcgctctgtcacccagtgcagtggtgctatcttgactcactgtaacctccgtctcccgggttcaagcaattctcctgcctcaacctcctgagtagctgggactacaggcatgcaaaaccactcccggctaattttttgtattttagtagagacagagtttcaccatgttgcccaggctggtcttgaaatcctgagttcaggcaatctgcccacctcggcctcccaaagtgctaggattacacctgtaatcagtgaccgcacccagcccttttctttttttcttttgagacagagtctaactctgtcacccaggctggagtacagtggcgcaatcttagttcactgcaacctctgcctcccgggttcaagcgattcttatgcctcagcttctcaagtagctgggattactggcccgcgtccccaagcccggctaatttttgtatttgtagtagagatgcggtttcaccatgttggccaggctgggcttgaactcctggcctcaagtgatccacctgcctcagcctcctaaagttctgggattacaggcatgagccaccrtgcccggcctctgtcctccagaatttttattttgctgcataaatgtaatgatattagggatctgttaggtattccatacatctacttatctgaataacttttgaatcatttcttaacttgtttctatggtatccatcaggttatatgtggacagatgatctggtaagtactggtaatgatgcagaagaagtgctctgcaccagtcatccattgatgtctgttttccaagacacagaattacgatcattacggatcattatttcccatcatgtgtttatctttcaaaaggaaatggtttttgattttcagttgttttggaattcagcctttcctatggatgtgactgatttttgctctctatattttacccttcaattagcaactttaaaacaggcctgttgggccgcatgtggtggctcacgcctgtaatcccagcactttgggaggctgaggcaggcagatcacctgaggtcgggagttcgagaccagtctgaccaacatggagaaaccccgtctctaataaaaatacaaaattagccgggcatggtggcacatgcctgtaatcccagctatttgggaggctaaggcagggaaatagcttgaacctggcgggtggaggttgcagtgagccaagatggtgccactgcactccagcctgggcaacaagagtgaaactccgtctcaaaaacaaaacaaacaaacaaaaaccaaaaaaccacaacaggcctgtttagtcaagctaaaatttctgatccataaagagtcctagttgggacattgtgttatttttatttatttacttatttttgagatggagtctcgctctgtcgccaggctggagtgcagtggcgtgattttagctcgctgcaacctccccctttggggttcaagtgattctcctgcctcattctcctgagtagctgggactacaggcacccgccaccatacccagctaattgttgtatttttagtagagacggggcttcaccatgttggccaggatggtctcgatctcttgacctcatgatccacccacctcagcctcccaaagtgctgggattacaggcgtaagacactgcgcccggccttagaatcttctttaataattatcagcactgtaagatgtttctggtctccactcttttttcaggcctacaccaatggctaattgagaccatgcatcactattaaggcatcttcagcaaaaggaactatggaagttctgcatgaaacatagacacctgttagaaaaggaactaaatttcaaaccgggaatgtggtgttgaatcacagcaaagtgtccagaaggaactcccaaagtactgttttccaaaatatagaatgatatagaagattgttttaggtggaattcctggaaataaatttttaaatgtttctttttgacttccttttcatatggcaaatgataccaatgttccatttatattagttatgaatttaaagaaatattgaggaaatcacatttcacctggcatatgagtatgggaaaaatcatgacaatggaaggcaaatgacttaagtttgggaaacatttggctgagaggatgtgttggaaagcaagttaaaatcccaaactcagccatgtgcagtggctcatgcttgcaatcccagcattttggaaagctgaggcaggaggatcgcttgagcccaggggttcaagaccagcctgggcaacacagggagacctctgtctatacaaaaataaataagtattgattagccgggcatagtggcacacacttgtggtcccagccactcgggaacttcagcccaggagctcaaggctgcagtgagccatgaccatgccactgcactccagcctgggcaacagagtgagagcctgtctcttaagagaaaaaaagatagattcaaaatctgataacagtaggtttggggatggccccgaggtcttgggcttttcttttctctctctctttttttttttttttttttttgagatggagtcttgctctgtcgccaggctggaatgcgatggtgcaatctcagctcactgcaacctctgcctcccagcttcaagcgattctcctgcctcagactcccgagtagctgggattacaggcacctgccaccacgcccaatttttttttttttttttttgtattttttagtagagacggggttttgccatgttggccaggctcgtcttgaactcctgacttcaggtgatccacccgtctcggtcttccaaagtgctgggattacaggcctgagccaccgcgcccagccaggtcttgggcttttcataggctccctgggcatctttcaaggtgtggaaatttgaaagccaggaacaatctgccatacatcaggaagccactagatggcaggagccatcccttggagcccattcttcagtccaaaaagtggtcagagaggaaacctgtcaagtggggaagaatccaagcacacatgttaaatgcactttaataaatagctggtgcagatgaaagggcaggaagagtttatctcatctcttgcccccctctagtgtcccctcaagtatttgaaatgcttcaaggatccttaaataaaactgcaaccagggagctgtgctaccctgtagcacgaccagctaaggaaaaaactagctcaatgatagggctagtatttatatggggtcaatggcttttactggcagacatatatggccttttgtgcaatataggagataggaaaaacccaaaccaaagcttttttttttattttttttctgctctcaatcaacacagaatacttctgtgaccaaatgtgggcaaggttttccccagacaccaaacaatccgttttccagcaggttctccagtggacactagctgggtgtcctctaattcaactcaattttgacactccctacctaaagacagtgttagatctcataggttcaggggttagtctcacaaaactgtccccaacttcagataccagttgcagatctgagcctctagaacttctgacccaccagctacaaattaaggttgccacatgcccctccccaggttcaattaatttgttagagcagttcacaagaactcagggaaacacatttaccaatttattaacaaagaatataataagggctcacctaactagcctaaaaaaaagaatatgataaaggatacagatgaagagatccatggggtgaagtcagcaagggttctgatcctaggagcttctgtcctcatgaagttggggtacaccaccctcccagcatgtggatgtgttcaccaacccaggaggtctccaaacccagtccttttgaacttttttttttttttttttacagagtcttgctctgtcaccaggctggagtgcagtggcgcgatctcgactcactgcaacctccacctcccgggttcaagtgattctcctgcctcagcctcccaagtagctgggactacaggcctagctaatttttatatttttagtagagacggggttttaccacaccaccatgctcagctaatttttatatttttagtagagacagggttttaccatgttggccaggatggtctccatctcttgatctcgtgatccgcccactcaggcctcccaaagtgctgggattacaggcgtgagccaccacgcctggcctccttttgaatttttatggaagcttccatttgtaggcatgattgattatatcattagccattaacgatcaactcaattttcagccccccttccctccttggaggttggggcctggggctgaatatcttaaccctgtaatcagaacttgatttttcccacaaaaagttcccaccctgaggctatctagaggccctcagcctccagtcacctcattagcacagaagattccaaggattgaaggaaccgtatgtcaggaaaagatgaggaagaccaaatacatatttcacaatatcacaccttccaagtgtatgaccctgtacctaagagataacacatgttaaaatcagatacaaaacagatagtgccatcccgtgatttttctgtagaatgtgcttttcctccaaatgccaggaaatggcataacagagactaaaattcagagtgcttgctcttctttttagtggctactaacgtggtgtcaatgtgtagagctaatatttagataaagacaggtaggcaagggcactatttgagacatatgaattattgttggtgtctgattttgttttattccaacctaattagttctgccttgtaaaatactctcattacctgaattaccactgtgaatattatactctaacaatttattattatagaaatagtacccttcagtttttgaaatagtttagaaagcagtgatactgggggcacttaaatatatttttaaagtggttaggccgggcgctgtggctcatgccagtaatcccagcactttgggaggccaaggcaagtggatcacctgacgtcaggagttcaagaccagcctgcccaacatggtcaaacgccatctctactaaaaatgcaaaaattagctgggtgtggtggtgcacgcctgtaatcccagctacttgagaggctgaggcaagagaatcacttgaacctgggaggtggaagttacagtgagccatgatcatgccactgcactccagcctgggtgacagagcgagactctgtctaaaaaaatattaaataaataaatgtggttaatgtaaccaatcatggtgtacttttttaatttattattattatttttttttttgagacagagtctcactcttgtcatctaggctagagtgcactgacataatcggctcactgcaaccttcacctcccaggtttaagcgattcttgtgcctcagcctcctgagtagctaggattacaggcacctgccaccacacccagctagtttttatatattttagtagagatggggtttcatcatgtggccaggctgatcttgatctcctgacctcaggtgatctgcccatctcagcctcccaaagtgctgggattacaggcatgagccatcacccccagcctacttatttattttttgagatagagtctcgctctgttagccaggctggagtgcagtggcgcgatcttggctcactgcaaactccgcctcccaggttcaagtgattctcctgcctcagcctcccaagtagcagggattacaggcatgcaccatcaggcctagctaattttcctattttcagtagagatggagtttcgccatgttgatcaggttggtctcaaactcctgacctcaggtgatcttttttaagtatgaagaatatattttcattatacttgtctataagtgattgaagtggtcagaggagctactgaattcctcatttacttttagatgaagcaaagactaacatcctgccctcccagccaaatagatactaagttgaatattctttctgggaacctggagaaaaagtggataaaaatcactacttccaggctgggcgtagtggctcacgcctgtaatcccagcactttgggaggccgaggcgggcagatcatgaggtcaggagatcaagaccatccttgctaacacggtgaaaccctgtctctactaaaaatacaaaaaattagctgggcgtggtggcgggtgcctgtagtcccagctacttgggaggctgaggcaggagaatggcgtgaacccaggaggcagagcttgcagtgagccaagatcttgccactgcactccaggctgggcgacagagcaagactccgtctcaaaaaaaaaaaaaaatcactactgccaatgtggcactgtagattagcaatactgattatatctgatggaggacaacagatgttatcatgtgcaaatttaggatgctgaagaagtgacaagaaaaggatcagagccttgccacaacatagaatttatgtaagtgcttgaatgatgtcatctttcttgaagtccaagatgtgctggaaggtgagcaggaaataaacttagtcattttattttgaatcaagctgtatctttgggaataacaaatgcatagtacagaatgtgttgcttggttatttataagcttgggttcagagagttaatgcaaatgcaaaagcaagcaaggggctgctgtcctcttagtaaggatggtgtgtgcagctgagtcagaggaagggttggaagcctagccccagtgctggctagctttgggagtgtaagcaaagtctcaacctaatttgaaggctctctgttcccatctgtgaaatgggtacaaaccccccatgatctgagctgtagtgaaagaaaggaggccatgcacgtcaagatccaggcaggtggtcaggctcagtaagggagaggtcatgtcactctggtacttgagaccgagaccggactggtaacataagccttctgggccttccggggccctgaagcatggatcacggggaccactggttggcgccacagatgctcaaccagcaaagaggggaagggagaaagcagagcccagggagggctggaggggatcgttcctggtgttgatccagaaaaccacagggttccttgtcttggttttcaacaacttctctttctgtgtgtgtgtggatggatgtagcacattgttataaccaagctcaaaataatgcaaaactttgattatatatgttgttaccatggttaacaaatgtattcttccatctgagaatcctcagtagtacagagagaggttttgcatttagaattctatttagactttttattccttgaagcatcaaaagtacataaacaccccaaaaggttatatcagaagtcaaagcattatgatctctctggatgcttttcagacatggtgggtgagcgttctgaatcccaaccccgcccccaatgccccccagccgccacccggccagctttgcctggagagctactgagattttccactatctagtcttgggatgctgaagcctcaagaggttaggaatgaatgcaattctcacccacctgacaatgttggtatgcaagctttggttgctttggttggtatgagaccacctcatcctactggagaagttattttcttgtctttcaccatggaatcatttacttttgtggtgggggaggaatgctactcagaaagagatttcaaagaacgaaggaaaaacttccttatcttcttcttcttctccttattcttcttttttcttttagtagagacagggttttgtcctccaggttgcagcacagtggcaagttatgctcactgtaccctggaactcctgggctcaaggagtcctcaagcctcccaagcagctaggagcacaagtgcatgtcacttcttaaaggagacttgccacagagaataatgggccacactggcttttgttacttggtgaaatgattttgttggtccatatagatactgctactctacggagca

SEQ ID NO: 17868 - DNA, 66025 bp, Homo sapiens
  misc_feature (1)...(66025): n = A,T,C or G, or insertion/deletion polymorphism (see Tables 1-2)
ctagctaatgtctttatcttacatagacacaaagtctcctcactatgttacctaggctggtctcacactcctgggctcaagtgatctttttgccttggcctcccaaagtgctgggattaataggcttcagctactgttcctggcctgatattgcatatcttatttttgaaacttctataaagtctgtcatgtttagtatttcaggaagtcgatcacttccacctttcttttgaaatccacccctgacaccatctcctcatgtctgttgtccttttttttttttttcatgagctcctttgacatatgactcctgggcattttaaagtctctctcttttattataacatggagggcagctctgagcctggttccattgattactttgtatcttcacaggatgttgttgtcatcttcttcttcttttgatacaacttgtaatttttcattgattgccaaacatcttgtgtagaacaggagagatttaaataaatagtatttgtgactagaaatggacacacctcttctcaggcagttagcttggtggattgagttaatctagttaaaaggtgaactgtgcaggttttgtaattgccaagtttactttcggtacatcataggcttcaaattccttttgtgatgccttatgcttagggtggcatctggagtgctggctatttctcagtgtttgtgccccaccctcagctctcgttctcctctgtacaccacacagcagaccccacagaggtcgtctctctgcacgttcatgccctctgccagtggcggactgcttagttacttggtgctcttgctcgggtaatggtgaggggacagggtgcttctctgttgccctcttcatcttctatcttaggtaggtttatatgcctgggccctgggggatgagtatttctgccccactccttatgccaggctgccaaaccctgctttgaatttgtggctggtcttgggtgggaaagatttttttgtgctcctccttcagtttcaggagacctctaaaagtattagcttagaactctgggctcacaattgctccttgtccctccctcggactagggtcctccctgctcttcccttggtaacacctgtgccctgggagcaacagtatttgccagtcctccccagggtcttaaggctttcgagagaggagcatgggcagctggggccttttctgcaatgatagcaaatacggtccttgatgcccatagtactgagggggctctttgtagtctcccacttggcccccagtatttcctgtgaacacctggtagaggtcatggaaaggagcctgtgggtaagtaaagccctccttgcttctgtgacacccagaggctccttatagtcactctagtctgcactaggcctctagcaatttatgaaaaatgtagctgctttcttcttgcatgcttgtatgatggcccaaatacctcccatactctggcactgatgagacactccacccatctggtctctgctcatgaggattgcatgtccttgaatttcaggctacttagcttacctgcaacctcagctcagctgttttgttttcttttgttttgttttgtgatggagtcttgctctgtcactcaggctggagtgcaatggcgtgatctcagctcactgcaacctccacctcctgggttcaagcaattctcctgcctcagcctcccgagtagctgggattacaggcatgcaccaccatgcctggctaatttttttgtatttttagtaaagacagggtttcaccatattggccaggcgggtctcgaactcctgaccttgtgatctgcttgcctcagcctcccaaagtgctgggattacagacgtgagccaccgcccccggcccagctcagcatttaggttcaacttttggtttaagaaaagtgattttgcagtttgtctggctttttcatattgtcagagagggggcaatgcactttccagcttatttttattttttattcttagagacagggtcttgctctgttgcccaggctggagtgcagtggcacaatcatggctcactgcagacttgaagtcctgggctctagtgatcttcctgcctcagcctcccaagtagctgggcatgtgacaccacacctagctaacttttaatttttttttttggtagagatggggtcttactatactgcccaggttgatctcgaactcctggcctcaaacaaccctcccaccttgccttcccaaagtgttgagatcacaggctcgagccaccaagccacactctttctagcctttcaaattccaagttaaagtggaacttgccacatgtcgttttgtatcactttccccaacccctttcttttcttttttttttttttttttgagacggaatttcgctcttgttgcccaggctggagtgcaatgttatgctctcagctcactgcagcctccacctccccagttcaagtgattttcctgcctcagcctcccgagtagctgagattataggcgcccaccaccatgcctggctaatttttgtatttttggtagagacagggtttcgccatgttgactaggctggtctcgagctcctacggatcggcctcccaaagtgctgggattacaggtgtgagccgctgcaccagccccaacccctttcaattagcattgcaaataattccccttatcatgaaaacattatttttaatggcagcagagtattgctttatattaacatgacagtttattcaaccgaactctttatggggcattgcaatagacttaatgttttatgtttgcagctctttacaccaacacttttcctactgtagtgatttctttgaacaatttcccctccccaactccctgtggttctaaaggggtggccaatcacagtaccccatcaccctggcctttaggtgggagaatgacccaggccctgcctatcataccctcctgactacagtgactgattcagaggtgagccagcgagagagggaggaacacagtccttcttcgggaatttctataacataggtgaaaaattttgtcagttggggtcgtggagctgaacgaatatggcttgagggctcccagctgccgtcctccctacgacttgaagaaaagcttgtgtgcagtaggagaaaatgaaccaatcagagacaagtacacaagagagaaggactgggaggagtcggccctggctgcaccacgtctccactcctgggctgtcaagtttttcaaggtgctctggttccataagctcattcttcctgttggatccattccagttaccaaaaacacttttttgtttaggctggtttgatataggatgatcattggtcccagagagcatcctggctaatctattttattattttattttatgagacaagttctcactgttgcccaggctggagtgcagtggtgctatcatggctcattgcagccttgaacccctgggctcaagcaaatcctaccatctcagcctccagagtagctgggactacaggcgtgcaccaccacactcagctaattttaaagaaatgttttatacagactgaaactgcctttgcaaaattgtaacaggaaattatgacagtgcaagaagtcagacctaaccgactctatcttgcttctaacccttaagctgtccttgtttattcctgggcataggccgaagtaactttgggaaggaattcagttcatggtttgactctgaaacaaaattgataacagccctttcccaaaaagacccccttcttgcccggggtccagtctgcctttgtaggactaacagattagctacaagattagaaattacagtttagaggccgggtgcagtggctcgcgcctgtaatcccagcactttgggaggccaaggcgggcggatcacgaggtcaggagatcgagaccatcctggctgacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccattgcactccagcctgggcggtagagccagactctgtctcaaaaaaaaaaaaaaagaaattacagtttagaggtcatgcagcctctggctccaagagtctgaacctccccaaattgctcctggggataacatcactgctgtaaaacctaagatcagtaattgagttattttgcaggccctgcactccatgggatcagctgacaccacacagaccagtcatctggcccaaccagttctgccatctcacccaggaacagaagacattaagaaaatctaacttcgaccctctatgattccatctccaacctgagcaatcagcactccccacttcccaagcccctacctgccaaattatctttaaaaactctgatccacgaaggctcaaggatttaagtaataataaaactccagtctcccacacagccggctctgcgtgaattactcttttgccattgcagttcccctgtcttgataaatcggctctgtctaggcagcaagcaaggtgaatccattgggtggttacaaaacggggtctcactatgttgcccaggctggtctcaaactcttgggctcaagcaatcctccagcttctgactcccaaaagctgggattataggcatgagccactgcacttagactaatttatattttaggtgacttctaagtattaccatcataaagaacactgtgggctgggcacggtggctcatacctgtaatcccagcactttgggaggctgaggtggtccctggagctcaggagttcgagactagcctgggcaacatggtgaaaccctgtctctattaaaaatacaaaacaattagccaggagtgttggtgcctacctgtggtcccagctactcaggaggtggaggtgggaggatcgcttgagcccaggaggtcaaagctgcagtgggctgagattgtgccactgcactccagcctgggtgataaagtgagactctacttcaaaaaaataaaaaataaagaaaagaaaaaaaagaaagaacagtgtgaaaaaactcagtgttacacttgtgcatacatgcatgctgtcctttttttcctcattaagaaacatttccagagtaggagttgctgagtgaaagaatatgcaaatctcaaaggctttggtgtgtattacaaaattgccatgagaaagttatccacattctattttctctaggactgtgtgtgtccctatttccatacagtcacaacaatactgagtagtattaattttttttttttttttgagacagagtctcgttgtgtcacccacgctggagtaaagtggcatgatctcggctcactgcaacctccacctcccgggttcaagcgattctcctgcctcagcctcccaagtagctgggactataggcacccaccactatgcccagctgatttttttttctttgtatttttagtagagacagggtttcactatgttggccaggctggtcttgaactcctgacctggtgatctgcccacctcaaccccccaaagtgctgggattacaggcgtgagccactgtgaccggccaagtttaccgcttttctattgaaactgttctcatacccgtgttcccaactacaccttaattgaataataaaagaaaataaggacattaaatgagaacaggaattggaatgagaccagaaaaaaagggaggagttcaaaatatgttctgagagctttaccattatgaatactcagctctggttttcccccaaaactggctgaaccagtatggatgttccaggcagaaacaactttaaagaagtgaatagtggccctaccctggtccaccacctaacctggtggttacagaaggaggaacacagtcctcctgtgttccaggtgccaggaggtgactgactatagcatcagtcatcactgcacaccctacctggaattagtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgcctaactttctcaaacatttatatggagatggggagatcaactttggtttatcttaatttcctcctccttttttctcttctttggttccactgatcctttacccagagagggaggctgacgcatgaagaggaagctttaaaaaagataaatattaaaatgtgccctgttttctgaaataggcctaatttcctccttggtgctctaggcatgtgtgctcggtgagggcctcctgatggcggaagttgargactgtgcactgagtcgttgcccctctgcttcttgtagaaaatgaggtgcataaggaaggcaggggcttggtctgtctaattcactgctacttgctgagcgcttaggagagtgctggatttttcgagtgaatgaatcattattgccctgaaatccttctgctcctttaatagaaactacctggtgacattaccagcccggctaaatttcccctccgttcagaaggtttgtttggacctgagccctgggtacagtgatgttaaattcacggttactctggagaccaaggacaagacycagaagttgctagaatactctggactgaagaagaggcacttacattgtatctcctttcttgtaagcacagactcagccctcactcgaatcccttacttgcctattctcctccctaggctcactataatctactttaagtataatttctgttatcttttgccacggcctctaaacctattttttctcaacttaacctcaatccccggctataactcacccacggtttcctcgacctaggatttctccctttagttcctgaccttaattcttcctcgtggtaatttgttttatgtctctatccttgctacccccatctaactcagctctttcctttaactcactgttgggttgagaccagttgattctgttcccccaatcccttacccctccccagaagtcccctttcttggtcaggtaccacctcctgctggtggcacagaagaagtggccacaatccgggtgtcgggagttggaaataacatcagctttgaggagaagaaaaaggttctaattcagaggcaggggaacggcacctttgtacagactgacaaacctctctacaccccagggcagcaaggtaagagtcacatatttggggttcgactaaaacctggggaaaccgctgtgcacaggggtaaagaggggatttgtggtttgacagtaggctttggaaaaaaaggagtgcagaggagaggaaaatctggggggattaagtagtgcaagtgttgaatacatgctgcgctacacaagcaagagaagtaggtgggggttgctactgagtttgtgtatctaaaacaaaagtacacatttcttctggaatagaatttggcaagtataactgggttgctgggccttacaacaaactgcttgtaaatggctaagaaagcactgagggcatttggcttgagctactggggttttttttttttttttttttttttttggatttgttcattcgtccttacaggggcacttcattctgagatttcaaagtcaggcaccctgaaaagaaactatgtttgggttttttttatttttttatttaaaatttttgtgggtacatagctggtgtatatatatttatggggtagatgagatatttttatacacacacacaatgtgtaatcattacatcagggtacatgtgtatccatcacytcaagcatttatcatttccttgtattacaaacaatccaattatactctcttagtaatttttaaatgtgcaataaattattgttgactgtagtcactctttgtgctaaaaactacaagatccctagatcttattcattctagctaaatatatttttgtacccattaaccattcccaccccacccctcatcctgcccaccattacccttcccagcatctggtaaccatcattctgttctctctctctctttcaaaaaaatttttttccttttaccttatttttttccacacacttaaaaattattattctattctctatctccacgacttcaattgttttaatttttagctcccacaaataaatgagaacatggaaagtttgtctttctgtgtctggtttattttacttaacataatgacctcctgttccattcaggctgttgcaaaggatggggtctcattcttttttatggctgaatagtactccattatgtatgtgtaccacattttttaatccattttttatcatctgttcatagacacttaggttgcttccatatcttggctattgtgaatactgatgccataaacatggcagcacagatagtctttgatatactgatttcctttcttttgtatatatacttagcagtgggcttgcaggattatatggaagctctatttttagtttttttcagaaacctccaaactgttctccatagtggttgtactaatttacattcccaccaacagtgtatgagggttctcttttctccrcatcctcaccagcatttattattgtttgtcttttggaaaaaagccattttaactggggtgagataatatctcattgtagttttgatttacatttctctgacagtcaatgatttgagcaccttttttatatacctgtttgccatttgtatgtcttcttttgagaaatgtctattcagatctttttgcccgttctttaatctgattactagatgttttcctatacagctgtctgagctccttatatattctggttattaatcccttgtcagatgggtagtttgcaaatattttctttcattctgtgggttgtctctttgttgattgtttcctttgctgtgcagaagctttttaacttgatgtgatcctgtttgtccatttttgctttggtttcttgtgctccttgggtattactcaagaaatctttgcccagaccaatgttctggagagtttccccaaagttttcttatatataatagtttcatagattgaggtattagatttaaatctttcatccattttgacttgatttttctatatggagagagatgagggtctagtttcattcttctgcatatggatatccaattttcccagaaccatttattgaagagcctgtgctttctccagtgtatacacttgtcacctttgtcaaaaatgagttcaccctagacatgtttctgggttctctattctgttccattggtctatgtatttgtttttatgacagtaccatgctgttttggttactatagctttgcagtataatttgaagtcatgtaatgtgattcttccagctttgttctttttgttcagaatagatttggctattttaggtcttttatggttccataaaaattttatgattttttttacaaaagtcctaagatttaggatgtagaatttctgtgaagaatgtcattagtattctgatagggattgcaatgaacctgtagattgccttaggtagtacggaattttaacaatatcaattcttccaatccagaaacatgaaatctcttttcatgtttttgtgtgtcctcttcaatttctttcatcagtattttatagtttttattgttgagatctttcacttctttggtaaagtttattcctaggtattttatattatttatagctattgtaaatggaattatctttcttaatttctttttcagattgttccctgttggcatatagaaatgttactgaattttttttgtttttgagacagagtctccctctgttgcccaggctgtggagtgcagtggcgggatcactgcttactgcaacctctgcctcctgggttcaagtgattcttgtgcttcagcatcccaagtagctgggagtacaggcatgcgccaccatgcccagctaatttttgtttttgtttttttgttttttgagatggagtctcattctgccgcgcaggctggaatgcaataaatggttgctcattgcagcctctgcctcctgggttcaagtgattctcctgcctcagcctcccgagtagctgggtttacaggtgagcgccaccacccctggctaatttttgtatttttggtagagatggagtttcgccatgttggccaggctggtctccaactcctgacctcaagttatcctccccactcagcctcccaaagtgctggggttacacgcgtaagccaccacgtctgtcttcttgcacttttaggattcttttttgttttttattccttgatgtttgggagtttgattattaaatgtcttgaggtagactcatttgggctaaatctgcttggtgttctataatcttgtaattaatattgatatctttctcagctgggctcagtggctcatgcttgtaatcccagcactttgggaggctgaggtgggcaaatcacctgagatgagtatttcgagaccagcctggccaacatggcaaaaccctgtctctactaaaaataccaaattagccaagcaaggtggcctgtgcctgtaatcccagctactggggaggctgaggcaggagaatcacttgaaccagggaggcggaggtcacatgagccaagatcacattactgcactccagcctgggcaacagagcgagactgtctcaaataataataatattgatatctttctctaggtttggaaagttctctgttattttcactttgaataaactttccatctcattttctctctcaacctcctctttaaagtcaatacctctttttttttctctttgttaaatttatctgataagattctgmattctttctctgtgttatctaaaattttgttgagtttcctcaaaacagctattttgaattctcgatctgaaagatcactatctttgtttctgggagattggttgctggtgccttatttagttcatctggtgaggtaattttttccaacatggtcttgatgtggatgttcattggtgtctgggcattgaagagttaggtatttattgtagtcttggcattctggacttgtttgtacctgtcctccttgggcagactttccaggtatttgaagggacttgggtgtcgtaatctaagtgtttggactctgcagttcatctgcattagggaggaccccatgctcagtatctctgtggctcttgaagcctcatagaggtacctccttgatggtcttggataagatctggaagaattccagattaccaggaggagactcctgttctcttcccttactttctccaaaacaaacagagtttctctctttgtgctgagctgcctggagagaggggtgacacaagcacccctgtggccaccagcattgggactgcactgggtcagatctgaagccagcaccgtactgtgtctcacccaaggcctgtggtaaccagtacctggctactgcccatgtttgctcaaggccctagggctctacagtcagcaggtgacaaagccagccaggcttgtgtcctccccttcagggtggtgagttccccatgaccctggaaggtccagagatgtaatctgcgagccagggcctggagtcagaaaccttaggaatctacctggtgttctgttctactgcagctgagttggcacccaagccataagacaaagtccttcccactcttccttccccttttcacagaggagtctctctctgtggccaccactactccaggcccagaggagtactgcctggatacttccagtattctctcgaggcccaaagtctcctttcaccagcttgtggtgaatggtgcctggcctgggactctcttttcagggcagtgagctctcctctgacaaacagcaggtccagaaatggcatccaagagccacagcccataactggggaccccaagggcctgcttggtgctgtaccccactgtggctgagctggtacctaagctgcaagacaaagtccccttgactcttccctctccttttctcaagtagaaggagtctctccccatagtcaccacagctgggaatgtgctgaatcactggaagccagcatgtctctgagtctcacccaaggcccacgacaagtactgcccagctatcactgctgagtatttagagccccaggggctaatcggaactcagcttccaaccgctgggatgggcagttcacccctggctaacgctggtctaaatgctccctccatgggcactggctgagttctgccctgtgtgctttcccctgtgattgggcagcaytgcrttctaaagccaagtcccacagtcactgtgctctcccgccctcaagctcatcgattctgtctctgtaccacagtcactgctgggggatggcggggagggggtgaatcagcaattsaagtgtgtcttttctaccctcttcagtgcctctttcagtgatataaagttaaaaccaggcactgtgatcactcttctgatttttggttcttatgacagtgctgttttgcgtgggcagttgttcagtttggtgttactgtgggggatgaggagggtggtcaatggaggcttctattctgcctcttgctctgcctcctgagctccaggcctgygtttggactttaccttactctcagagcaggttttgtaaaaaagtaaaacctgttggggttttgctgactcagmgcatgtgtgaggaaggaggagggatagaggaaagattctgagcaggaggcsgagcgcggtggctcacgcctataatcccagcactttgggaggscaaggcaggtggatcacctgaggtcaggagttcatagaccagcctggccaacatggtgaaaccctgtctctacaaaaattagccaagtgtggtggcacctgcctgtggtcccagctactccggaggctggggtgggagaatcacttgagcccaggagtttgaggctgaagtgagccacggttgtgccactgcactccaacctgggtgacagagtgagaccctgtatcaaaaaaaaaaaaaaaaaaaaaattctgagccaggaaacatcccctttgctaatgatgcctgttcctttccagtgtatttccgcattgtcaccatggatagcaacttcgttccagtgaatgacaaggtgagttgggaggaggaraaggagtggcgcagggagaacagggaaaaggatgagagattctctagggtggaagtcctctcagcctgggcgtggcaaggcgaggccctctgggttggagactgctgtgtgcgtgggactggaagtgctgggcgagcttcagggagctagcctaaatcagcctaggaacaagcagaggtaaccagttctcagcttcagtatctacacattcatcaggttcttgagagatggttatgctccttgtcattttattttatttatttgtttatttagagacagagtctcgctctgtggcccaggctggagtgcaatggtgtgacctcagctcactacaacctctgcctcctgggtttaagcaattctcctgcctcggcctcccaaatagttggaattacaggcgcgcaccatcacgcctggctaatttttgtatttttagtaaaaacagggttacatcatgttggccaagctggtctcaaactcctgacctcaagtgttccacccacctcggcctcccaaagtgctgggattacagacaagagccaccatgctcagccccctttcattttaagagttttcgcaaacttcaagaccttttcttcaggactgacaaaagcattttttttttaaggcagaaaggagaatgtccgcttccactctgtttctatgaggcaaaataatttacaaagtaggtaattctcttagggcaacattaaataaatacatgccaaagcttaaaatgtagcaacattttgcgaatatttgatttttccttggactccccatccctagaatcataagccttaccacaggtttgatttcaagttggagcatgtgtcatttctacatgcttctgagacacttacctcccggacacccctgctttcttcctcttccgtctgtcccagcctgtgtattcaaatgaaacttttagagataaacatagagaaagcatgatttccattttccatctccgtgttctcagagctgctgtttcctttccctatgtgcaggggagttattagcttgttatgattggtaatgccctacccgctactctctttcccaatatagatttccttttacttcctccttcccatcacctatggcttttctttggtaggtataacgttgagtacttcttactttttttttttttttttaacattttaagacaaggtctcattctgtcacctaggctggagtgcagtggcagtcatggctcactgcagctttgaccctgccccgggctcaagtaatcttcccatctcagtctccccagtagctgggaccacaggtgtgcactaccacacctggctaattattttatttttttgtagagttgtggggggcgggggtctcaccttgttgcgcaggccggtcttgagatcctggcctctctcgctttggtctcccaaagtgttgggattataggcctgagccactgcacccggcctgagtgcttacttcttaacagactgttttctctagagctgcaacaaggaagtgctgggttcaaagcgtggcccgcagcagcactattttagactcacttaccctcagggttgatctcattaactacccctgttacgattcaaatgaagcgggattacttccaggtgttctgttttctgcagttaggctctttctcttgtgaaattactccttcctccccactctatttctccagccaaactctccctccaaattcagttgaaacactgagattaacaaaaggaattttaccaagaaagctaggataaaaattgtgtttatgtaaccacccaatgggttcaccttgcctgctgcttagacagggttgatttatcgagacaggggaattgcaatgaagaaagagtaactcacccagagccggctgtgtgggagactggagttttactgttactcaaatcagtctccctgagcatttggaaatcgagtttttttttgtttttgtttttgtttttttttgagacggagtttcattcttgttgcccaggctggagtgcaatggcgcgatctcggctcgccgcaacctctgcctcccaggttcaagtgattctcctgcctcagcctcccaagtagctgggattacaggcatgcgccaacacgcccggctaattttggtacttttagtagagacggggtttcttcatgttggtcaggctgttcttgaactcccgacctcaagtgatccgcccgcctcggcctcccaaagtgctgggattacaggcgtgagccaccgcgcctggccaggaaatcgagtttttaaagataatttggcaggtaggggcttgggaagtggggagtgctgattggtcaggttggagatggagtcatagatggtcaaagtgaggttttcttgctgttttcctcctcctgggtgggatggcagaactggttgagccagattactggtctgggtggtgtcagctgatccactgaatgcagggtctgcagaacatctcaggcgctgatcttgggttttacaacagtgatgttctccccaggagcaatttgaagaggttcagactcttggagtcagaggctgcatgacccctaaagtgtaatttctaatcttgtagctaatttgttagtcctgcaaaggcagactggtccccgggcaagaagggggtctttttgggaaagggctgttatcaattttgtttcagagtcaaaccatgaactgaattccttcccaaagttagtctggcttacacccaggaatccacaaggacagcttacaagttagaagcaagatggagtcggttaggtctgacatctttcactttcatagtttcctcagttataattttgcaaaggcggcttcagtccctccctttgggttttataacaccttaatcttcaggtgtgggctaggaagatgggaaaaggctgtcgattgttctggcttcttcctgctgagagggggcgtagtgagggtacctaaggtgagaggagtggaactgcttagaagcaagatagcgttggttaggtctgatttctttcactgtcatcgtttcctcagttttaattttgcaaagtcagtttcatttacacagcacaatatttaatccccaaacaagtaaagtaagcctgatattaactgaccctgtctaacttgattgctatactcagttattcagaaactccaggcaacttccagtcggaaatgctactttccttttttttttttttttttgagacggagtttcgctgcgttgcccaggttggagtgcagtagcgggatctcagctcactgcaacctccccctcctgggttcaaaggattctcccgcctcagcctcccgagtagttgggtttacaggaatgtaccaccacatctggctaattttgtatttttagtagaaatgtggttttaccatgttggtcaggctggtctcaaactcctgacctcaggtgatctgcccacctcagcctcccaaagtgctgggattatgggcgtgagccaccatgcctggcctcagcaatgctactttcctagtgaaacacttattttcttccagagcctatttctggccaactgatgtctttcctgattcttgatccctgtgtgagaaaagtactttgttatcgaagtgttttttgttgttgttgttttgtattttgtttttgagttactttgtcacccaggctggagtgcagtggcatgatcccggctcaagcaacctccgctgtccgggttcaagtgattcttctgcctcagcctccggagtagctggggttacaggcatgtgccaccatgtccggctaatttttgtatttttagtagagaggggtttcaccatgttggccaggctggtcttgaactcctaacctcaggtgatccaaccgccgcagcctcccaaagtgctgggattacaggtgtgagccaccgtgtctggcctaaagaagtgtttgtttgttttgttttgttttgactttatggaaatttatagcaatcttagtgatattctcctcctgatgtttatatrgcccaggtttgtggaagtcctagctcatcgtgatccttagatctccttattttttgctttttttgaagaattgccattatccctactatcaaggctgatatttgtatttagtggttcagcttcttcactggttggcatcacatgacacttggcccaagaataaaaaaatcaagcactgtcttgatttcattttcttctttccaagttagatccaaactggtcttctcttttgaatacctttgcagtctctctgagcccctctcctgctattcactgaattccagctttcaatctcatctagttgcaagcacaatgacctgttcctcacaaacttaatggtttcacatctatttagcaactactgtcttgaggaaagtgatacatgattctccaatggaactatttcaaacaattttaaaaataattatttgcaatgcttgaaagtaagcttcctgcccacaagcattcagatggtaaaggaagaagccaggagatggttggctaccaagaagaggtttaaacattgaggaaccccctggtgctaatacttcttttagggcatgtttcttgtgcaagagctcagtcacagggtactgagactggtctgacgctccagttcttcaaatcttttggagactggcaattcctttgagattcctgcccccactcttaccctcctcctgccttgtttccctcccaagaagtctgtgcccccattgttattcttttcagggcacaaaagagccatttagaaaggaagaaatgaagaaatgggcaagagggaaaggaagaattctttgtgaacttttgctttcagcaaacttattcttattgctgtcaaccttctttaacccgcattatctggttttscttttcagtactccatggtggaactacaggtaagcggaagtttctttctcttctctgtcagttgtggaagaggaagaatgagaatttggtggtacaccttgaagacagaagcaactctgagatcttggcccagagccccatgactctgcccagcaccgagcgcccacatccacctaagctgtgcctgctttcttgcctctgccctcctagtctctcacacctacatttcagtagacaaggacaccagcctctgtaatgactacaccgctctctcattcccctaacttctctgtgcccagaygacttaaccaggcttggttccatactccccttagtgtaaggtaatagcccttgccataggcattctcaacaggtacgtgataacataaacacctgtgagaagtattttaaaggaaaggctctagaaggtgatttctccacaatatcttctccatttttccattaaatcacccatgttttaggtatcttacaatcaatctcctcagccttgtcccctaatagtgaccagaaacagagtaaacattctttgtaaatgacatcctgggtcctactttctaaaactggagataacactttagagggctcagtctgatcattaaaatccacaagatttcctaccaaatgggggctggatctatagaaatatttacctcattccgccataaagaaagttataaataacacagggagctgctcttcctggacacagaccacaggggtcatgaacaatgggtggggttttttacctgccttttgcttctttacctgctttttgcaatgcagagtgggaagcaaacgggcaggcacatcatgcagtttctctattggacaggatccaaatagcaacaggattgcacagtggctggaagtggtacctgagcaaggcattgtagacctgtccttccaactggcaccagaggcaatgctgggcacctacaytgtggcagtggctgagggcaagacctttsgtactttcagtgtggaggaatatggtaggkggggaaatggacaggccaaagtattgggcataatctcatcttaaaatcagcaaaggtggagccgggcgcagtggctcacgcctgtaatcccaggactttgggaggccgaggcgggcagatcatgaggtcaggagmtcgagaccaccctggctaacacagtgaaaccctgtctccactaacaawacaaaaaattagccgggcrtggtggcaggtgcctgtagtctcagctactcgggaggctgaggcaggagaatggcgtgaacctgggaggtgsagcttgcagtgagctgacatcacgccactgcactccagcctgggtgacagagcaagactccgtctcaaaaaaaaaaaaaaaaaaaaaatcagcaaaggtggagtaaaatgtactctgggaaaggattatttactcatttttgaatcgatgctgaaccagctaattacttcaggaacatgctacctaaataatgcctccttcattagatccattaatttaattctcactgtttatrcccctctgctcactgcctgtctgactgattcctcctccagtgctttctccatttctccttttactctcttcagtgctgccgaagtttaaggtggaagtggtggaacccaaggagttatcaacggtgcaggaatctttcttagtaaaaatttgttgtaggtaagagcagaagcttgggatctggtggagattaaagatgcatcgagagacatgatgaggggatgacatgggatgtgggattatgggtgggccaaaacttggggcattttatgtaattcagagtcatggcttatccaagacctttttttttttttttttttgagacaaagtctcactcttgtttcccaggctggagtgcaatcacgtgatctcggctcactgcaacctccgcctcatgggttcaagcgattctcctgcctcaacctctagagtagctgggatcacaggcgcgcgccaccatgcctggctaatgtttgtatttttagtagagatggggtttcgccgtgttggccaggctggtctcggactcctgacctcaggtgatccgcccaccttggcctcccaaagtgttggattacagacgtgagccaccgcgcccagccaagaacatattttatagttgtgtttctgctgtttttttccattgctcactcagatagtattattgatttagtctttacaagacacaatattgaatcccatagataaatatggatcaggagaaagaaagatrctgtttccgtccttagtatggtgctaattgtggaaktgggtctactctaagactctgagtaaagtagggaaggggaagagagctagagaaaggtaggattgtcagagcttgctttcttcttttttttgagacagagtctctgtcacgcaggctggggtgcagtggggagatctcagctcactgcaacctctgtctcccaggttcaagcgattctcctgcctcttcctcccggagaagctgggattacaggtgtgagccaccatgcccagcaaatttttgtatttttagtagagacaggatcttgccatgttgcctaggctggtcttgaacccctggcctcaagtaatacacctgtctcggcctcccaaagtgctgggattacaggcgtgagccactgcactggcccrgattgtcagagctttctttcagaggctggagtgtgagagggaagaagtggtgtttgagggaagagttggatctcaagtggaatttcccaactctgactccttatgcttttcttggttaggtacacctatggaaagcccatgctaggggcagtgcaggtatctgtgtgtcagaaggcaaatacttactggtatcgagaggtggaacgggaacagcttcctgacaaatgcaggaacctctctggacaggtgagtaaatgacaggttaaaaaggaacctatcggccaggcacggtggctcacgcctgtcatccyagcactttgggaggccgagatgggcggatcacgaggtcaggagtttgagaccagcctgaccaatatggggaaaccccgtctctattaaaaattcaaaaaattggctgggcatggtggtgtgcacctgaaatcccagctacttggaggctgagacaggagaatcacttgaacycgggaggcggaggttgcaatgagccgagatggtgccactgcactccagcgtgggtgacagagcaacactcagtccccctcccccaccgaaaaaaaaaaaaaaaagaacgtatccacatgtcctaaagcgtaaggaagcaacaatctagaaaagagctaaacagcccaaagtagaaagcatttcccagaattatcatcccagttccaaagaacaaagcagggatctttatcctaaacagggagtgttttagagtctgccttggaaccaagaaattgacctaaaccccagtaaggtacaattttccagttttgaaggcatttctttttccctttcccaaatcttggagcttcaaagtcatttcatgattatctatgtgcaagtgtatacttcatgttgtaggagagtttttctrtattagaaactgaagtgtggagatgagaaattatttccttctacagaacattataaaatggatgtagagattagattcctcatctgctctctatctctgtctctgatcacctcactagactgacaaaacaggatgtttctcagcacctgtggacatggccacctttgacctcattggatatgcgtacagccatcaaatcaatattgtggctactgttgtggaggaagggwcaggtaagtagggtgctccttggctcattaagaaaagagaaagaaaaagggctggtcccagggacagatttactccaagtatacaagacctaccctcttgagtgtttggatggtaccttgttcctagttcatagtcaaggggaaataccagatcccatcttgccatctataagaaatactacgggccgggcatggtggctcatgcctgtaatgccagcactttgggaggccgagacgggcagatcacgaggtcaggagatcgagaccatcctggctaacacggtgaaaccctgtctctactaaaaatacaaaaaattagccgggcatggtgacgggggcgcctgtagtcccagctactcggggaggctgaggcaggagaatggcgtgaacccaggaggtggagcttgcagtgagccgagatcgtgccactgcactccagcctgggcaacagagcgagactccatcttaaaaaaaaaaaaaaaaaaaaaagaagaaatactacatacttctccaaaagattggggaggtgaggttggtttggatctttggccagaaatacattcaacttcatccctctgccaccattctctcagagacttgacattaaacgtgaagatgagaatatcaggtgcctagatctttatacatctggtttccctctgcaggtgtggaggccaatgccactcagaatatctacatttctccacaaatgggatcaatgacctttgaagacaccagcaatttttaccatccaaatttccccttcagtgggaaggtatgttaaaacttttctctgcatagacaaaaaaatgcataaccatctactttgcctccttcctgcagccatagccacatagctaacttagtgctgttccaagtactttatgtgtattcattttaatctttagaataatgcaatgaggcagacactgtattggccccattttatggatamtgagacaggcaacagaggctaagtgatttttccaaggtgatcacaaatagatgggaactatgaccaaatccaggaagcctgcctcccgggtatacactctccactccctgtactctgctgcccctaatcccatagaagtgccttgaatattaatgacaccttaggggtctttctaatgccaggggctgatcttctaatgtctaaatcttcatatttaagagctgcagggtttctagagaaatcatccagcctggtctcctgcatctaggcaaggttaatatgaaactttccttgacagccatgtatagctctgtaagcaattttgtttttctttctgtttttgttttgttttgttttgttttgagacagtctcgctcttgttgcccagcctgaagtgcaatggcgcgatctctgttcaccgcaacctccacctcccaggttcaagcgattctcctgtctcagcctcctgagtagctgggattacagacatgtgtccccatgcctggctaattttgtatttttagtagagatggggtttctccatgttggtcaggctggtcttgaactcccgacctcaggtgatccgtccacctgggcctcccaaagtgctgggattacaggagtgagccactgtgcctgactagcaattttctttagagattttaaaatttccggcagggcgtggtggctcacgtctgcagtcctagcactttgggaggctgaggtgggcagatcacttgaggccaagagttcgagaccagcctggccaacatggcgaaaacttgtctctgctaaaaatacaaaaattagccaggcatggtggcgcatgcctataatcccagctactcgggagtctgaggcacgagagtggcttgaacacaggaggcagggggtgcagtgagctaagatcatgccactgcactccagcctgggcgatagagcgagactgtctcaaaaaaaaaaaaaaagataaatacataattaaattttctttgctagtgttttctttctgatatctaactgaatttctctcttgttcagcttatctttctttacttcttgtacagctggtccacacaataatattgcacacatagagatgcatttattcctcagttatcatttctctagaccaagggtgggtgcaaattatttttagagcctaaggattacacartttgggagggtaggggattcgctttaagaaaaagaaagcaaaataggctgggcacaatggctcatgcctgtaatctcagcactttgggaggctgaggcgggcgaatcacgaggtcaggagttcgaaaccagcctgaccaacatggtgaaaacccgtccctgctaaaaatacaaaaattagccaggtatggtggcacgggcctatagtcccactacttgggaggctgaggcaggagaatcgcttgaacccaggaggtagaggttgcagtgagctgagctcgtcccactgcactccagcctgggcgacagactgagactccatctcaaaaaaaaaaagaaagaaaggaaggaagaaaggaaggaaagaaggaaggaaggaaggaaagaaggaaggaaagaaggaaggaaggaaggaaggaaggaaggaaggaaggamggaacggaaggaaggaaggaaagaaaaaagaaagcaaaacaacgtgcagaacctttgaaggagcctgtgcatatgaagagccctgaagcttcattagccaccgggcaaatctagctctgctctgggctgttacttctgtttgtttttcggttcctcacagatcctagttcaaaagcttgaatcacatttatctttttcaggactctttcctgaaatgtattcttagaaattctgttattacttttagtgccaaaaaccacaattagtttgcaccaacctaatatttcactttacctcatactcaagcttactccaaacctaattctaatccgtaatgatctttgtccttcagataagagttaggggccatgaygactcctycctcaagaaccatctagtgtttctggtgatttatggcacaaatggaaccttcaaccagaccctggttactgataacaatggcctagctccctttaccttggagacatccggttggaatgggacagacgtttctctggaggtaagcatggacggaggaccagcttcctagaaaggaaggcttccctgaaggaaaacttcagaattttcctgtttcctatyctcccctctgcttggaattacatctttctcactcacaagtcctgctctcccgttgacaaaaagttttccttagatgctttctgtttttaatatcaatcaaataaatagtccttacttggatgaaaactactatttctactaatacatcttttaacttacccccatctctatctgatcctatctatatatgaagttagagcagggaggaataggtgactcagagtctttttctttctctttccccttcccatcccctcattacttaataaaaacagcaaacaagagaactctagattctagataacttataagtatcaattatcaactgccacaacaatgcttcttatcaaacagctacaaacttcagtatcgtgcagcagaaagcattcactgcttgtgcatctggggcattcagtcaggcagctctgctgatttcgatttccagaactgtctgcagatcggctggccataagctgctgctccgcatgcctctcatgcaggagccrgctagcccaggtatattcttatggcagtgatgaggtgcaagtgcaaaagctgatgttcagggcttttcyaaacctctgtatattgcatatgtttttttcttttttttttttttgagacagagtctcactctgtcacccaggctggagtgcagtggcgtgatctcggctcactgcaagctccgcctccccggttcacgccattctcctgcctcagcctccccgagtagctgggactacaggcgcctgccaccacgcccggctaattttttgtattttttagtagagatggggtttcactgtgttrgccaggatggtctcgayctcctgacctcgtgatccgcccgccttggcctcccaaagtgctgggattacaggcgtgagccaccgcgcccggcccctgttgcatatgttaacaccccwttcccaacaaatcgaacagtgggcacagactaggagggtactggaagaccacatgctcaaggatgctgatctyggagggggcrgggtgcgtgtgaggaattggagccattaatgagatcgttcaacctcaggacttaagcaaacacatactacttgccttgtggctaatttgactatttctttactctaggcatgactcagttactcagaaataattatttttcaatcttagtgtcttctgtgcctagttttcttatccctgaaatataatctttgatttctatataatctaagtcacgttcatctatcccaggaatatctgtgaagatacatcacccacaatttcctctcatttagtaactataattcagcccttctgtcgctstcctacataccaaaatattgctgtacacagctacgtttatggattctttatccatccttggctggaccgctaatgaaatacccacatgccattctcaggcagtgaagatttgagagaaagagctctatttgaaaaccgtaacaagtccgtggggtttccatggttggagcrcatgctaaaattctctctctctcttttattctcagggaaagtttcaaatggaagacttagtrtataatccggaacaagtgccacgttactaccaaaatgcctacctgcacctgcgacccttctacagcacaacccgcagcttccttggcatccaccggctaaacggccccttgaaatgtggccagccccaggaagtgctggtggattattacatcgacccggccgatgcaagccctgaccaagagatcagcttctcctactatgtgagaccrggaaacggggacgggtgagagtatgctgggaaggaaagagaatgagaagagtcagccagagggtgcacctaggctatctgaattgcagatgcacatctaattaaaaacaattttaaagccacactaaaaaagtaaaagaacagttgacattaattttaaatgtattttttatttaacccattatatccaaaatattaacattttaacacgaaagccatataaaaagttttaatagatattttacattcttgtttcaacggtgtctttgaaactcagtatgtattttacacttaaagcgtatctcagtttggactgagcacatttcaagtattcaatattcctttttttttctttttttttttttttgagacacagtctcgctcagttgcccaggctggagtgcagtggtgtgttcttggctcactgcaagctccacctcccaggttcacgccattctcctgtctcagcctcccaagtagctgggactacaggcgcccgccaccacgcccagctaattttttttgtatttttagtagagacggggtttcaccatgttaactaggatggtctcgatctcctgacctcgtgatccacctgcctcagtctcccagagtgctgggattacaggcatgagccaccgcgcccggcctcaagtattcaatattcctatgtggctatgagatactgcatggcccagtataggtgtaagagatggaaaacattgggggaagaaagagattctgagcaggaacacaggaaaattgtgtgggaaaataaaatgaggaattacctgagaaaatagtgctggccaggaccaaaaaaaacaaaaacaaaaacaaaaccagctgggtggttgggagggagagtggggagggatgggactcaggatactttttttttttttttaatttatatgagacagggtttcgccatgttggccaggctggtcttgaactcctgacctcaggtgatctgcccaccttggcctcccaaagtgctgggactgcaggcatgagccaccgagcccagccaggatacatttcattctgtgttccattggtcaatattatcaaatagatgatatggggttaaattcacatcgatagcagcctcattggggaaataaaatcataacttggtagcctgaaagcaatgtataaggataagcagctttcctgtcaccttggtgacagtcaggaagtagaatggaaacctcaggtttgatggctcggagcctctttgttccgttatcctcctgtcagtctatgagagactttctcccctctggatcattgcagtagcttccatggtttcagtgttgtcgttaagtgaaaaaaaaaaaatcatcctaatacaacgaaaagagaaaagataggtggaaaataacaagtccagtgataaagcgggctctgtcttcaggaccgaagtgtggggaggtgtaggacaaaagtgaagttagggccgagccacgtggaatggctaatgctgggcaggcgtccaaggaaccgaccttggagccctgcaggagcgtgggatgagagcctgcttgcaaacaagatcaccgagttctgtttcaagtgagagtggacgggaagggggagttagaagaggagatttctcctctagagggttcaatgtcagaagggctcagggtggtttaggatgaaattatttccactgaattttaaattgagctgtaattaaaaaacacttatgaggatagattttcgctgactttctgttacaaagattataagaaaataaaatttggagatcttcaagaaatggcagacagttatctatggtgaggaacaatttctatgctgtcagactcctcccatccacctgcgtggttctcagccagacctccaactgcaggaggagccaccaggacccgttggcagcatcctgcatttgtcaagctagtggatgctgggtgaggtattgacccggactctgaactgtgaaaggaacctctcctcatgaagggatgcagagatgctctggaagttggtccaaggtgaaattactgtaacttctgtgcagttgattcttttcttttcttctttagttaatagggaaaggaagtttggtgatggaggggcagaaacacctgaactctaagaagaaaggtgagtgtacatgcttttcccggaagcaaacaggatatttttaaattccagaaaacaattcttggccaggcgcggtggctcatgcctgtaatcccagcactttgggaggccgaggtgggcggatcacgatgtcgggagatcgagaccatcttggctaacatggtgaaaccccgtctctactaaaaatacaaaaaaaaattagccggacgtcggggcgggcccctgtagtcccagctactcgggaggctgaggcaggagaatggcgtgaacccgggaggcggagcttgcagtgagccgagatcatgccactgcgctccagcctgggcgacagagcgagactccgtctcaaaaaaaaaaaaaaataaataaaataaaataaaataaaataaaataaaaaaattcttatccacagaagtaatggaattggagcactaacagttatcacaggagaagagaaaaatgagaagtaacttgcaccatggtgcctgcactggctcagtgaaaagtacatatggttagatgccgttggcaggtgaatgtgcattctgattttcctgtatattccctcttctctttcaggactgaaagcctccttctctctctcactgaccttcacttcgagactggcccctgatccttccctggtgatctatgccatttttcccagtggaggtgttgtagctgacaaaattcagttctcagtcgagatgtgctttgacaatcaggtaaaatgatagcggagaagggtgaagataaaagttgggcatagagaaagatcttgtgtgtgctgcggttggaaacaagacaagtcagggaaagaagatagtgttgacgttggatgttgtattatatttatatctttagtgtttggggtttgtgttgaaatccatctctctcctactttttattttaagaagtcatgctggctgaggtgcagtggctcactcctgtaatcccagtgctttgggaggccaaggcagagggatttctttaggtcaagggttcaagaccagcctggacaacatagcaagatcctgtctgtacaaaaaaatttttaattagctgggtgtgcagcactttgggaggccgaggtgggtggatcacctgatgccaggagttcaagaccagcctggtgaaaccgtgtctctactaaaaatacaaaaattagccaagcatggtggtggatgcctgcaatcccagctacttgggaggctgaggcaggagaattgcatgaacccaggagacggaggttgcagtgagcaaagaacacaccattacactccagcctgagtgacagagtgagactctgtctcaaaaaaaaaaaaaaaaattagttgagtgtggtgatgcatacctgtagtcccagctagtcggaaggctgaagcaggtgtatcgcttgagccccaggagttcaacggctgcagagcgagaccctgtctattttttttatttttaaaaaacagagttttctttttgttgccaaggttgaagcgcaatgggggaatttcggttaattgcagcctttgctttttgggttaaagggatttttttgcttaaaactcccgagtagctgggtttacaagtttgccccaccatgccgggtttttttttttttttttttttgggtttttaaaaagggggggggcttccccatgaaaccccggggggcttggaccctcgtcacagggataccccccggtttggcccccaaaggggggggaatacacgggaagcccctttttttttaaaaaaaaaaaaaaaaaaacccctttggggggaccccctgtttttatatttttttcccacggggtctccttttttttggttttaaaaattttttttttttttttgggggggggcggggttccccactttttttgggggaacccccctttggggagggggtgttttttaaaaaaagaatgttcccacggannnnnnnnnnnnnnnnnnnntacttggtgtaatccatcaccccccaaacccctatggggagtccagtcacttcataggattaaatcccttgcaattccaaagtttgattttcatatgtaggaggtatctcatgtgcctggccagaatattgtaaaacttaagtgtcataaaagggcaaacatttatctaacaggtttctatgggtcattaatctgggtgcagcttagctgggtgcctctggctcaaggtatctcatgaggttgcaatcaagctgtcagtcaggactctggtgtcatttgaagactcgactaggagaggattgatttttcaagctcatcccaaagtctctgatccttacaggctgctagactgaaggacacagttcttgacctcagcttttggctaggggcctcactcagtatctcatcacatgaatctctctggtggggtgcctcatcacacaacagctgtttttcccagagcaagcagtttgagaaaaggggtgcrcccaagatggaagctgcagtcttttagtagctgggattacaagtatgcccccccatgcctggcttttttttttttttttttttttgtatttttagtagagacggggtttcaccatgttaggccaggctggtcttgaactcctgacctcaggtcatccacctgccttggcctcccaatgtgctgggattacaggcatgaccctgtctctattaaaaaaaaaaaaaaaaaaaagccatactgggaagccacatgttctatatagttattccacatgttctctctactttttgtcttctaaactttctctatccttctactgtgctgctcacgtttcccaactctatcacggcatacacgtcctgaagagctagactttacaaagaaagataagtacaaaagtgaaagaatgggttggatgtcatagctggggcatatttgctgatgacccaaattatgttgtttcccttcctttccaggctgacctgatccccaagttatacctttcccttccccaggtktcccttggcttctccccctcccagcagcttccaggagcagaagtggagctgcagctgcaggcagctcccggatccctgtgtgcgctccgggcggtggatgagagtgtcttactgcttaggccagacagagagctgagcaaccgctctgtgagtaactgtctgctgacagagtgggaggagggagttgatggagaagacaattaagaggtaggtttcaggcaggggagagaaagtcttagggaaataatgcactgccataaggcggtaaaaaggctggtgtgaaaatgaagttagaaagtgtaagagggctgggcacggtggctcacgcctgtaatcccagtgctttgtgaggccgaggctggcagatcacctgaggtcgggagttcgagaccagcctgaccaacatggagaaactctgtctctactaaaaatccagaaaaaaaaaaaaaaaattaactgggcatgggcccatgcctgtaatcctggggaggctgaggcaggagaatcacttgaacctgggaggcggaggttgtatcattgccctccagcctgggcaacaagagcaaaactctgtctcaaaaacaaaaaaaaaaaaacaaaaacaaaaaaagaaaggataagagaaaggcatggttagtatgaatgcagagacaagaaaagagaatgagcctgtaatcccagaactttaggagaccaaggcaggcagatcacctgaggtctggggttcaagaccagcctgaccaacatggtgaaaccctgtctctactaaaaatacaaaaattagccaggcatggtggcgcatgcctgtaatcccaactactcaggaggctgaggcaggagaattgcgtgaacccgggaggcagaggttgcagtgagccgagatcgtcccactgcacttcaatctgggcgacagagcaagactccgtctcaaaaaaaaaacaagaaagagaacgaaataggggataggattatgaaaaaataggtgagatagaggttaaagttttagacagtgagaaaggtaattatgacagaatgaatataaaaataattctgaagtaataaagagaaatgatacaggagtagtgaactgagcaccagaatctgagagaagtttctcaactgatatcactatatcaatgctttatttcctctccccctcttgtcccaggtctatgggatgtttccattctggtatggtcactacccctatcaagtggctgagtatgatcagtgtccagtgtctggcccatgggactttcctcagcccctcattgacccaatgccccaagggcattcgagccagcgttccattatctggaggccctcgttctctgaaggcacggaccttttcagctttttccgggtaggtcttcttacccattttgttcttatgggaaagatggtggtgggaatgggcaaaggaaagttcatatctaagaaagcagagagactcatatgggcactgatgggaacaaaatcttgaaagaagcttctgacgtgtaaggtcgcctctgttggcccttatgcttgaagaagatgtccaacctagtcttcctctttttgttgtcctcaaacactgatttccatgagatcaatcaggagggaaaattagagaaggtagaccagaggtctcttatcattattataaaaaataatttgcacctattctatgagcaggatttgggatgctgtgtgacccaagtctgaccaggaggtccctgaggtcaggaactaggtcttgttcatctttgtattctctctaatgcctgacccttcataaggctcattgtatttttgttgaattgagtacgctgatatggtccctaccctcagcatgtttacagcgtaagtcaaatagtaaggacatagcgaataatatttggcagaaccattacatgtatgtaatgatgaaataagtttaactgaaagcctttcatgctagctggaacagaagccaaccagcctcagtggctgagtttcaggtaagaacacccaggttcaccattaattcaaaaagaatgttttgtttcaactctttgatggtggaattcctgggcagtagcccttgtagttggggaagggaccaccttaatacttatttctctgatgcctatcaggacgtgggcctgaaaatactgtccaatgccaaaatcaagaagccagtagattgcagtcacagatctccagaatacagcactgctatgggtggtaagccacctctgtggtctgtggattctctgagatgttaacagtcctggaactctgcagatttcctcttgcctcctgttcttgcactgagcctctagcccgagaatgctaatgggttgtgggtcacagatgcaggacagtttcccaagtgttctctctctggggagagcttttgaagcctgaagcttatgtatccattccccggccaaacctccttggctatcacttccctcgatggcctttgtgactagttagttcctctttggtccttcctccttgcctctgactggatgttctctgcttccctctaaatttctttctagtaatccctccatcccaatttatgtcacaacaagaagtctcctgtttcctaaagttttcgtattctcaatttcatcagcaggcggtggtcatccagaggcttttgagtcatcaactcctttacatcaagcagaggattctcaggtccgccagtacttcccagagacctggctctgggatctgtttcctattgggtaagtgatgactcaaaagtacagtaaagggccaggtgcatggctcacgcctgtaatcccarcactttgggaggcttaggagggaggatcacttgagaccaggagttcaagaccagcctgggcaacataatgagcttctgtctctacaaaagaaatwaaaaaaatagccagatggtagttgtgtcctacttggaaggcygaggtggaaggatcacttgagtctgggaggtggaggctgcagtgaagcaagatcacattgcttcactcctgcttgggtgacagagcaaaacccttctcaaaatcaacaacgacaacgacaacaacaaacccagaaaaaaaacagtaagattctgcaatgtagagcctgtagaaaactcagaatcagacgcattcctaatggatctaaatcttaagcaaagaaagcttgatggggtgtgggaatttatttattttccggaattctttttttctttttatttttaagacagagtcttgctctgtcacccaggctggagtgcagtggcatgattttggctcactgtaggcctcaacctcctaggttcaagcaattcttgtgcctcagcctcccaagtagctgggactataggcacatgccaccacacctggctaagttttgtatttttagtagaggcagggttttgctatgttggccaggctagtcttgaactcctggcctcaagtgatccacccgccttggcctcccaaagtgttgggattacaggtgtgagccactgcgcccggcctacctgaattcttcatgcattcatatacaaccactcaaaacaaatccacacaattccacactcacacattgcaggccctgtgttctcactacagaaccacacacatttaaaggtatatattgacatcaatttttgctcactgcttgcatatccattttgacaagccctgagaccacacatcctcagactcagagggcaccagcctctctgtcagatgtgcttgcacagagatgcccaccccgactccccaccatagtccccctcctccgtatgagtgcagcctcactcacactgagactcacctgttcagttgcctctttacttctccccatacaataacaataacaattttacttctgcagatgaatttgtagctttttttttttggacagggtcttgccctgtcacccaggctggagtgcagtggtgcaatcatagctcactgcagcctcaaactcctgggctcaagcaatcctcctgcctcagcctcctaagtagctgggactataggcatgcaccaccacacctggctaatttttaaatttttggtagaaatagggtcttgctatgtttcccaggctggcctcaaactgctgggctgaagctatctgctcacctcagcctctcaaagagctgggattacaagtgtaagccagcacaccccaccgaatttgtggcttaattcacaaatgttctccttgccccacgctacctctgcctcatgttggtccttgtgttttcacagtaactcggggaaggaggyggtccacgtcacagttcctgacgccatcaccgagtggaaggcgatgagtttctgcacttcccagtcaagaggcttcgggctttcacccactgttggactaactgctttcaagccrttctttgttgacctgactctcccttactcagtagtccgtggggaatcctttcgtcttactgccaccatcttcaattacctaaaggattgcatcagggtgagagctggggatacaggaatcaggtgtcagccctggaatcacacctcccccataastttgtctctaaattggaagcatcccaattttccctgggaaagagaggagatgtcggcgtctcagcccccaggtttccccaggcctctatgcactacctcctttgtttgtaccctttgtctcttaaacatcctccgtaggttcagactgacctggctaaatcgcatgagtaccagctagaatcatgggcagattctcagacctccagttgtctctgtgctgatgamgcaaaaacccaccactggaacatcacagctgtcaaattgggtaagagagggaagtggtagacgggcgaggaaagccagcagcagaagaccagtgactgagcactcagtcttttcctctgccacatctgctttgcttcctcctccattttccactatttttctccctcctaaggctgttataagtcaatacacaaacactctttgataggtgaccaaacaaatttgttcaaaccggaatattttgagtgtgaaagggagagcttttaatatttatagctggacaaggaatacatggtcatgtaactaatcaaggacttactataagagtccctgggccaggcactattctaactgctttacatatattaactcattaaattgattgactaattaatttttattttatttatttatttttgagaggaagtctcgctctgttgcgcaggctggagtgcagtggtgcaatctgtgcttactgcaacctccacctcctgggttcaagtgattctcctgccaagcctcccaagtagctaggattacagtcgcgtgccaccctacccggctaatttttgtacttttagtagaggtggggttttgccatgttggccaggctggtctcaaactcctgacctcaggtgacctgcctgcctcggcctcccaaagtgctgggattacaggcgtgagccgctgcgcctggccttttatttttttttagagagacaagatcttactctgtcacctaagctggagtacagtggtgtggtcattgctcactgcagcctcaacctcccaggctcaagcgatcctctcacctaggcctccggagtagctgggactataggctcatgccaccaccatgcctggctaattcagttggcagagaagcggtcttgctctgttgcccaggctgttctcaaactcctgggttcaagtgattctcccgcctcacccttccaaagtactgggattacaagaatgagtcacygcacctttaacttgtttaatcctcacccccaaccctatgggatgtcagtcactcatagattaaatccttgcaactcaaagtttgattttcatatgtatgagttatctcatgttgcttgacaaattattgtaaaacttaagtgtcataaaaggacaaacattatcaaacagattctatgggtcattaatctgggtgcagcttagctgggtacctctggctcaaggtatctcatgaggttgcaatcaagctgtcagtcaggactctggtttcatctgaagactcgactaggagaggattgatttttcaagctcatcccaaagtctctgatccttacaggctgctagactgaaggacacagttcttgacctcagcttttggctaggggcctcactcagtatctcatcacatgaatctctctgctgggctgcctcatcacacaacagctgtcttccccagagcaagcagtttgagaaaaggggtgcrcccaagatggaagctgcagtcttttttgtaacctaatcccagaagagtcattactttcaccctgttctctttaacagaagcgagtcactcaatccagctcacactcaatggatgtaaatatcaggatgcagggatctctgagggcccttagaggttacctaccacactggactagcctctctggcatcacctgggagcttgttagaaatgcagaatatgggccccaccccaggtctatggcagcagagtttgcactgttgcaagatccccattaaagtttcagaaatgctgatccaaatgggaatggacctcactggtacctctggcaatagggctaatggcttcccttcttctttctctcaggtcacattaactttactattagtacaaagattctggacagcaatgaaccatgtgggggccagaaggggtttgttccccaaaagggccgaagtgacacgctcatcaagccagttctcgtcaaagtgagttttcttcagaggtagagacagcaaccaaccgagggatgctcagcatctcgtcttgctgtgagttagtctctcacagcaaccatactccagtccaaccaggcagcttcaactttctccttccctggccccttgaacatttgcctaatccacacccacggcctatgaaagcacctaaaaccsggcacctcataggcactcaacaaatgttagtttacctaattaaaatgtctgtcttcatcaatagctgcctttttcgtcccatcatgaagcccattgtcaatcttgcctcttagaagttgcctaaatgtgkctttggctctagcacttgcccagaaagaactttacagaaagggcccatccttgggttgacgcagagttckkytgassywsagtgagaagctcttgtctgcagttctgagggaagccctgggggcacagcgaggggcctcccttccctttcctttagtgccatccctcctgatgttcatctttgttgtttttatctgtgtctctcttcatcgcagcctgagggagtcctggtggagaagacacacagctcattgctgtgcccaaaaggtgggtggactcagagcaggattggtggtgagaattcccttagagggcaggagattttcttttcattttttttttttttttgagacggagtctcgctccgtcgtccaggctggattgcagtggcacgatttcagctcattgcaacctctgcctcccgggttcaagtgattctactgccttagtctcctgagtagctgggactacaggtacatgccaccatgcctggctaatttttgtatttttagtagagatggggtttcaccatattggccaggctggtctcgaactcctgaccttgtgatcctcctgccttggcctcccaaagtgctgggattacaggcgtgagcyactgcacccggcagcaggagattttcataggcaaaaggaggaatgcatagtaccagaaggaataggagagtctgaagtgccattcctcatggggctgattaactgggaggcaggaggaagaagagaaagtgtgcagcacgatgatgactctctgtggaatttattttcagcaagatcactatgaatagtacccagtgctttctgcatcccagagaaagcaccgagtacagaaatccctggattatagaaagttcttctaaaattttgtcttgagaacccctgccattccccatcttctattgtgtcacctttttttctgcatctsacaggaaaggtggcatctgaatctgtctccctggagctcccagtggacattgttcctgactcgaccaaggcttatgttacggttctgggtaagcagttagagattcttgactcagaaaggaaaaggckaatggaggctgcaaaggtgtggagtggggcgggacatacggacctatccggagagtgtaactaataacaagtgatgaaggaaaaagagcstattttatataggagggaaatacagtgtaggcaacagtacagatgggattagacttgtactctagttaaaaatggaagagagtcagggtaggaagaaggtaaggtcgctgatgcttgattttaggtttagacagtctataaattgggtgaagggaaaacagaatatttgcagcaaccattttcaaaactgaggaatttgggtatagtttagggaagatacaaccatatttacaataggcagcacacttactgtttggggcaagggaggaagtgggttgaaaagcatgaacktagaaatcatatctaacctgtcatttaatagccatgtgaccctgaacaagttagtgaacagttctgggccttctttcctcttctgtaaaacagtgataataacctacctctcagactggtgtaaagattaaatgcaatataaagtccccagcacaatatctagcatgtagtaggagccctatgaatgttaggctctttctttactccctcaccctctattgagatcctttgcagtcacagtgtctctgttttgtctattttattcgtaagtctgacatagcacttatcttattgtattagagttcactgtctatatctgtcttccacactgtgttgggggctcctgaagaggaagggccacatctttttcttttgtgttcctagtacagttcctgcaacatagttgacattcaggacacatttatagattgaattgagcttgttggctacaatgcagatgttaatgagtcacttatgtcaggttcactggcttgggaagtatatgaaggggtcagtgacaacttggaaaagagtgtcagaactgtgttttagagaaacttggtgatttggagggtgaggaacgtacatgcagtggtagaggagcttaagagattgatcctaagtgttataagttttgtcacatcactcatcagctcagtgacatgtcttcttaaaagccctgaactctcttagatagcttatgtgcctctccgtgtcccctagcacctcgtacatatccagtatgacattgtagtactgtattaaaattgtttataatgaataaaaattgtaatgtgttgtaatggtttgctcctctgtgagtttttttgagggtagagaccgagtttgatttactgtggtcttcccaggacacacagtaggtactttttttttttttttttttgtatttttagtagagacagggtttgtccatgttggtcaggctggtctcgaactcctgacctcaggtgatccaccctcctcggcctcccatactgctggaattacaggcgtgagccaccacgcccggcccatagtaggtacttattaaatgatagctaatacgtgtttgttcagtgaatgatgataactcttagagggtcccttcttctctgtaccccyaccttctctctctccttttggatcccaggagacattatgggcacagcyctgcagaacctggatggtctggtgcagatgcccagtggctrtggcgagcagaacatggtcttgtttgctcccatcatctatgtcttgcagtacctggagaaggcagggctgctgacggaggagatcaggtctcgggcagtgggtttcctggaaataggtaagttggttcagtctttctttcttgaacactctcctccactaggccctatgacagattgatgatacagggaattccagcccctcaagtgtcccatatccttgaacggcatgggggtgttttctgaagttgtcgctgtgatctaaaaccacatttggcttcccagggtaccagaaggagctgatgtacaaacacagcaatggctcatacagtgcctttggggagcgagatggaaatggaaacacatggtaatatcacccaattcccaatgagttctgtactccagagcrtaattcctgagccctctggaactattccactacctctccccttaacccctttccttcttgcactcagtcttctacctctttaatactgtttatttcaccctcatggatggtcaagtccctcgatcttcctgagcttgtgcctcccctgttcttgtcctcattggtgcccattaatgcctctcttttctaggcctgctatggcatatgttccctcagctccccttctggaagtatacacccaaataaatgaagaaatgattgcaccctcacctggaaattcctcttcatgccatattttcctctttacccatgtaggctgacagcgtttgtcacaaaatgctttggccaagctcagaaattcatcttcattgatcccaagaacatccaggatgctctcaagtggatggcaggaaaccagctccccagtggctgctatgccaacgtrggaaatctccttcayacagctatgaaggtgcggatctgtccaggagcctgcagccaaccactgtctcgaaggaccccacacctctgaccgagtagaagcaaaagagcactggcctgggaatcagttttctcctgatctccactgtggctctgggtgaccgtgatcaaaatgcttagctggtctgggcctcagttttcatgtctgtagaatgagaatacagatgaagcctgggtgcagtggctcatgcctgtaatcccagcactttgggaggccgaggcgggcagatcgtttgggcccrggagtttgagaccaccctgggcaacatggtgaaaccccatctctacaaaaaaaatatgaaaaattaatcaggcttgttagtgcatgcctgtagtcccagctacttgggtggttgaggttggaggatcacttgaacccaggaggtcaagcctgcagtgagccgtgattgcaccactgcaccccaacctgggtgaccgagtgagaccctgcctcaaaaagaaaaagagaatgtggactggaacatggttctcaaagcatagttcccagatcaggagcattggcatcacatgggaacttgttggaaacgcagattctgactcccagcccacacctactgaatgagaaactctgggagggtgggccagaaatttgtgttttgacaagccctcctgattattctgatacacactgaaatttgatactactggactaaaagatctctgggcctcttactgtgtcaccaaatccatctgggaaagccatttcctgtggtgaggactagtaggcagcccaacgtcttttgtaagaagtttactctattggkcactattctaggcacgtggtttatttgatattatttcatgtttacaacaaatcaatgagctaggtattggtatgccattattaatcccattttacagatgaagaaactaagccatggagactaagtaaattgcccaaggtgcatgctaataagtggcaggactgagatttgaaccaggcagttgcactccagaggcactgctttcttctgttcactaccttgtctgtacctgtcccaagcagagggcgaggcgtagatcctgcaggataacttgttcaattcaggacacactcagtgcaagaaagacttgtataaacttttctagagagatcacttacattgctattccagggcaaggattaaaaatcttgagtgttaaaaaaaaaatctatttataggattcattagtcttcctctgcaggatcttattagtctcccctaagtttttgtcttcttcttctcttatacactgtatgaaatatgcgtgggggccaggcgcagtggctcatgcttgtaatcccagcattctgggaggctgaggcgagtggatcatgaggtcaggaattagagaccagtctgaaaccctgtctctactaagataaaggacttgactagagcaagatctcagaggtattcttccttctttcccttttttttcttttctttttttcttgagacaagagtcttactctgttgtacaggctggagtgtagttgcgcaatcccagctcactgcaacctctacctcctgggttcaagtgatctcagcctcctgagcagctgggactacaggcatgtgccaccatgcctggctactttttgtatttttagtagagatggggtttcaccatgtttggccaggctggtcttgaactcctggcctcaagtgatccacccgccttgacctcccaaagtgctgggattacaagcgtgacctatgcgtgcccagcctcttcctactttcttttgagagcaggccagtccattgagaaatccatcctctgtgtagmcaaggttagtggtgtggcacatgagctccagagttaaatgtcctgggttcaaattccagtcctgctgcagatgagccatgtaaccgtgagcaagctatttaatctttttatttatttacttattcatttttttgagacagggtctcactctgtcacccaggctgaagtgcagtggcacgatcatggctcactgcagccttgacctccccgggctcagatgatcctcctactttagcttcctgaatagctgggaccacggatccacgtgccacyacacctggctaatttttgcaggttttgtagagttggggttttaccgtgttgcccaggctggcctcaaactcctgagctcaagcgatcctccccaccgacttggcctcaagctgggataataggcataaaccactgtgcgtgaccacaagctatttaatcttgttaagtgtttgttttcttatttatagaatgaggataataatttgagtagatatttttaaaaatttgcttagctctttctgggaaaggcgataagcagggaaggtctcacctaatctctgctggagaagggctgggtattgtgctgcttgaggggagctgcatgtgaggaggctcagatgcggtgatgcggcagattctctccttattcctcccttctttaaagctcttacccttcctaactccttctcttgggtttcttaaatacccactcagctgaagtccacatgctgcctcctgcaggctgtttaaggctgtgcagttatgaagtccaaactgttccctctttgtgtgtcctggaggcttggagctgcaraaagcctgtggaaaaaagagctttcttttcttttttctttttaaaaattattcatctattcagaggggaggctgttttgcaatctgcacataattcttgcagctgctgcctgytgccctgactcactgcctccctgtttgcctctagggtggtgytgatgatgaggtctccttgactgcgtatgtcacagctgcattgctggagatgggaaaggatgtagatgtaagttctcctggctcctgctcttgataccctccttctcatgcgtattcctagagacattcacccatctttgtctctagtcacccttttaaggtcaagaaggataagatgatttcctgattacttgccatttttaaaggaatgccttataagttatagtcttcatcttcactttttaggacccaatggtgagtcagggtctayggtgtctcaagaattyggccacctccaygaccaacctctacacacaggccctgttggcttacattttctccctggctggggaaatggacatcagaaacattctccttaaacagttagatcaacaggctatcatctcaggtatgttggtcctgttgagagttctttgaaattgtgaacataagctgtgagttatctataatctccctagtaacctctgtcccacacatgtactctaggattcattttagtaacagttattaagtcatcaaattattgttgggaggtttgtgagaaacacacgcaagtgctcaaagggcatttttatacttttttttcttttctttttgagacggagtcttgctctgttgcccaggctggagtgcagtggcgtgatctcggctcactccaagttccgcctcccgggttcacgccattctcctgcctcagcctccccagtagctgggactacaggcgcccaccaccacgcccggcgaattttttgtatttttagtagagacggggtttcaccgtgttagccaggatggtctcgatctcctgacctcatgatccacccgcctcggcctcccaaagtgctggtattacaggcatgagccaccacgcccgagtttctctcttcttgcccaagctggagtgcaatggcgtgatctcagctcactgcaacctctgcctcccaggatcaagcaactctcctgcctcagcctcccgagtagatgggattacaggtgtgtgccatcatgcacagctaatttttgtatttttagtagagaaggggtttcgccctgttgaccagggtggtctcgaattcttgacctcaggtgatccacctgcctcggcctcccaaagtgctgggattacaggcgtgagccaccatgcctggccacatttttatacttttaatgtgaagagaaactacattgaagaagctagtcggaaaatatattggcattgtggaatcacccttttggagatctttgaaagtgctttgatgtaggaccactttaaatatttttaaaaatttttattttactttttatttttttgagacggtgtcttgctctgtcacccaggctggagtgcagtggtgcaatcttggctcactgcaacctttgcctcctgggttcaagtgattctcctgcctcagcctcccgagtagctgggattacaggtgcccgccaccacactggctaatctttgtatttttagtagagagggggtttcaccatgttggccaggctggtctcagaatcctgacctcaagtgatctgcccctcttggcctcccaaagtgctgaattacaagcgtgagccattgcacctggcctggaccactttaaatatatttagaatactatttgaagtatgacagatcttgtaaataaaatattaatgcatttcatttatctggctgtgtatttaaaattattcttccaggcagaagtgcagtctcagccttcatttatatgagcgtcatggctgagctgtcctctcacagggggtcaggtagttttttctcttgtgtctaagcaactccagtcatgaaatgttgtccgagacaatgggttaaatacacctgttccaccgtrtattggtttattgtgatgatctcttttccattatcttgtattgcaagctcacatgtttcctgttacgttcttccaattagattgcccttctgtggttacttattatctctaaaattctgtttaattagtcttctaacktacagtcttctcatttcttatttatttttcttcaagttatccattatctgtcatcttggctgtcacagaggtttcttttggtctcattctattggactgccttctaagcatgtttcatatagttrrcctcattagcatttcttcatggtttctcagaattctttcatatactctgccatttttattctacttaaaatgttaaatctttttttttttttgagactgggtttcgctcttgttttgttgcccaggttggagtgcattggygtgatctcagttcaccgcaacctccacctcccgggttcaaatgattctcctgcctcagcctcccaagtagctgggattagaggcacgcgccaccacgcctggctaattttgtatttttagtagagttagggtttctccatgttggtcaggctggtctcaaactcccgacctcaggtgatccacccgcctcggcctcccaaagtgctggattacaggtgtgagccaccgcacccggcctaaatctttgattaaatgaaataaatgctgaaaaattcataaaactgtaagcaaacaaaaattgcccccaaacacagagattcttataagaagcttctatttacctatttccattagcatcaaaactgataaattaacaagggtggttttcatgtaattgctggaggcaggaacatttatcgatgcttctagctttacacacaggcacgcacatgcatccttgcatttacatcaaggtcaattaatcagctaaatctaagaaattttttttctactctgtttaattctcagttggtacttactctgctctaagatgctgcatttacaaagtgaatgtgggaaagccagttccttctaaggacatcctagttatgtttctttttccataggagaatccatttactggagccagaaacctactccatcatcgaacgccagcccttggtctgagcctgcggctgtagatgtggaactcacagcatatgcattgttggcccagcttaccaagcccagcctgactcaaaaggagatagcgaaggccactagcatagtggcttggttggccaagcaacgcaatgcatatgggggcttctcttctactcaggtaaacagcctgttctcccactgccacttatcaggtagaattagatcttgtgtggagatagaggaaaacatattgtccttgccttctcggtccaggggcttagagagaggaaaagcctgtgaacaatatatggaagtattcataaaatgggttataagagcacattaatagtaccagatgtatttaattttctttttttgttgttgaatgtgaaacattggggccgggcatggtggctcatgcctgtaataccagtgctttgggaggccgaggcaggcggatcacctgaggtcgggagttcgagaccagcctgaccaacatggagaaaccccatctctactaaaaatacaaaattagccaggcgtggtggcgggtgcctgtaatcccagctacctgggaggctgaggcaggagaatcgcttgaacccgggaggcagaggttgcggtgagccgagatggcgccattgcactccagcctgggcaacaagagttaaaactccgtctcaacaacaacaacacaacaacaacaacaaaaattttaactttgtttcagaaagattaatcagccacttggtgtgtgagataatttagagaggagaaacattggacttgaagagatcaggagactgtttcctttatctaggttaggggtaaggggaaattgggaaattgaatgagtggtgtggcagtatggaaaaaacagaggggtagaattgtatgataaactcaaatcataaaaaattattttagattataatgaagagagtagtcattaatctatgtattctgaaaatattaaatatctaccatgtccaaatcactttgatgaggctacagaaataactaagaaaatgtatttcttgttctcatgaagattatattctgatttgttgaaattagccaatttcactgaagatataacatgtaaatcagacctgaaagaatgaacatcttttaataggttgcatgtttggtaaaaatgttaaaagcaccaagtttaggccaggtgtggtggctcacgcctgtaatcccagcactttgggaggccgaggcaggtggatcacgaggtcaggagatcgagaccacggtgaaaccccatctctactaaaaatacaaaaaattagccgggcacagtggtgggygcctgtagtcccagctactcgggaggctgaggcaggagaatggcgtgaacccaggaggcggagcttgcagtgagccaagatcgcgccactgcactccagcctgggagacagagcaagactccatctcaaaaaaaaaaaaaaaaaaaaaaaaaaagcaccaagtttaaatatggtaatgacttaattgaaacttaaaaaaattatatggtactatgcctccctgtttcagggaaattcttggccaaagatcacaaaatactccttcttgctcggtcctgaataattataatatataataatatttttggaaagcagtgggtgaaatgtttacaactctcagtgacaggtatatgtcagaatcctttttcaatgaaatccttggctatcacaagaagtcatatatcatatattacccacactggtttttcagctgacagtgaggtccctttctttgaattgtctccatatgttcaagcagtaaaaaacctccctggctccagtccacaaaaggtaaacaaaaattgtttgtagatggtgaagctgcacagatagaacttcttcacagcttcaccagggtgggtgacctgtcttcctgttttgtaggacagtgataatgtcgaaataagaatgtatttttcatttgtgagatgaagaaatcgggtttttttttgtaatagatattttttataatagatattttacacgagtgagatataacaattttgttgaacacttcattcatttttctttccccttgtaatttatatgaattatgttttcagaatgaaacagttcaaatatcactgtaccatgctcacttagtgacagtttatctgtcttattcccagagaaataaaagattgtcacatggtataatggctaagaagccagcctgcagggaaggactttcctagggtcccttatactccttccaactgtcatgtagaagatcattacacagttaaatgacttcatagactgcaatttctagggctatcaagttactactgtttctcccccaaataaggaagctgtaaaatatatactgaacaattatccacttgcttctagcaataactcattctgaaactgttggtttctgaacatgaattgattaggttaaccaagtaatctgtggatgttcagtagtaccttgttgatggtgattttctataaaagcatgctactggctgggtrtggtggctcatgcctgtcatcccagcattttgggaggccaaggcagccggaccacctgaggttgggagttcaagactagcctgaccaacatggagaaaccccttctctactaaaaatacaaaattagccggatgtggtggcacacgcctgtaatcccagctacttgggaggcttagggaggagaatcacttgaacccaggaagcggaggttgcaatgagctgagatcgtgccattgcactccagcctgggcaacaaaagcaaaactccatctgaaaaaaaaaaaaagcaagctactgtgatttctaggccagcttctccagaggaggtgggtatagttctctaaatacttaaagaagtcatcatccaagccaactaacaacaaccagatgtgtgggttatagagttgttcaaggttaattccaatggctcacaaaatggtaagtatacgtttggttgtttccctcaggatactgtagttgctctccaagctcttgccaaatatgccactaccgcctacrtgccatctgaggagatcaacctggttgtaaaatccactgagaatttccagcgcacattcaacatacagtcagtyaacagattggtatttcagcaggataccctgcccaatrtccctggaatgtacacgttggaggcctcaggccagggctgtgtctatgtgcaggtaagtagagatccatgagaatgagcrgacattgggaaggagagtcggagagcatcttccccttaggccttctctctctctttctttctcacttgtaagaaaagtagtttgaactgtacaatctttaaagttctttccaastytgatttggctacctatttcttcctaccagacggtgttgagatacaatattctccctcccacaaatatgaagacctttagtcttagtgtggaaataggaaaagctagatgtgagcarccgacttcacctcgatccttgactctcactattcacaccaggtgattaaagctggggtgctggtggccggcagagcacctggtcataggagctgagctgggacacttgygtgtgtgtgtgkctgtgtatgtgtgtgtgtacgtgtgtgtgtgtgtgtgtgtgttggggatgcagagtgcactgaagtaataggctcacatgtgttttcttcttcctgctctcagttatgtggggagccgtagctcttccaatrtggctattgtggaagtgaagatgctatctgggttcagtcccatggagggcaccaatcagttagtaagttacttctgttttcttcatttatctagytgtgaggggacctaacgttataatttaaaaaactggtaaaatgggcatcatggcgtgtatacacacacacacacaaggcatgtatatacatacatatatatgtatgtatatgtatgtacacttgtaagaaaagtagttttcatatatatatatggcatccatatacacagtatgtgattatatatatgtgtgtgtatacatatgtaggtatatatacatgtatatatgtgcatgtatgtacatatatgtgtgcatatatgtatatattmatacacacaaactcatgattggattatttaaatgggctgcaaggttgtagcagatatatgacatgcaacttgtaatagtcttggttcccttttcctaccttttccacagtatatattgtttccttgatcatggcagagctttggaagactaccccagggaaggctctggctcttagtatcttttttttctccctctcttattcagcttctccagcaacccctggtgaagaaggttgaatttggaactgacacacttaacatttacttggatgaggtaggtattcaggaaccagatcaaagagctggattgcttacggatcttcatgacttcccttctaatctgtatatacgggtgtcacacacatggggatgaggggcctgggagtgagtccacaccatgccatgagttctgcctccatgctggtataccgtaaaacaccccattgtgcctctagaggagccctgtccaacagacctataatgtgagccgtttacgacatttgaagatttctggtagacatttaaaaagtatagaaacagatgaaattaagtttaacggtatattttatgcaagcttatacaccccaaatatttccattttaccatacaattaatatacagacgtattaatgagatatctacattctttttttttttctgtaccacatctttgaaatccagtatgtactttacactgtcagtgcatctcaattctgactgacctcatttcaagtgctcaatagccacaagtgacattgcaactctagagtatgttatagtggttaatagcagaagctctgaagccagactgcctgggctgtgatcttggttctagcattgactgagtaactggacaagctgttgaaagttagctgtaaaatgtgtgtgggtaggggtcaaaatagttcttttagagttatagaaaaaactaaattatttaagacatgtaaaaatatttagaactgtacctggtatagagtaagccctcatcactttatagctattcctatcattttaacataatgttaatattacttaatattaatcagacattgtatgtaacctttcattttaacaaaacaagaagttctcaaggactaacaatgttctaaagattgttacaatgttccttttcatgatattccattccacacaaggaacaaagttatccttattgaatataaccaaaagacaagaatatcccaaatcaaaacatactgttgttagtaacatccatttccaaccccctgcccacccaccaaccccatcatctaactgtgtttcctgtcttccagggagccagggttttttatgttgtgtgagccgtgtatagtttcttttttyttttttttttgagacgcagtctcgctctgtcacccaggctggagtgcagtggcacaatctcagctcactgtaagctctgcctcccgggttcatgccattctcctgcctcagcctcccgagtagctgggaccacatgcgcccgccaccatgcccggctaattttttgtatttttactagagacagggtttcaccgtgttagccaggatggtctcgatctcctgacctcgtgatccacccacctcggcctcccaaagtgttaggattacaggcgtaagccaccgcacccagccgagttgtgtatagtttcttttgagacagctcgggttagcttatctggcactaccctgtaatcatgatgttgctgtttaaaactttgccaagtttatgatgctttcatacatgacttattcaagtcttacagccaccctccttagacataaggagacagagttggagagagagagtgggttgtccaagtcataccatctgtcagtgtctagggtgggagcagaacctggggagtctgatttccatgacaccatgcctgagactgcaatgaactgctcctcagtgtgtcctgccaaatctgccagttggcttctaatttgagttaacaggcctaatgatctaaaagccagtgctaatcattgtatctgtggttatttcctcttttctgtgtgtcttctcccttgtgttcttgatcaatttcaccagaggatgaccttattcacatatatagtcttccttattttttgatgaacttacactataagcgtccctctaggtacatgccatccctctcccacaatctcagacaagmaatgtttttactgtcattcagttctaactatttcttaatttgttgggaaacacatggaatttttaaagccatccttttgttcctgatgtctaattttgttgcattatggtctgagaatacagtcttcatgatcctgattgcctggaatgtgctgaagtttcttccatgacctaatccatgatctgtttttgcaggtgttcagtgtgcactccaaaagaacatctatttcttttctcttgggcttggattctgatctagaagtctgagatcattatttctgttgttcatgtgtttgataactctgcttatttttctgcttgatttaacaatttctgaaaagcatgtgttaaaatatccaattatgatggtttttgtttgtttgtttagtatttttttggtagagacagcgtttcaccatgttggccaggctggtcttgaacttctgacctcaagtgatctgcctgcctaggcctcccaaagtgctggagttataggtgtgagccaccacgcctggcctctaattatgatatttgatttatccatttatccatacatttctgccaattgtttcctgatatatttgagactacataattagatatatatgttatgaacatatcttcttattaaattttccttatattagtacatactatcctttccccattactatatatgtgtatatatttatatcatttacttttgccttagattcttacactcccccaccgccacacacacacacacaatttttttcccttgccttgggtgccatttagtcagatattaaaactgctacctggccgggcgcagtggctcatgcctgtaatcccagcactttgggaggctgagacgggcagatcatgaggtcaggagatcaagaccatcctggctaacacagtgaaaccccgtctgtactaaaggtacaaaaagttagctgggcgtggtggcaggagcctgtagtcccagctactcaggtggctgaggcacaagaatggcgtgaacctgggaggcagagcttgcagtgagccgagattgcgccactgcactccagcctgggcaacggtgcaagactccatctcrgaaaaaagaaaaaaaaaaaaaaactgctaccccagctttcttttggttcatattagtcatttgctttaattcattatggtgaccaaatgatagaaaagaacagtggttctaaaaattctttgtttcagtgtccctttatactcttaatttactgaggacctcaaacagctttcggtgaagtgggttttaactattggtctttatcatattagaaattaaaactgagacaatcttaaaatatttattaattaatttaaaaatgataataaactcactacatcttaatataaataaaatttttgtgaaaataactattttctggccaggcgtggtggctcatgcctgtaatcccagcactttgggaggccgaggcgggtggatcacgagatcaggagttcgagatcaacctggccaatatggtgaaaccccatccatctctactgaaaacacaaaaattagctgggcatggttgtgcgtgccggtagtcccagctacttgagaggctgaggcagaagaatcgcctgaacctggcaggcagaggttgcggtgagccgagatcatgccactatactctagcctgggcaacagagtgagactccatctcaaaaaaaaaaaaaaagaaaaagaaaaagaaaataactattttccaaaacaaaaaaataagaatggtgacattgttttgcatttttgctttaatatctggcttaatcaaagagaatgaaattttcctatttactcctacattcaaaccgttgcaatattacacataaagtagcctctgataactctcctgtatacttgttttgttttttatttttttaaatcactttccccagaaggaaacaatctcctgtatatttgtaagagaatgagagtggaaaaaaaaagtcttaatatcattctaaaaataattctgacctctcagatattctgatgcaatctcggggatccctggagtaggggaggtccctcgaccacactttgagaagcactatacctgaagaactttggaaatcccttccaattaggcgttaatagcgctatatctaaatttataatacgatttttttttttttttgagacagggtctcactctgttgcccaggctggacttcagtggcccgatcttggctcactataatctccacctcctgggttcaaatgatccttccacctcagcttcccaagtagctaggatttatttttttatattaaagtaacttatacaattgccttagattctccatttgctaatttattcaacaaatatttactgaacaaccaacatatgccagtcacttttctaagtgatggagacgtagcaatgaaaacaatagatatgatacctggcctaagagtgctgatattctagtggagagacaacaatattcaggtttttaaaaattacatgtatatgtgtatacacacacattttttttcagtagtaataagtgctatgcagcataaggggataaagagtgctggtggggcaggccagggatgtgactctttttaaataaggtgttcaaggaaagcctctttgaggaggtatcatttgctcagggaccagattgaagaaagcaaaccagtaaggggcatagaactgttggagtaaaatgcaagcctctgtttctctggccactttgactaatttagtggagaagccatgggtcagggtggaccatgaacaaagggaaccagttcacaagagggccagagagctgtaagatcctaagaagaaagagccaggaagtcagcaggaggcaatgtctttaagactcatagggcagtagcggtacatagagggtttcagagaatctttttttaattaaaaaaaaaatttttttttaatttgagatggagtctcgctctgtcgcccaggctggagtgcagtggcgccatctcggctcactgcaacatctgcctcccaggttcaagcgattcttctgcctcagcctcctgagtagctgggattacaggtgccagccaccatgcccgactaatttttgtatttttagtagagatggggtttcaccatgttggccaggctggtctggaactcctgacctctggtgattcacccacttcggcctcccaaagtgctgggattagaggcatgagccaccgtgcctggcggggcttcagaaaatctacatgaagacagcaagggtcttttattccacattgcatacagtgtaattttcattttacttctaaggtactgtttcatctgtcttccccacagctcattaagaacrctcagacttacaccttcaccatcagccaaagtgtgctggtcaccaacttgaaaccagcaaccatcaaggtctatgactactacctaccaggtgagagggctgagctgaaatgagakctgagatcttacctgcatctcccaacttacttctgcctcattcttcatggcttctctcttaattttacaaatactccttcccaagccaagtagcacataattaaattatctaatctcctaaaatattttaattcagttgtgtgccatttttaagttgcgtacactagagacattttatrtgatcggagaacaatgtgaaccattgttctcraagggctatttctattatttttggtatgattaatagtttgtcacaatgtacaaatattagtgattgaarctttcttgtaattctgaatatgctcataacctgtagagattctctggaaggggctcaagcagtagcttttctgaagcattttycctctgaatataggaggccctcaaagtaataatatgwcttatttcatttcacagatgaacaggcaacaattcagtattctgatccctgtgaatgaggtaagtccagcggagaaatgggtggagttatgggttagggtggcagaagttaagaggagcctcttttcgagttactgtcattgtctttttttgagatagagtctcgcggtgttgcccaggctggagggcagtggcggaggttgagtggctcacttcccagcttcaagcgattctcctgcctcagcctcctgagttgctgggattataggcgcccaccatgatgcctggctaatttttgtatttttagtagagacagagtttcaccatgttgaccaggctggtctcgaactcctgacttcaggtgatctgcccacctcggcctcccaaagtgctgagattacaagcatgagccaccacactcagccctgttattgtcttttggaagctattgttgatagaaagtgagctttccttttttgtcttaaactttttttttttttttaaacaggatctggctctgttgcccaggctgyagtgcagtggcgtgatctcagctcactgcagcctctgcctcccaagttcaagcgattcttgtgcctcagcctcctgagtagctgggatgacaggcacgtgccatcacgcccagctaattttttttgtatttttaatagagatggggtttcgccatgttggtcaggctggtctcaaactcctggcctcaggtgatccgcctacttcagcctcccaaagtgctgggattacaggtgtaagccactgtgcccggcctgtcctaaactcttgaaaatagtttacagaagaaaaagctaatgcttggtattaaaacaatacttttttctatcagattgaaaatggattgatttttcctgatatttttacatgatacatctttgttatatgaaaatactaagacaaaagtaaaggttacctgattctacacctgtgagataacactattaataatccaactgtgcatttgtgagatttttttgtatatatakagagaggtcaagtatcctctatgtatgtaatgagcttctgagtatcacagtgtcttctattttttgtttgattgttcgcttttcaggataggagctggaaactcaattagtcctctgtgacatttactggagggtggaacattcttctgtcgcttgaagcagaactcattcaatcaaataatttaatttctctgactagtatatgggtaacaaatgaatatgtctgaacctcagctataatactttctactacctttgcaaggagatgggataggaacaatcactcagaggaggcgttgcatggrcagggtcatagggggaagaaaggtggtttagctgttttatttagccattcagggggctctccagagaggagacggtggtagagggtgaactagagaagataagaatgtcttcctaggccggatgcggtggctcacgcctgtaatcccagcactttgggattgcgaggtgggcggatcacttgaggtcaggagttcaagaccagcctggccaacatggtaaaacccgtctctactaacaatacaaagattagcctggtgtggtggcacgggcctgtaatcgcagccccttggaaggccaaggcaggagaatcgcctcaacactggaggtggaggttgcagtgagctgagattgtgccactgcactccagcctgggcaatgaggcaagaccctgtctcaaaaaataataaataataataataataatgtttttctagagtttcagtctaagggaaaatgtgatttagggctttggaaattggctaaaaaaataaaaatggaaaagaaaatctgtgcatttagttctatgcatatttctttggaaaccaaaagttcttttaaagatgatgatcatcctttcccccaaaactcacaatttggtttcttccttaaaccttttaacccagacttctcaaagaatcatcttaaagatgtgaggacaggttagaatagagaattttaattatggggctctgctcaaccagcccgctactgcagggcaaacagtgatggattacaagaaaagtggctggccagaatgccgtttccatctctctcggtttctcttctgcatgattctcccaacctctccccacatgggctatctatcacctatcaccgtgcaagcacttcctcagaggaatgcttttgttttggaaacaggtttggaggcaaagggataagggaagtaagatgaatgatatttaacagaaaagattctctaggcaattacacccttttatcctgggtatccactggatccattatgctccccttgattgcaaattctgactgaaaagtcagggaaaataagtacattctacaaaaataaaaaatgacagatgggacctacttaaactaaagagcttctgcacagcaaaagaaactatcaacagagtaaacagacagcctaaagaataggagaaaatattaacaaactgcctccagcaaagaactaatatccagaatctataaggaacttaaacaaatcaacaagaaaaaaacaaataatcccattaaaacgtgggcaaggggcatgagcagacacttctcaaaagaagagtacaagtggccaataaacatatgaaaaaatgctaaccatcactaatcatcagagaaatgcaaaatcaaaaccacaatgagataccatccacactagttagaatggctattattaaagtcagaaaataagagatgttggcgaggtagcagagaaaagggaatgctaacacactgttggtgggaaggtaaattagttcagccactgtggaaagcagtttggagttttctcaaagaattaaaaatagaattaacattcaacccagcaatctcactactgggtatatacacaaaggaaatacatctttctaccaaaaggacacatgcacctgtatgtttttcgcagcactattcacaatagcaaagacatggaatcagcctagatgttcatcaatggtagagtggataaagaaaatgtggtccatgtataccatggaatgctatgtagccataaaaaagaatgcaatcggcccagtgcggtggctcatacctgtaaacccagcactttgggaggccgaggtgggtggatcacctgaggtcaggacttcaagaccaacctggccaacatggcaaaaccccatctctactaaaaatacaaaaacctagcagggtgtggtggcaggtgcctataatcccagctactggggaggctgaggcaggagaattgcttgaacctgggaggtggaggttgcaatgagccgagatcatgccatcgcacttcagcctgggcgacaagagcaaaactccgtatctaaataaataaataaataaatagaatgtaatcatgtcctttgcagcagcatggatgcagctggaggccattatcctaagtgaattaatgcagaaacagaaaaccaaatactgcatgttctaacttttaagtgggagctaaacctgttgtacacatagacacaaagatagaaacaataaacactggagattccaaaagggagaagggaggaaagagggcaagagttgaaacctacattcaggtactatgttcactatttgggtaacgggatcactaactcaaaccacagcatcacgcaatatacccatgtaacaaaacctgcatatttaccccctgaatctaaacctgcatatgtatctcctgaatttaaaattgaaaaggccaggcatggtggctcactcctgtaatcccagcactttggtagtccaaggtgggtggatcgcttgagctctgagttcgagatcaacctaggcaacatggcaaaactccatctctaccaaaaatacaaaaattagccaggcatggtggcgtgttcctgtagtcccagctactccggaggctgaggtgggagaatcgcttgaacccaggaggaggaggttgcagtgagcctagtttgcaccactgcactccaacctgggtgatagggtgagaccttgtctcaaaaaaatagaataaaataaaataaataaaagcgtatactgaagagaatattcccccaagcccagggtcacagttgcattaattgttctgtacctttctcctccatccttgtgtctgtcctggtccttctaggagttcctatagtgagggcagatgggggaagatatgcaaaggaggtcattcccaagcttgcctcttgggtatcaaaggaagagagcagagggaactctaaagaaaagaaggtagttgtcaggtgcagcagctcacacctgtaatcccagcagttttggaggcttaggcgggcggatcactagagatcgggcattcaagatcagcctggctaacatggtgaaaccctgtccctactaaatatacaaaattagctgggcgtggtggcatgcgcctgtaatcccagctactcgggaggctgaggcaggagaattgcttgaacccgggaggcggaggttgcagtgagctgggattgcaccactgcactccagcctgggggacagagtgagacttggtgtccaaaaaaaaaaagaaggtagtcatgatcatgaaagccccttccactcactaaaagctccatcccatgtacattttgggtctgcagcacttaccagagcatcccctcttttggaacgaaaggaaatggtgatcctcaagacttaagaggttatgcgggcagaatacatcttaaatgattaggaaaactctttattcttgtatctttgggatttcagataggataaaaagaatattcttatgcttaaattatcaactacgctgaataaaaggatgttaatgagaacatgtacattgtccaactcattgaaatataaatatttgtgcatatttgagaaggtgattgtgaggattaggtggcatttagcattcaagtgacacttggtattacagtacttacagtaaatactgatacatacatttattatatgtcaggtattacaccaggcctgggaatacaaagataaataaaatgaagtttctcttctcaaaaagctcacagactagtggagggaggaaggaaacaaacaaattaacagttataatacagtgtgaccaaaaaaatgatagaagaaagcacaaaaagctacggaaggccaggtgtggtggctcatgcctgtaatcccagcaccttgggaggccgaggcaggcagatcacctgagatcaggagttcgagaccagcctggccaatatggtgaaacctcgtctgtagtaaaaatacaaaaaatcagccgagtgtggtggcaggtgcctataatcccagctaattgggaggctgaggcatgagaattgcttgcatctgagaggtggaggttgcagtgagcggagattgtagcactgcactccaggagcctgggcaacagagcaagactgtctaaaaaaaagaggtggggagaaagcacggtatttcacccaagtaattcagtgtactcatggattatgtgtgtgtatgtgtggggcggggtgggggcgtgggtagtgtctcctcaaagttagactgggaaacagagattggataatgacttgcttttcagaaagatcattctagcagtaatgtgaagaatggggtggagaagaagaaagccgaagtccttgaaaccatttaggagactgctacagttatccaggtaaaagctggtgaacggggagtgggagggggaggaggggacactcagcagctactcagcttagctgatagaatcaggaagacttactgacatcaaagacaaaacgtaccagacaattacacaggtggttttattcgggccattgcaatcaagaacacatgttcattaattaataacatctcagagaaaaggaaggggacctgaggtttcatagaggcagcaaacaaaagagtcatacatggatcttatgggagccataatgaaggatggagatgaggctttttatggaatatgtgtgagcagagtgattctttgcagttagcttttttgttggaacacaaaaggttggagggttttggaaaacaacacgatgggtaaatttcttaactgacctgttttacagaagcacagggttcaggtggttcaccagtgtcagagactaagtgaatgcaagaaaggagagtaagggaagaggctgggaagactgccagaattctagactgtggattacatacaggagaaaaaccttttcctctacctgttaggtttagtatacggggcctgcaaatgaaaccgagaaaagacagatgaaagggaaaggcttatttcacaagcatgtgacaacttcacagggaagaagtgaaaataagagaagcaatgaggaatgggggcttatatgccattttaacaaaggacaagttgtggaaacattaacaagaccaaggaagtgagatctgggcatttggggcagtaagttatgggaaggtaaatatatcggaggcactaatggaagataatgaccattttagtaagatttgtttacgcagattcaagttggtgctgactttctgtctcttgtcatataagttattctccttctcctgatatgggagagggggagagagacactttccttcataaggggaaatttatatcctgcttttaagtgtttcttaattgccttccagcacaaaatcctacttatgccaaagtggcacaatttggactggcatattttgatcccttttaactgggtggatggtgccatccatgcaggtacagatatagaaagagagaaaatagtgtgttcagtttactacattaagtttgagtggctgggtgtggtggctcacacctgtaatcacagcactttgggaggccgaggcgggtggatcacgaggtcaggagatcgagaccatcctggctaacacggtgaaaccccgtctgtactaaaaatacaaaaaattagctgggtgtggtggtgggtgcctgtagtcccagctactcgggaggctgaggcaggagaatggcgtgaacctgggaggtggagcttgcagtgagccgagattgcgccactgcactccagcctgggcgacagagcgagactctgtctcaaaaaaaaaaaagaaaaaagtttgagaatgtgtaagtcctgatggtgaagatgttgagatagtgggatataaagggtcatgtcaaccattaaagaaagaaatctgaagataaagactggcagttagcagcaaataagtagtgagaagccaagagtgttgaggactagctagggaacaggaaatgagaagaggagagactgaaagggagtgccaacatttcaacagcaaaggaagagaagggacttcagaacccaggatctcaccaatatttcttcccataacaatggcctcttgaaggctttcccttctcctacctcccccttgaatccccgccttcatcaaggatttggtaggaagtggaaaggaaccagtatcagaaaagaatcctacttttttttctttctaagaatcctaccttaataagcaaaatatgtcacatttggagcacagagaactttctatccttcttcctgtagccctgttgaaatatttatcatatctcatccagactgttgcaaaaacccagttgctgccccttctatgtcagaacattcctccacccctatgtctattattttattttacatattctctatacacaaggctgcctctattcaactaacccttagaattgtgtcaggtgatgtactgccagctatttaaaatctgggccaggtgcagtggctcccacctgtagtcccagcactttgggaagttgaggaaggaggatcacttgagcccagaagt

SEQ ID NO: 17869 - DNA, 28499 bp, Homo sapiens
gagcctttgccagatggatgagttctgtgtggaaatcgttgtgggggaagtgatgggagcagggaaaggaggggcgcaactgtgcggggcatctggcacctggggaggaactggggagccatggagggggccggccatgagcaggggaggtgctggggctggtgggaggttggctggaagggaggaatgcgaggaaggggcaaagagagctggcggacggggggtgaatgtcctttgttccgtccagcagcctctcctgaggacacttgcatgctaggccctctgctcggtgatgccggggaccctgaaggtccagtttgggggtaacccatctaggtgagctgtgtgacagtggcagtcgcagcactgcaggaacagaggaggatgctgatgggggacaggtgtgctggaaggagcctcccagactgagatggggtccccagaaagaggggtgtcccgaacctggcgctgtgactccagatctgccttgttcccgaccaacacaacggggaagtcgtcgcggtccttgacccgcagaatctgcgtgaagagcttgcccacctcgttgaaactgcgagtgaagccggaggcatgaggtccagccagctgcagagcccaggtcctccccacacccacccactgctccgccaccagtaacccctgtcacctctgccggtcgttaatggcgaacaccagcaggaagccgtggccagcacgcatgtactgctctctcatggccccgaactcttcctggcccgcggtgtccaggactgcagagacagggagaggggccatcgtggggaccaggctccccgcagtcacccccaagagccctcagcccccactgacaccacccccatccatcatccatccttgccgccctcactgtccagccgggctgggatgccatccacactgcagatcttcgtgtaggagtcctcaatagtggggtcgtagtcagacacgaagtaggactggcggggtggggagaggatagttactgcagtgccccggcagacaggacgaagccctgcccttgggatgcctctctcagtctctgtccctctctctctaaatgtctgtccctgttgctgggtctctgcccccttttctctgggtctctgtcccgtctgtctctctgaatcttttttttttttttttttttttgagacggagtttcgctcttgttgcacaggctggagtgcaatggcgagatctcggctcactgcaacctccgcctcctgggttcaagagattctcctgcctcagcctcccaagtagctgggattacaggcatgcgccaccacacctggctaattttgtatttttagtagagatgtgttggtcaggctgtgttggtcaggctggtctcgaactcctgacctcaggtgatccgcccgcctgggtctcccaaagtgctgggattacagatgtgagccactgcgccctgccctgtccttctctctctctccagatgtctgtccttgttgctgggtctctgcccccttttctctgggtctctgtcccctctgtctctctgagtctctattactctctctctctgggtctctgtccccttctctttgggtagctgctcccctgcccccctttccctgccccccacccctcctaccagtcttcttctctctgagtcactcctggtcctctctttctggtataaggtacatgtcccacatcgtgattacatcctagctgtgtgacactgaacaaatcacttcccctctctgagcctcagtttcctcatttgaaaaaggaggctaagaacagcactacactccatccagcactggcaagattcggagcaaaaccccattaaatattgaatgtatcagttatcggaggcgttgttgtccagactgcctgtttatatctctccctcctcttctgcttcctccctctcttcctcctcccccgtctcctcctcccccgtctccttctcctgctcaggcggcctccagcgtctcctcccaggggaaggtcccggttccaatccggctgcggagaggctgccccaccctcgggccccagcccctcccttcctgcctgggtcctgcccgctgccagccaagcctttggccagctctgggactgcctctgggtgcaaggggcccagggctggggcctttctctacacaagcagggcttcctcccaggcccttgaaggggtctcttggtgggggtgaggggggtgtcctggggccccggggcctctgcggtagcatgtcaggccaagacacttttctaggatttctttgaagctgggaggacctccctcaggaatggggaggaggtttcctgggctggggtggaatttcaggaaagggggtgatgtggaggctaggggtctgaaggctgcatctgtcggttagaggggtgcttggtgaggggcttgtcctggagggaggctgtaaggatcaagccctgggagggattgtggctctgggggtagttaggggcgtgacctcagagcacagcgtgagaagctcagggctgagaactgggagccagcccggaggtggctcaggggttttgggaggttatagtatatacagtcttagaaacattgagttcatttatggggtcagagaaactcccaaggaatagatctttctgggggtgccaagaatctgggggcttcttccatggagatgatttgagagctattcagggtttctgagaggggctcagggagttgcagcggagaaagcatgggatggaggaggggctggttttccttgggggtggggtgggagagtggaggtttgggcctccgggaatgggggattgtcaggacttggggtcttggagatttctggaatggccaaggggcaggatgtctttttaaatctcgggtcggagagcaggactctcttaggactgggtagtcccagaagagtctcagggccagggtctgggtagaatttctagattctgggggcagtcatggaaggggctaagaatcaaacgtggggccgggcacggtggctcatgcctgtaatcccagcactttgggagtccaaggcaggccgatcacgaggtcaggagttcgagaccagtccaatatggtgaaaccccgtctctactaaaaaatacaaaaattagccaggcatggtggcactcgcctgtagtctcagctacttgggaggctgaggcaggagaattgcttgaatccaggaggcagaggttgcagtgagccaacatcgcaccactgcactccaccgcactccagcctgggtgacagagtgagtgagactctgtctcaaaaaaaaaaaaaaagaaaaaaaagaatcgaacgtggtggaatctcaaaggtgctgggcactggcattctcccaggaaggctctcaatggcttagaggggaagttggggactgggatttgggggagatagggctcagggtggtggaaggtggcaccaagggcgtggtgggggtcctgggagtgcttagggtccgaatggggtgagtattttgtatttagcatgctcccaggaggtgctcaaagccaggtcagcaggtaagcggggtcttaggcactgggagagggaatagtgggtctcgggatgcgagtgcagaaggaagggtcccccgtgcaggggatggaggctctccaagagtttaggttacaatctgtggggatcttttaagattagagggccttataggagggtctcagtgatgggtcaagggggaaaaggggtctcggggatccccccaagggctcagttctgggtcccgggggacaccctcccgggtgagggcccactacctggatgaactggatggtcagcgcgctcttgcccacgccgccgccgcccacgaccaccagcttgtgtgtctcgctgggcggggggtccccgggcccaggtcccccgccccggggccgcccccgccctgtcccggacgccgccccgctgctcatgtcgccaccgctgctgctgccttcgctaccgcctgcgggggagccgggcgggacccgggggggcgggctacgctaatgaggctactgcataatcatgagctctggcaaggagggctcgcgtctccggacacttaaggagggggacgggccaaagaaagggaggagctatgttaataagggaaagggaacggcgttcgctgcgaaggggaattccgaatgaggcggggctatgctaatgagagacctgtgctttgccctgagcggcgccacgcgctctcagcgggagggcggtctgtgggcgtggctatgctaataagaatttattctttcagcagacggggcggaaagttcctcaggggaggggctatgcaaataaggacccctgtgacactgctgcttggggcatcgtctccgaggccttagtatggtaggcggagctcgtcgactcgcgcgcgcggccgtatatagggcgctccgaggaagcagcaggttttgaggagtagctccacctccctcctgggatcctagccaagctttcgaccccggcgtctgggttagaagctagagtctccgcccgctaagggacccaggcttccggttcccgctgtcccagccaagcggaagacagactgggaggagagtggggccctagagggggacagcagggtaacggggcagggaggggccgtgagatcactgcattcctaatccatgagccagctcgcccaagtagggatgcctgggtcatgaagagcctggggccaggatttctgggtcttgaaggagaaggaagcagagggcccagactcctgggtccttaggagaaaatggggctggagatgtggactcctgggtcctggggaggagggtgtcagggaggaaggtagacaggttccttcgtactaggttcggtaaaggagggagccgggggcctggactcttaggtccaggaattggagaggctggggacccaggattctggatccgagcgagggcactggcttggggggacccgaattcgtatgtgagagcttgagaccaggactagtctgggagaccgactcttggatccgaggaaggaagaatcagactcctgagtcggagggaggagggaaataggagtctggacactgctctgagtgagaggattcggaattcagacttctctgtactgaacgaggcggctatggggtcgggcttctaggttctaagtttatttttatttgtttatttttgagacggagtttccgtcttgtagcccatgctggagtgcaatggcgcgatcttggcccactgcaacctccgcttcccgggttcaagcgattctcctacctcagcctcccgagtagctgggattacaggcgttagccaccacgccaggctaatttttgtatttttagtagagactgggtttcaccatgttggtcaggctggtcttgaactcctgatatcagatgatccgcctgcttcggcctcccaaagtgctgggattacagacgtgagccaccgcgcctggcctatttttatttttttagaggcggggtctccctatattgcctaggctggcttctaacttctaggctcaagccatccttccgcctcagtctcccgagtgggactacggtgtgcgccactgcatcccgtctggttctaaatttaggggggcctagaggatctggattctgagagccccagaatgtgggcagcacaacatccagcaagtcgtgctcactccgccggactacaattcccttgcgtctgttctgcctggcgcctcttacgtcacctcctgttccgccaccctttccgcgcgcgcgcagggcactgtggggcgtcatcgcgggctaccgcggccccgcccacttcacctctcaccccattagctgtccccgcgcgacagaggcggtgcgcggactacgcctcccggcgtgcatcgcgcggaccccgccccatgtgtcccattggcttctgggaaaccgagtgcggttgccttcccgccggccttcacgtcgccgtgctcggtacttgaaatcccggcaagctcggcggcgctttagctccgcctctctcctcctttgctcacgaaccccgccccagcccgccccgccccgcgccggggccggagccgcagcccgagcggcggggtaagatggcggcggcagtccgggccgcggggctcgggcctattggggtgggcggggcggagttgggtcgctagttgtcccggggtcctccccacaagccacgggtcctagagggcttctcggggcggtctcgggcccggcagctgcggcgaaacctggcgccgagaggggggccttctcagggccccgggacgcatccgtgggttcctgggggcgtctatggggcgtctccgagaggacttggggcgtctctgggcctagaccgagcctaaggcctgccctccatcacacagctggcctggatcgtgtctgtagacactgtagattgtctttttgggctgaccggaggctagggtctggttagagggttctggggccatcttgagatcttgagatatgtcccaggggtgaaggagggtctgcaagacctgaagagtatcttcagagccatctagaggcctggggtatgtcttttagggctggaaagtgtctgcatgggctggcctgaggatgcaactggtctgcataagtctggggccatttatcaggcctagaaggagtgttcaagggctaagaagtcatttagggccccctagggggttgggttatgcccaccagggaagggcgccaaatattgagatgtactgagggtctggggtctccaaggtatgggtagtgtctaataatgggtgacaggaggctgggggcagttagaaggacctggaaccatctagatggctttaatgtgactgcaggaatgcagttttgatgcctggagcaaattcgaatgcctttggggtcagagcagcttgtggcgaataataatacggaaagagaatgaggaaattttgcccagcttagatatacttgcccttcagacagtaattcaaatgaaaaatgttttaagattctgcattaccctgggggttattgagagagttagaattaatctacattagtctggaagagtctggagggtcatctagacccactattacagtgcttttcaaggggaaacctgggccatgttgaccgtgatctgcattaagatacattttttcattgagacctggtacagacagtcataatgtatttaacattatataacataatgtattaacattaactcaccttccacgaattgacatttccacttactacttgtgctgtgctgtgaagaactattttgttctatttactttttaaaacaagctatttgtgaagcactaaactggtatatgaccctgttgttggggaaaccactgatccagataggacctagcagtatctgcagagcattcttctgttcagaagatctcagtagctgagggtgtgtctgcgaagcctggtgctttctaaatgagcaagcaagcatctttgtatactgcagagggtttggggatccctcagcctgtagtcagcagatgttgattaagcttctgatatgtgacagtcactgttgtaggtagcatgtgcttccccgggaggtgctggagagcagttccagggccaggaactggggctgagcttattgagtattggtgaaagaggctgggatgtaatagactatcagggttgggtgtgtcttaggaagttaggaattaggtggagctgggaggctgaatatggaggcttggcatggtttgaaaatctatatgggatctagaacaggaccagggccttgtctttgcaggcatgctgtgggggaagcgaggagacagatgtaggggaaacctgggcgttaagggctaatagtgtcattcctcttcatccgtattgagcacttgaggtgctctaaatgtgtggcagaagtcaggctttgagtattcacagccattctctgagatagatgctcctatttcgtgcatttacaattaagcatactgagttgtgggttagggattttgaagctttctaggaattttgagattggatattgtcttatgagtagcagatttgacagtcatggggaagcttacagctgaaatattcatatttttctgaagccctaatcaagacatccacctgtttgatggatgatctttcaactgcctgactggggaatcatatcaaagaatttccatgacattgcaaaggctttgtgcagatggcgataggtaaatgcctcctgtgaagttttcmttcggcatgtctttctgaagtttagcgttttcattttaaaaatggcatactggttttgcagatcactcaatgaagtttccaacttaggtgtataaatacaatttgggggtggtcctcaccatcgaggacagttgatgctctaggaagccgtgtggtgtttaaggcatggtgttgaatattgcccagcacattggccttgggaaaggtgggtttataggactgtggaacacaccctttgaaatcacagtgcagcacacacaaaaaaccttggtgttggctttgcctcttaggaggccagggaatgaggtcttgaagtttggataggttgttggggaagctgcgggaattgaggagtgagatgttaaaagcggaggccagggaggcctccctttgacataagaggcacctgaracccagaaaaaaggaagagaattgctcctagtccctggggtgtctgtgctgggtccagcgcccacccaagcacagggtggagtgggaggaggtggaggagaggaggggtgccagaggggatgctgagggagatagtgtggggcccttgaggtcttcatgtctatcctctacttccatcctttctcccgggacctccactccaaactctmccccctggacccccaggtgaccatggaggaagaagatgagtctcgagggaagacagaggagtcgggggaggatcggggcgatggtccgccagacagagaccccacgctttctccttctgcctttatcctggtgaggctgctgggctcctggcactgagggatggaggagctgggcatccacactccaggggcctgactccagggcctgaggcaggggcgctggactcttggctcccttgaagcacttgagtctagctgtcagtgtctgggatgtctgtctcccaaggggcagaggttgcaaagcatctgcctgggtccyctgacgcttggttcttccccccttccccagcgagccatccagcaggctgtgggaagctccctgcagggggacctgcccaatgataaaggtatggcggcttccggttccttttagcccctgccccctctctgcattctttatcctaatgtcattcatacaagcttttctgaagcctcctrggtgccacccttgtgctggcatggggagccaaaaatgggcagacaccctgtagctgccttggaagggcctagtgtgcagtggaagggagacaggcacagtgctgggagagggcaggaggcccacttgagctagcatggtgggagacgggtcagggcaccttccccgagcagggacagtgaacggctctctaaggacctagaagagtctaaggacctaggattagagggaagcctgatcagctgcagcaggcctacagcacgggtgcagcggcgaggggctgcgctgggcttccttggggctggcatgcaggagggtgtgagtggggttgggggaggcaggagaggtctgtggggactggatcccagcaaggcctgaatgccaggttgaggtgtctgagggcagacaggaggacgaatggctgagcgtcgcagcctctgaagtgggtgctgggaagtcctcctgggaggtggcgcatggaggcctggagagcatgcgggaggctggttccrctgtcaggaactagatcaagctcctctttcctctaccccgcaagtctctgcagcaagtcccctgtgtccaatcccccatgcaaatctctcaccagatggctctcggtgtcatggccttcgatggcggcgctgccggagtccacggtcagagccccgttcccaggaatcagggggcactgacacggctactgtgagtaagaagagggggctgggggcctggctcacgggtatcagggaggaagggatgggggcctgagtctgggggaatggggtttggggacctggactcctggctctgcgatgctgaccaggggcaatgttggagagtctgggggcctgatctgtgggcctgagctttgagtgttgatggcagtcaggctataggaattagatcctcagttttcttggggatcttagatgtctgggttcctgagaggttagggagtggggaagcaggatttgccagtcttcatgtgaccagggacggcgtagagcctctctggcctcttccaggtgttggacatggccacggacagcttcctckcagggctggtgagtgtcctggatcccccggatacctgggttcccagccgcctggacctgcggcctggcgagtgagtagctgggcagctggagtgggagaggcctcagcgtgagagccagaagcacccctgaggctcacccaccccttccgccttgcagaagtgaggacatgctggagctggtggctgaggtccgaatcggggacagagatcccatccctctgcctgtgcccagcctgctgccccgtctcagggcctggaggacgggcaaaacgggtatgtggggccagggcggagctgggcaggtggtcgtggagttgtgtggggatcggctgtttttggtagtgatggtagcggtgatcatgttatttagacaaaacctttcccttctcttcgtattagacgtgattaaggctgtaggcgcatacagatgtacataaagtaaaaactgatgtgctggggctatgtgggagtggtcagcgtgtgtgacaactggtttcggcacgctaagtattagtgtcactgcactgggcgttcatctccccaggagggggactcttcgaatctctatcttcagagaagcagacagcctgaaaaagggcaggcacttgcccaagggcgcacagccagatgctccgtggggtgcctgggccttgagccctggtgtgtctgagtctgaagcccaagtttttgatgtctgagatgtgcgctgcccaaggaggaatctcttcctccaaccccacacacaacggtaaccctgtgagccctttagaccaaacgcgaacgcacatctcagttgcaaggaggacttgttactatgcacatcactgggcccactcccaagagttctgattctgcaggtctggggtgggacctgggaattttcattttaaacaatacatgctgctgagccctggactctgttgagaaccctgggtttaggccttccttctacgtgaacatctgtatttggaggaggggttggagggagaggagaagaaggtgcagtcagctatgggcaccagctgtgagccgtgagcaccagttctgtggtagagcaggcacaccactctgtgccaggtcatgtttaccttgtttaccttgtttcgctgtgtcgcccaggctggagtgcagtggcataatctcagctcactgcaacctccacttcccgagtacaagcgattctcctgcctcagcctcctgagtagctgggactacaaggtgcatgccaccacacccagctaattttcgtagttttagtagagatggggtttcaccatgctggccaggatggccttgatctcttgacctcaagtgatccgcccgcctcagcctcccacagtgctgggattacaggcgtgagccactgtgccctgctaccttgtttgttttttttgagacagggtctcactgcrtcccccaggctagagtgcagtggcacagtcacagctcactgcagcctcaaattccccggttcaagttatcctgttgtctcagtctctggagtagctgggactacaggtgcatgccaccatgcctggctagtttttttttttcttttttctttttttgagatggagtcttactgtgtcacctaggccggagtgcagtagtggggtctagtctctctgcaacctccgtctcccgggttcaagtgattctctcctgcctcagcctcctgagtagcagggattataggtgcgcatgccaccacattgagctaatttttgtatttttagtagaggtagggtttcactgtgttggccaggctggtctcaaactcctgacctgaagtgatccgcctgcctcaacctcccaaactgctgggattatgggcgtgagccaccacgcccagcctttattttttatttttttaaaatttttaatagagatgaggtcttgatatgttgcgcaggctggtcttaaactccagagctcaagcaatcctcctgccttggcctctcaaactgctgagatcacaggcatgagccaccatgcctgccacaccccccccccctttttttttaacagctggaaatgatttatccattaagtacagtgatatggtgcctaggacttatgacattcttaggggcccacaaaagtgtttcaatttctttaaaatcagaagctgtagggctgggcacggtggctcacgcctgtaatcccagcactttgggaggccaatgtgagcggatcatgaggtcaagagattgagaccatcctggccaacatggtgaaaccctgtctccattaaaaatacaaaaattagctgggcatggtggcacacgcctctagtcccagctactcgggaggctgaggcaggagaattgcttgaaccaggagatggaggttgcagtgagctgagatcgtgccactgcactccagcctgggtaacagagtgagactccctctcaaaaaaaaaaaaaaaaaaaatcagaagctgcagaggataagtaaacaaatgggtcaggcaacgttcctctaaaacttgatttaggaaaacaggtggtatgctggatttgacccctgggccttaagagtgataagggtgtatccggaagctaatagtagttgttttcagggggactctgaggttatgttttctttgcttattccaggtagctttaaaaagaaaagaaagttcacccataatcctgtcccatacagaaatttatataaagctgtggatctcgcgtgtttgcagagcgctctagtctgtggagagtattttgtgcttaaggtgctgggaatagcaatgaggctaggaaaagctgaggctcagactgtcctcacccagcagcaggtgcagcctggctctttctgcgcactcatctattcctccgcttatcctgggaagtaaatgctgtcatcatcacccctgtttcatcttcccctaagcccttggcagctgagggaccgtacactccactcattgatattttttttgtttgtttttgagatgaagttttggtcttgttgcccaggttggagtgcagtggtacgatctcggctcactgcaacctctgcctcctggtttcgagtgattcttctgcctcagcctcccgagtagttgggattacaggcatgtgccaccacacccggctaatttggtatttttagtagagatgggctttctccatgttggtcaggctggtctcgaactcccaacctcaggtgatccatccacctcggcctcccaaagttctgggattacaggcatgagccaccccacccggccataaagggtgttggatgaatgaacatacccccattttatagatgaggaaactgaagtaagacacattgatccacttgcctgtggtcatgtggctggtgagggccagcccctggatcaaggggtggctctggtgctgccctcttgacccctctccttccctggcactgtcctcacaccactctgctggcatccttgcctgtggtgtggcctctgtcagccatctccatcgtgtgactgtggcatcatgactgtagtacttagcacagtgcagcgggctctttgggggcgaatgaggtgacatacgaagcaccatgcctggtttggaggaagaggcaaacctttgtcattgccactgtcactggtcagtggtgtctttgagtcctgagcagatgtaattccttgggtggggactcagcacagagtgaagagcttggggtgaagaccagccttcctgggctccccagctctgccatttcctggctctgcactggaatctcaccctctaccaaacgggagaaactcccacgagaggcagctggcgcagcaggccagagcttgtttttgtcttggagggggacttaggtttgaatcccagctctccccctgcagcctgttttcctgtttcttctccccccaggatggagtgtggtgttgtggtcatagctcactgcagcctccacctcctcctgggatgggtcgccggcactggtcaagatagttcctagtttcaaggccagggtacattgcccagggtcaggccagtgctgtctcaggatatgggagtgcaggttcggggccgcactgactgagtttacaccctgactgctgccttctctctgtgtgcccttggggaggatactgcagccctctgcctcagtttcctcctgtgacctttgggttaagaaccatggtgtgcagttgttgggagcatcctacggctggctcctgtgaagcacttggggcttcctgggcaggacctggtggcccagggagtgtccacggctgggccagcaagcaggcaccaggagggaggcaaaggccctgaccgcctctctctccctgttcctttgcagtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctccaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccakccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgttgcccccgcccatgccctggaatctgccagctggtgtggactgcaccaccagcggcgtcctggcctgtgagtgtcccctgggggagggtggtgctggggcaggtgagacaggatggggactggagggtacagacttagaggcagtggggtgccctggcagggagaggtttatagggacatagactgggagggtgggggtgagtaaaggccagccaggctctaggtgcctgggtgtactgggagagaggggccggtgagagcaggtggtggccagcacagactggagtggtgggctgggttctgggattcccctagacggggagtaggagagagggaccagaaagaatggcttgagcagggcatcgtattccttacggatggcggttgcctctaccagactgcagaggtggggagagaggttgggactggccacagcgggtcaggaggcagaatctcactcctgccactgtctcatcactgcatgaccctggccaaccccgcacccacacacctggagtcccaagaacattcgtggtatgggctgttctctcattggccaaggcccccttttcccagttctgagcgtgaggctttgtggctgttctggggccaagggcaggagatgacagcaggtgtccaggtgaggttcaccagctcctgtcctgtcacctctcccatcttcatgttgtcacctctctgcctcctgcagtgactgcacttctcttcaagatggaagaagccaacctggcgagccgagcgaaggcccaggagctgatccaggccaccaaccaggtgggctcccctgggggagagtccctgccgccccttcttttgtccattgcctcgggttaggagaggaaccgcgggcctggcagctctggggcaaggtatcggcctgaagaggagcctgttgcctcagctgtggggaagtcagcgtgggaacagtggggtgcacgtcccctcttcccctccacctccctttactcatcacccctctgtcctcgtcccacagatcctcagccacagaaagccaccctcaagtctggggaygaccccagctcctgtgcccacctctttgggtctrccccctggcccctccagctacctgcttcctggcagcctccctctggggggstgcggttcgaccccccccacccccaccgggctggctgccacgtctgacaagagagagggcagcagcagctctgagggccgtggggacacagataaggtgagctggcctggggagaggtggggcggtgctgacagttctgtagagaatatggacaggaactgagacgcgggggcccaaggagaaagggagactgaggcagggagacagggccgtagagaccaaagtcatggaaccataaggaactccactttgctggaatgggtgagcaggaaatgcgttaggcgtgtccaaaggaaaatcgcgtctgtgcgtgtgtggggctgtgtgcgtacacaccacatatacacaccctggaagagatgccccgcgctgcagcccaccccttgattatctgttgctcgcgctgtctccgtctctgtgagtgggggagggtggtttccgaatgaaaactcaagaacctgtttgtagatgaagcaggggagaatgggtgccaggcagacagtaatgtaggttcttactcagctgctctggccggctcctactcctgggctctggagctgtttctctcttggtcaggtctagatgtgggtttttgtttttgtttttctttgagatggagtcttgctctgtcacctggtctggagtgcaatggtgccatctcggctcactgcagcctccgcctccagggttcaagtgattctcctacctcagcctcccgagtagctgggatgacaggcacccgccaccacacccagctaatttttgtatttttagtagagacggcatttcaccacgttggccaggctggtcttgactcctgacctcaggtgatctgccagcctcggcctcccaaagtgcagggattacaggtgtgagccaccrtgcccggccttggttggttggtttttgagacagggtctcgctttgtcacccaagctggcatgcagtggcacagtcacagctcactgtagcctcagccttgatctctcgggctcaagggatcctcctacgtcagcatcctgtgtagctaggactacaggcacgcgccaccatgcccagctcatttcttaattttttgtagagttggggtctcactatgttgcccaggctggtctcaaattcctgagctcaagtgattctcccacctcagcctcccaaagtgctgggattataggcatgagccactgcacccagcctagatgtgttttcttacagtctagtagcccatagccagacggtgacgttggccacccttacacagctgtgtaccgtgccagataaagctgtataaaccccattaaacatcctgtgtgagccgcagaggcggggctgcagtttagtcggtcacttgtccgtagcttgtgccttgcgctgcaggactcggacggtgaggaccccctggtctacagtggcccttgctctgccctggtctgtgctctgccctttgccccgctttgcccatccgagatgggtgttggggagcagcgtctctctagagacccacatcctgtggggccaggcaagcctgagaagtccctccagggcagcctgtgtctcttctggccacagagttccctaacagctcagtagctcgtcagacagtgtcactgatgttgctcctggagtcggctagccattgtgccctgcccttcccaggactcagtttacctgcccctactttgatagtcacctggcttgggagggcagcttctccaagggtggtgccaagggactgtcccttgtgcctgcagaaggcctgttcttctctggtcccacgtggctctctggctagaggtttcctgtctgcttttgcaaggattctgcctgaggccagggctgcagctgctgccccgagcctgcggctgcgggatctcctagcttgctggccacaggcgggaagagccttgcctcggaggctctctgccctgtccctgttgcgtcctccccttttcatcccatggccatcccccttggaacaggcacagctcccctggattgagtctttgctctgtacccagcctgtgccatgtcctccatgtgtgtcgctgtagtactgcccataggtgctgtccccgttttacaaatgagccacaaaggtggccaggcacggtggctcatgcctgtaattccaacacttcgcaaggccgaggcgggtgaatcgcttgagcccaggagttcaagatcagcttgggcaacatagtgagacctagtcgccacaaaaagtacaagaattagccaggcgtgggggtggcacatctagtcccagctattcaggaggctgaggtgggaagatcgctttagcccaggagaccaggggtacagtgagcagtgattgtgccactgcactccagcctgcatgacaatgagagaccctgtctcaaaaacaaagaaacaaaaaaggagccacaaaaaggtttggctgagcatcccaggggtcagagacagggagtggcagaccaggcttctgatacaaatgggctcaaggtcagtccccacccccactccccagtgcccctcacccctagccaccccctccatcccctgggtgaccagagcagtactgtaaaaacctaaactgagtcctccccgctcccgcggtgaaaagccctgtgcagttttctacagccccgcctctagagtctgattcaaaaccagctgcaatttcttggccaatgcctgtcttctcatcagactgaactttgtgagggcaggcgacacacatgtcctggtcccggccaggcctggagcagcccagggttcggcctggaggagatgttcagtgacatgcagaggcccaggcctggcctttggtcccgggcacctgcagcagagggcgcatgggacagaccctcagcaggacttccagcctgagagcagctggacggccagagaggttaggctggcagcagaggcgagtggaggtggaggttccgcaggtactcactggcccttgctgtgtcttcccccgctgtcgccaccccaccagtatctgaagaagctgcacacgcaggagcgggcggtggaggaggtgaagctggccatcaagccatactatcagargaaggacatcaccaaggaggagtacaaggacatcctgaggaaggccgtccacaaggtgggcacccggagagaggggcagacacaggccggggagagaacgagctggagggacagatgtgtgcagacagatggacgcggatgggagacggggaggaggtcagtctgggaggtgakgagggtgacaggattttctcaaggccacctgggcctgttccgctggccctggggcacccatcgtctagggggacagagggactttggcctggttattggggaagctcctcctaccgcagttccaagctgcgcccaacagtcctgggtggatggggccccgggagcctggtggtgactccaactgtccccggccccccagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgyccacctcccttgcccccaagcctgtccccagtgcccctcccttctgtttgtgcccctctccccaatttcattaaagatttcatgaaacattacccctgagccccatggttctaaccctttgttttcggagacaaatttgccagagggttggggagggacccccaggaggctgaggatgggagacagagaccagactgtgacttggggcagctgcctcccctgggcctcagttttcttatctgtgtagtgggtgttgtgatgattgaacaagacacaggtggagcacttagcacagtctctggctgggagcgagctgctcacagggaggcaggggccggaccccacctgatcagcatcttcccagctcggctcctgggtgccatgtgcctgccttggaattgctcccagagcaggatctgtgttccccattgagttggcttctcttttcagcagccccgtgaagctggggtgatctcatcaactgtcctgagagggaaactgaggcacagagcagcaagggccgaagggtgagtcagggctgcgctggcttctgccagtttcatcacccagaactgcggcccaaccaggagaggtgacagtgcccagggtcaccaggcaggcaggctttgcaggctccagggtggccgcagagcccctttaccaagacccctccagccccacgtggaggggagcctgaggcctggaaggagaaggaccacttgcccaaactgttcataggcaaggcagggggcctgggttctggctagtctttgtgtttcctactctgtgacctttgcgcctctcccagcctgtgtcttggtctacaacacggggacagccatcacccaccaggtccctgggcagaagtgaggaggtgtcagctgccccctgcagtgcttggtcttcatgcattgagcacctgagttgtatatagctgcacagatgggtaaactgagaccctgagcgggaataacaaccatattgggtcagagggcacccaacaccagacacgcacaagtgatcatagcaggaaccagtttattggttgaggtggtggggaacaggggggttggaggcacaccatgaggagcgagggctcaggtctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttctaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaaccataggcctagggctgctgggagttgtagttttacacacacacacacacacacacacacacacacacacacacacacaccccctgctgtaactgaaccataggcctagggctgctgggagttgtagttttacacacacacacaaacacacacacacacacacgtcagggctgagcagtctgtgatcttgactcctgggagccacagccatggcctcacaatggcagctaaaacttgagtccaccagcttctacatggtttagagcaggggtccccaacccccctacggcttgttagggaccaggttgcacagcaggatgtgagcagcgggtgggggaatattactgcctgagctctgccttctgtgagatcagcggcagcattagattctcagaggagcacaaactctatcgaactgcgcacgtgagggatcggctgctccttaagagaatctaatgcctgatgatctgcagtggagcagtttcatcccgaaaccacacctccctgtccgtggaaatattatcttccatgagactggtccctggtgccaaatagtttgggggccactggtttagagagttcaaaacaggttctgcaggtgaggccatgggaaggagctcccggggatgaaaaactggttattgcagagatcttggaagttgcagttttttagagggccctctgggagttggagttcctgggagcaacctcttccctctgtaaggccacccctttcagccccagggactcaggtctgcaggcaccttgaccatcacgagcctcttggtccacggctggtcctggggccatgactcccccacacagaaccagagggcatagcgtggtgagcgtccgcttccttccgtgaaggtaatcagatctgggggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtcctgtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcagaaagtgccactgcacagcgaaaccctaagggatgtagctttcctgctattggtctgttcaccatcattagttacgatgatgatgacagtggcagctaattccctgagcaggctctgtgtactgggcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacgcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagctcctcgctcactgcccagtatgtgtggcagtgccccagccgctgggcccagagccactgcccggcccgccagagagccagtcccccacccaggcagctcagcacatgcctcacgtagctcatcactcccctgtctgtcagggacatgccagggtctggcagtgtgactggccatccaggcagcgtcctgtctcccacttcggaccccaccagccgcaggccctccgggcaggagatggtctgctggaagacttggcggccccggtagaaggctgtcacctcgaactcccactctgagcagcggcagcagcggcatgaaggggagaggggttgagaatcaggggctgccgcccagacctcagccctcccagcctgcagctgacactcaccttcccccggcaccaacagccgcttcagtgggttctcagagggccccaggtttgggaagggagtgggattgtccaagctggggctccgcaggggctgagggcagggctcaggggctacagccaggcttgggggtcccggatctgggagtggggccaacaccatgttacccagtaactcatccagaatgtcttcctggagggaaacaaaaaaagagaatcaggcatttccatatccttttctggagacttcatatggaccaggtctgttctcagcaacgcagggaggtcaggcttgagctctgccttcaaggggcttccagcctggggacagagccagccatggcatcaacagccaaacaaacactaatgaacgccaggtgctaccattccaacccaaggatctggctctatgcaggtaagacctgggcaaagcaggctgggtagaatttcagaggggatgctcccccagcttgggcctcagcaggatcaaggtgagggagtttttcagttcccaagaggctgacagccccctgcgaatcgaaatccatgaaatcccgggaaggtgtgctcgggccttgaatgctgggtgaagacttggaattttctcctgaggagaccggggcagggacagacagggtcagcactggctcaggtgaggggcaggctggaggcaggggagtggggggatcgtctagagggagaggacaaggcccatggagacaggtcggagactgaggggcatgaaagttgggcacattctcacctgggtatcagaagtactgcctccaccattggtgtccggagaggtgtctggctgggaaaagtccccaactcctgttgagaaaagtggtgaggggagtaggagtgccaggaacccttggggccccagcctcccacacgaaccccaagctggcagacctgagttcacaaactcgtagattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacaccaccctctttccctggcaagttctaactctgcaaggtccatccccaaatccccccgtcccacctacctccatcccccacctctagttttcaaaaggctttttttctttttgagatggagtttcactcctgtcacccaggctggaatgcaatggtgcaatctcagctcactgcaacttccgcctccccggttcaagcgattctcctgtctcagcctcctgagtagctgggattacaggtgggcaccactacacctggctaatttttgtatttttagtagagatggggtttcaccatgttggccaggctggtcttgaactcctgacctcaggtgatccgtcctcctcggcctcccaaagtgctgggattacaggcatgagctactgtgctcggcctcttcaaaagcctttgaaacctctttggtttttgttttgtttcgcttttgtttttaaagagatggagcctatgttgcccaagctggcctcaaactcctgggctcaagcgatcctcccgccttggccttgcaaagtgctaggattacaggtgtgaaccaccgcccccggcccaaaaaccttttctttctaagccaggcttccaagtccaacttggtgtctaatcccgtgcaccacctgccccgcgacaccctctgtgataaccccgcccctcacactgtttaccacctctggcatatactaattcggtagttaggaacctcagatttggggctccaggcctcacctctgatgtttcaagaaccatcccccagtatctatcctacaaccaagagccccggcctctagaaagccccaaacccccaggatgcatttcctttgcgtactaaccggctttcccggttttattcccgtaaccctgcagctccaaccctgcttgcgccccaccatcagtcagcggatccggctagccccgcccctcccgttctagccccacccaccagcgttggcacgagcccgcccctcgcgcgccacctccgccttctcagccgggcccactaggagtcctttccgcccagcgcgcagctccgggtttccagc

SEQ ID NO: 17870 - DNA, 44362 bp, Homo sapiens
  misc_feature (1)...(44362): n = A,T,C or G, or insertion/deletion polymorphism (see Tables 1-2)
ttgtattatcctgctctcattccatggagatcactctgacgatattgataatagtttttatacttcctcttctttcttttttttcttttttgtttttttgagacagagtctcactccctcgcccaggctggagtgcagtggcttgatctctgctcactgcaagctctgcctcacaggttcaaacaattttcttgcctcagcctcctgagtagctgggattacaggcctgtgcaaccatgcctggctaatttttgtatttttagtagagacagggtttcaccatgttggccaggctggtctccaactcctgacctcaagtgatttgctcacctcggcatcctgaagtgctgggattacaggcctgagccaccgtgccagacttgtttcctcttcctctaatgaaagatgtctaataacttttccaatatcttctatgataatggaccattcagattttccattttcttttgggtcatttctggtaatttacatgctactggaagttacccatttcctctagatcttcatatttgctgccacataattttgtgaagttaacatttatatctttaatctctcctgtattcacggttatatctttcttattctttttatttttactttccctcttttcaattttttattttaatttttgtgggtacatagcaagtgtatatatttatggagtacacgagatgttttgatgcaggcatgcagtgcataataatcacatcgtgtaaaatcgggtatctggccgggcccggtggctcacgcctgtaatgccagcactttgggaggcggaggtgggcggatcacgatgtcaagagattgagaccatcctggccaacatggtgaaactgtgtctctactaaaaatagaaaaattagctgggccttgtggcgcatgcctatagtcccagctactcgggaggctgaggcaggagaattgcttgaacctgggaggtgggggttgcaatgagctgagatcatggcattgtactccagcctgggtgacagagcgagactgtctcaaagaaacccataaataagtaagtaaataaataaataaataaataaataaatgggatatccatcccctgaagcatttatcctttatgttacaagcaacccaattatacttttattaatttttattttatttatttatttttgagatggagtatcactctgtcgctcaggccagagtacagtggcgtgatctgggctcactgcaacctctgcctcctgggttctagcaattcttctgcctcagcttcccgagtagctcagattacaggtgccagccaccacgcctggctaatttttgtattttagtagagatggggtttcaccatgttggtcaggctggtctcaaactcctgccctcaaatgatctttctgccttggcctctcaaagtgctgggattataggcgtaagccaccgtgccctgcccctcttttagtatttttttaaatgtacaattaaattattattgaccatagtcaccctgttgtgctaccaaatactaggtcttattcattctttctatttttttgtacttattaactctccccatctcccttactttctctcttttttgcttgatcagttttcaatttcactttttattgttattttcattttctcttcttcaatttctttttttttcttattaagctaaatacgtagctccttatgtacttaatcaagagactttttgtggagcgggggattaggtttagggtgtattagtatatgaatatgaaatatcagtatattaatagaaaaaatatcagtaagctgagaaaattcattaggtctaattagccaaacgtacaatgttcagtagtcacttcatattcttctctgcttgtttatatgtgtgcagaaaaggctgagaggtggactgagtagaagctcaggggtagtttggcagccgtaggaagagatggcaatggatgtttattagggaaatgagaaaaaatgaaagcgggaacttcaacatcctcatgggttgaggctttttgggaacttccgggagacgaaagtgttcaaagagggctacttgggagttagaaacaattaagtaatggcaatttaagtctgaatgggaggagaacattccgctcacacacacaattagtcttactattattcactgataatttaagaataatcctgggaattattttaataggaaatgtccaaatgtttttcccaaagtgttttcaaggcttaggaaaagatcattaacattatcatagcttatgaatctcatcttgtatttttattattcatagaatccttatgatcttaattgaggtattttttgggggagagggtatatacgtttttacctaagttctaatattttctcaattttgttttgtcctccagaaaattggagaaaagacagctttcagaccggaatctaattttttcccagcatttgattagaaaaaacttcaaacatacaggaaattcgtaagacatgtacagtaaatggctgggtgcggtggctcacacctgcaatcccagcactttgggaggccgaggtgggaggatcacttgatcccaagagttagagactagcctggacaacatggtgaaaccatgtctctactaaaaatacaaaaattagccaggtgtggtggtgcgtgcctgtagtcccagctacttgggaggctgagacacaagaattgcttgaacctgggaggcagaggctgcagtgagtgtcactgcactccagcctgggtgacagagcgatacttcatttcaaaataaataaataaaaataaaaattagccgggtgtggtggtacacacctgtagtccagctactcaggatgctgaggtgggaggatggcttgtgcagcacagcaggtggagcctgcagtgagccactgaactccagcctggccaacagagagaggccctgtctccaaaaaatataaaaaataaaaaatagaagaataagagagaaaagaaaaaataaatgtacaataaacacctatatacccaccacccagattctataatcagaacctaacttttactagctagaattaacatttgtctagacctacaagtgatattgagtagtgatagctctatcataattacatagacgtactctgtttctgctggtaagcccagtgcttcataagagttttgtactgtggccaatttcatgagtgttttaaacaagccaacacaggtcagctgttagctgggtggaggagcttctagagagttcttcccagcttaaaaaaacaaaatttcaaagtcatctggcatgctgcctaaagacacccacagcttttggctcttagaagcaggtgatgtccataagcataaccttggatttctggttgtgcaacaaggagcaactgccacctctctggggcagaaggtgacagagacagtgacaagaggaggggtagctggaattcatatcccttcacatcagtttcactaaaagttccaccctgcaattggtggccatggtcccgacagagagccctgtcctcttctacaaattcacacaatcttctgtatgttttctagagccattaaagcttttttaaaaggagcactgttctttgaaatctaaggaaaactggcaatcatctctctaagccagttccaagtaccgtatatatatctcaagccataataattacttcattttggcaaaacatcatctatccttggcttatttcttttcctggaacgtctttgcttaagaatagagtcaggagcaaaggatgtgtgctcataggtaagctagctccttctcacagaaaaaccaaccaaaaaacaaaaccaaagaagagtcctatttcttctcagccttttggctccgatcaagcgtcgaaaagaggctttgtggttgaatgaaatccataccatattcatcctgttaaaaacaggtgttatttccccaaatgctaaagctctttaggtcagcactgaatatgcaattttgtttttgtttttgtttttgagacggagtgccactctcttgcccaggctggagtgcagtggcgcgatctcagctcactgcaatttctgcctcctgcgttcaagtgattctcccacctcagcctcccaagtagctgggattagaaggcactcaccaccatgcctggctaatttttgtagtcttagtagagacaggagtctcaccatattggccaagctggtcttaaacttctgacctcaaataatccgcccaccttggcctcccaaagtgctgggattacaggtgtgagccaacgcccctggcctgaatacgcaattttgaacaggaatggagtacttgggtgaatatgaaaataacacatttagaatggggctggtatttttaaattctaaaagttttattctcttttgcctttctgagtacatgaccatcactctagaacaaggatcagcaaacatttctgtaaaggtccatttagtcaataattttggttgttgcaagtactcaactctgccatagtagcagagaagcagccatagacaacacaaacaaatgagcttggctggactccaatcaaactttagttatggactgagatgaagactacatcagctatacctgctatactttgcaactgtttcctcaaaggtaatctagttctcaacctttagacaccttttattcaattcatgaaaccataggatgacagacagtcatactgagcctgaattttcaccataattttaaaagtaataagtagggtagaggttaaaaacttaagttttagagtcagtcagaagtgaattcaaatccagactctgtggctttcttagttgtgttatatcaggtaaactgaagaatgtttctacgtttcttcatttgtgaaatagggaaattgttttgaagattaaaagaaataatgcatatcaaactctttttttttttttttgagactgagtctcaatctgttgccctcttggctcactgcagcctcagcctaccaggttcaagtgattctcctgcctcagcctcccaagtagctgggactacagagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctgtagtcccagctactccggaggctgaggcagcaaaaatcacttgaaccagggaggcggagcttgcagtgagccgagatcgcaccactgcactgcagcctgggtaacagagcttgactcgtctcaaaaaaaaaaaaaaaatctatgacatttggtgttcaatagtccatttcactgattatataccattttgtaactaggaaaatttccctaatgtcatgtttgtttaatgtgagatccctatgattaatgtgatataataatagatgggttatacagcaggctccttgaatgacagctggctccgtccgtctcggcaccacaggaaggcaggaaagaagtgtatcttttcatctctaacttgccactgtcactacctttacatatctgtgggctaatagcatttgtgcatatatattttaaaaattaatatttattaaagcactaaaaatgagttcagatgctttatggagagtggcacatctcattagacagtgttcaagcaaatgcaactttatttcaaagttcttttttctttacaggtaaagacatagtataaacggcaaaattcaaaaggtgcagaagattctagtacggtgaaaagcaagttttctttctctcctccactcctagtcccacagtgaccatcctaagaagcaaccacttccagagatgcaaacacacataccacatacacacagccctactcacactcttctgcactttattacttagaatacaccggaaaatttccacgtctcagcaaatacagctgccctgtactctttaatggcagcttagtgttccctcagagggatgcgccccatatcattcacccagcccccagggacgggcttttaggttgtttccagctgcttgctcttacaagcaacattgcaacgctgccctgttacttttaatcttctttatcctgtgattccgttctgcttttccttccagcacgactgcaaagtgactgcggggttttcccgagtgccctcgccccagacctcagcgagttatttgtggagtcaccgggtcctgctccgcattgttattcgaagtctccccgggacagcggggagcaggcggagctgcgtgtcccggcctgcgcgtctgggcccaggcgggcgcgcgtcgcgctcggatttcgggcggatagtgcgtgggaggcggcgctgccctccgtatgcagcgcgcgtgcagccaaggyggcgctgcgatctgcggcctggggccctggtgtgaaactcccgcggagacgctcccagccccgggccgcagctcgcccctgcacggagggaggtgtctaaaggtgtctcttaggaacaggcacaacccgagcagccgggccccagaacaatgggtgctttcagccgcccctttagatgcctggcccgtcaccatggcaaccaccccattattgaaagtcagtgccggtccccgccttagacgctctcctcccgggctcccctcccccgccggccccgccgtatggtgtgtgtgtcactggcagctgttgtcaaaagaaggcacctctttgtctccaggggatgaaagccatttggtttccagcgccaccctttctctccgcccggcaacttttctccgcgtcccgtccccaaggcgtccctggatgcgcgcgctcggccccgcgcccgccacccgcgctgagtgctggtatcctccccatcactcagcccagagccgttctgcctctgcctcaaactctcagagtccttataagtcttattctcaagagttgtgtcccagcgaagggaatccgccttggaaatcgcggcttcctccttgcacgccgctcgctgtttcagcgcaagccggatctcccctcacacccaacagcaccaccttccgagactagcggctcattaccgcccagtccccgcggcccggcgcaagaactcctcgccgggccccattccaggctgggtcgggtctttagaataaggaccagttgtgtgtctccctgtcgctggcagcggatcactttctggctgaagaaaagacaaaacgacgagggaaacaataggacctgtatgttttacacacagttctcattcgaaatgtatcatgatcatatttttaaagatgcgtgttacctttcataaatacytaaataaaacttactttctgttgtctgcggaggaacttgataaacattaaaaaagcaagaatatctttggtggccatgtgtctgggatgtggggttcacctatcatctgccccagggatcctaagaggggaacagatggtgttttcaaaacctatctggaaatwaaaaaggttacggtgctgagaggaagagcagagtccaagaggagggggctgtgagagagaaacgcagagagaggataaagctaggacttccagttattctgtaaagacaaacttgagatgctgtgtgggtaggaaaaatagaggcgtcataaaacttcactgatactgaaaagtgtaactactagaggaagaaatttaaggataatttgttcagaactcagtctatattttcaaataaagtttaaaaataattaccaaatgataaacacatttttaaaactttgtaaatgctaaaagtatgacaagtaaagaaaagcaggtgactgacaagaggtaagttgttctggtctttgctttcaataactatccgttccatttgataaacaggatgcaggcgagtctgacacacaggaaacaagtgtttgcaaagcccaggggtgtgtttccctctgcgtacaagtgttatctgagtaactgtctagaaaatagtaagtatgttaccctgaaaacgtttcctgacagtccaacctcttttcctttccgataaattctggagaaaattctgtcattcttccatgagatttgatgagtatttctccagtcatttcaaatgagggtttattatgcagtgtcaaaatttgaaacgctagttatttaatgcgatgggtttggtaaaaagtgcgtaagattgttattaccaagtaaaagcaattttccatatctgatggtaatctctgatttttaaccaataaatgcgtcattttattttgttgaagtcacacatggaactatgtagaagtgagctccacggaactcaggggccaccatgggaatgaagaccgaggccaagcagacattgctccggaattctattgctgcgtcctctggagcacctctgcttgatcttttttgttggttgattggttggttggttggttggctggttttgtcttcagagatagagtcttgctatgttgcccagaatggtcttgaactcctggggtcaatcgatcygcccgcagcttcctgagtagttgagaatacaggtgtgtgctgtctcacccagctcttcatctgttttctatgaaaccttccatttgtctaaaatatttcacttaattaaaataaaagttgccctggtgtggtggctcacacctgtaatcccagcactttgggaggccgaggcggaaggatctcttgagcccaggagttcagcaccagcctgggcaatatagtgaaaccctcatcttttaaaataaaaaaaattagccaggcatggtggtgcacacctgtggtcccagctactctgaaggctgaggttggaggatggcttgagtcaaggacgcagaggttgcagtgaccagagatcacaccactgtactttaagcctggtcaacagagccagaccctctcttaaaaaaaaaaaaaatgaccactagaattgtagcgttgggaaagatcttaaagataatttagttcaatcctctcattttacgacccatgagacccaaggacctccctaggtaacctcctgaggtcacaccgccagtttgtggtgaccctgtcaccacrcagatgaccctgtgattgcttatcatccccacaatgctttcagacatgactcttaccctgacatcacgtactgtaccttgttttcacaacggacatgtttctgtcttgtcttctaacaagattaaataaaaagtcgagcactgtggcttgtgcctgtaatcccaactcaggaggctgaggctggaggatcgcttgagaccagcagctcaaggccagtgtcagcagcagagcaagaccctgtctcaaaaaaaaaaaaattaagtaaagtctgttttgtggaaccttcctgttttccagtccaccttacctaagccctccaattctagactttaattaaaatattcagtctattcattgattgtaatcacacttcactttgttagttgcctattggatatccattctcctgtcttccttattcacagaatccattttggaagtgggagtgggggcagtaatgtgcccagctaagaacaatcccaggacctcctttaacataatattatctgaacaagagagtaccagtgggattcaggaaaagtcccttaaagggagcctatgcagttggctcacacccatttgctctttatctttttttgcctggaatatagcttgatgcctggagccacggcaacaatgttatgcacatgaggatgaaagctccacccccaggaagggtaggatgacaagctaagagatgcctgagtccatgatggaagctgccattccagctctggatttatgaacttcttgacatctcatgatgtggagagaaaactaaacccctatcttgtttaagccagtgttatttggcttttctgttacatgtagctaagcataatccccatgggctccaatttaggataagaataaaggagaattagggggcctggcacagtggctcacccctgcaaccctagcactttgggaggtcgaggcaggcaaattgcttgagtccagttcgagaccagcctgggcaatgttgtgaaaccctgtctctacaaaaaaaatagaaaaattagctgggcatggtgaccacacacctgtagtcccacccagcccagaggctgaggtgggaggatcacttaagcccgggaggtgaaggctgcagtagtgagccaagattgcgccactgtactccagcctgggtgagagtgagaccatgtctcaaaaaaaaaaaaaaaaaaaaggtaggattaggaattcagttttttaaggaaaacttactagctactcatctagtagcctgtacatacaaatcacagggctgtagtatagtaattcattcacttagtcttataataaaataatctcttccccttaccccctgcctctggctactatatgtgtatgtctcttgtccagatgctattatagatccatgtatggtaagaactaaactttcaagtgcaaccttgacattcttgaagatcacagggcctgaatgcttgtgaattcccctcatcttagcagacatccctggctaattctgtcagcaggacaagctgcaccccatgcagttctcaacctaatgagcttcaccttcctattagccygcgaaataattcaaacaaaccaatcacatgctccaatgggaaccaagggccatcctgccctcttgtctctaccaaggctgcctctctgggggtttgctctactccagaatgcagcccccaccatccacaatctcctcctcctgcagctgtgagtttacattgtgaataaactgctatcaacctcatccgtccagggccaggtgtcatgtgtttggctatcttgtactttttagggcagggatacccctcattcaccaacagtggaaggtgatcagaacagcccatgtaagccacaaacatttatttatttaaaattttagattcaggggtacaggtgcaggtttgttacatgagtatattgcatgatgctgaggctttaatgatcccgtcagccaagtagtgagcacagtacccataggtagttttttgacccttgacttcctccctttcccctgcttttgggatcccagtgtttattgttcccatctttgtgtctgtgtgtacctaacatttagctcccacttacaagtgaaaacatgcagtatttgcttttctgtttctgcattaatttgcttaggataacggcctccagctgcattcatgttgctacaaaggacatgatttcactctgttttatggctacatagtattccacggtgtatatgtaccacattttctttatccaatccaccattgatgggcacctaggttgattccatgtctttgctattgtgaatagcacagtgatgaacatacaagtgcatatgtctttttggtagaacaatttatttcctttgggtatatgcccagtaatgggattgctggattgcatggtagtgctatattaagttctttgagagatccccaaactgcttttcacagggcaacaaacatttactgaaacctcctgartgccagatattgtgctaggcaatggctacaaaggtgagcaggacagacacagtgcctgacctcagggggcacatactctagtggggaagactgacaaagaagaaaagaccacagataaataaacacagtaattacaagctkcgatgggtattataaagaatagagacagaatacttagggtggtagaggaagacaaagatggggggtagatttagacaaggtgcttaatggaagactccctgagaaggtaccataaaggaagacttaaaggaagaacaggagcttccaagcagaggaaagagcatrttctaggcccagagctgagagtgggggtgagtggtggaggggtgtggcaagagattcaactggagagatcgagaggacagataagtgttaaaggtagtcrggtgtggtggcatgcctgtagtcccatttactcaggaggctgaagcgggagtattgcttgagtccaggagttcaaggctgcaatgagttatgatcacatcactgcactccagcctgggcaacacagtgagaccctgactctaagcggggaaaaaaaagaagtagtaaaggcatttttgatttaatgccatgggaatgcattgatgggttccaagctgcacataactgtttacagttttaaaagctcacttttgctgctgtatagaaaatggattggaggggtgagagtagaaatgggagaccagtatggcagcggttatcatctttcagggaagtggtgattgtggcctggactaaagtgatgacattgcattggagagattctgaattcctgatgtacattgaagatagaatccacagggtatgcttctgattacatraggggatgagggtaatggaggacttgaggatgactcatgggtttgagtagctggatggatggtggtattgtttactaagctggggaaaacagttgaggttggagatacatcgagagctgtcatcattaaaagggtattacactcatgaagccatctagggagagtgcagagaaagaaccgcggagcgtctactaacaagccrcagaataatgccatgcccctgaggtgagggtgtggcctcatgattggatattcttgtggctaatcatctggggaagggaccatttggtgcaataattatgtccctcaggagactggaaccaggaggccagcctgaggccaccaggagagggaggctgctgtctccttgtcagacaaggtttggatttcaggaactccagatggcttgccggggctcctaggtgagaggaggtacacagcatccctgtcccctggaagcaggtgtgcatcccatagagacatctaagatgcccggattggatcacatttgtgagctacatttttagttgcatgttactctttctgctcacttcctttctgttatcttcaagtctttttttttttttttttgagactgagtctcgttctatcaccsaggctggagtgcaatggcacgatcttggctcactgcaaactctgccttccaggttcaagccattctcatgcctcggcctcccgagtagctgggattacaggtggccgccaccatgcccagctaatttttgtatttttagtagaaatgggttggccaggctggtctcgaactcctgacctcaagtgatccgcccacctctgtctcccaaaatgttgggattacaggcgtgagccactgtgctcggcctatcttcaagtctttagacaagctttggataaatgtccatcctggtctctgctctgctataggaaattaaacaaacaacaaaaaatagtgtgtcttaaatgccattgaagagttaaagggatactgaccctcccaaaaccagtatggtggtgggagctgcagccagcagtgagaggtccctaaggggaaagcggatctctttttctagagtagggcgtcaggttcagtctctcctctccacatggacaggctcctttcatggccaggcttaaaggagctggtttttttttttttttttttttgagatggagtctccctctgtggcccaggctggagtgcagtggcgtgatcttggctcactgcaacttctgcctcctgggttcaagtgattctcctgcctcagcctccccgagtagctgggactataggtgcatgccaccacactgggctaattttttttttttctatttttagtagagacaaggtttcaccatgttggccaggctggtctcgaactcttgacttcaggtgatccacccgccttggcctcccaaagtgctgggattacaggtgtgagccacggcgcccggcctggttttgataaggggagcagtctacactttaaatcccccctccacttgactgtatgttccttgaagtaacatagagtaccgcatctttgtacccgcagtgtccaggaggttgtaagcactccatcactgttagtttaataggtgattgttcactagacattgtgagacacactgtggtttcccaaagagcttagaatccagatttggtcagcagatgcacatgttgatgcatggcagagtgtgcccgctctgtaggttacatgaaagagctgggaaatgctctttgatcacagaggagggaaacattactcccagtgtgggggcaagaagcttcaaacagactttgtggaggaggaaacatatggctgggccttgcgggctggagcgaatttccaaaataggatgagtaaaagacaaacatgtgccaggtagagggctccgtgagaagggaggcatgaggagaaggcattccattgcttcagtgcatgaccggtagtgaggtgtgttgcaaggagagcatacgtgtgaacagggaggaagtggcaaagacgcagaaatgatgttgcagctctgaaaaaaatgtctttctgggtgggcaaggcctctcttgtctcagaccaaaaatgaaatataaataaataaataaataaatggttcccagtgaatcctgatagctaggattaactttttatggtagaaaaatttctcagcagtgagagctgttaaacattagaatggtttgtgagtggcagctttaggaaatctttccctagagatttttatgcacaaaatagactgacttatcatttgtcaatgatttcctgtggcctctcttaaagtcatgggaaagtattacatgagctctcagattctatgttacttgattcaattcaacaaacacttgagtgtcaacttggttcatgcccccaggcattgctatatactggattcatgcgccctccccgcaaggggcctctcttccagtgatccccatctcaacacatgatgcttccatccatgtcattgcccgaatcagaaacctactctgcctcaccactgacattccattaatccctaatccctatcttctctggaaggtgtccacttctctctaatccctgcctcatggctccaggcactagctctctcctagggattactgcaattgtctaaataacctcccagcctccaggctcagcctgttacagtccatcctgcacacatagtctttctgaaatggaaatctgaaagtgtgccactctcctgcttcacatttcttcaatgggttcctgggcttagaggtaggaagtgtggaatctgagccattctgctcagatcttccaacgtccttgaatcacagctttgctgttcgaccttgggcagttatttaagctgtctttgcagcttcctcatctacgaaaaggggatcacaacggtaattcattttagagtagytggggggattaaatgatttcagatcctcctctcttatgtgaactcttaaatttggagtgtccctggaatctggttctcttatctctccacactccttccctcggtcatctcaacaggtcctactactttaaatatccatatactgaaaacacccaaatttatatctcaagctcagcccactctcctgaaccctggacttatatgtccagctgccttctcaacatctccacttggatagttaatrgagctcacagatatattgatatactttggatgtttgtcccctccaaatctcatgttgaaatgtgatccccagttttggaggtgggtctagcaggtgtcatggggttggatccctcgtgaatggcttggtgccctccccatggtaatgagtgagttctcactctgttggtttatgagagagctggttgtttaaaggagcctggcacctcctctctctcactcctgctttcaccatgcaactgcccgctcccctttcaccttctgccatgagtaaaagcttcctgaggcctcaccagaagctgagcagatgctggtgccacgcttgcatagcctacagaaccatgagccaaataaacctctttttttttaatattataaattaccgagtctcaggtattcctttatagcaagcttgtccagcccaaggcccataggctgcatgcggcccaggatagctctgaatgcagcccaacacaaactcataaactctcttaaaacattatcagatttgtgattgctttttttttttttttgagacggagtcttgccttattgcccaggctggagtgcagtggcacaatcttggctcactgcaacttccacctcccaggttcaagcaattcttttgtctcagccttccgagtagctgggattacaggtgttcgccaccacacccggctaatttttgtatttttagtagagacagggtttcaccatgttggccaggctggtctcgaactcctgacctcaggtgatccacctgcctcagcctcccaaagtgctggaattacaggcatgagccaccgtgcttggcctacccatagtctttctagtctcagctgatgaaactatccttctccatgctgaagctcagtggccctcccttctctcttgttctcactccctgcatcccatccatctggaaatccagctggctcctcctggagactacacgcacagtccacctcctcctcaccacctccatggctacagcctggtctgagctccatcacctctcgcctgggtcactgcagcggtctcactagtcttcttgcacagtcttctcaacccagatgactgataaatcagatcctatcacccctttgtccaaaccctccatgggctctctctttcacaaccataatctttaaaagagctttctagcccctgtgtgatcaggccacccaccctgtaaccttgtctcctcctttaccctgcgctcatttcactccagccacactgtcacccttcctgctccagaaactccccaggagcattctggccttacaggctttgcagtgcctgttccctttgctggaatgctctcccccaagatctccctatagttaactcttctgccttcttcaagtctttgcactaatgtctcttctcaatgaggcttgttctcactactctcttaaaaactgtaatttgccctccaatcccataacactcctggtagtttttttttattgcacatgccatcttataacctactatatactttacttatgtatattgattattatctgtcttttccccactagaatataagcctcactaggacaggggtttttttttttttttttttttttttttttgagacagagtctcactctgtcgcccaggttggagtgcagtsgtgcgatcttagctcactgcaacctctgcctcytgggttcaagcgattctcccgtctcagcctcctgagtagctgggaccacaggtacgtgccatcacgcctggctaattttttaattttagtagagacaggggttcatcatgttggccaggctggtcttgaactcctgacgtcaagtgatccgcccacctcagcctcccaaagtgttgggattacaggcgtaagccaccgcgcccagctccaagagatttttgtcttttgtttactggtgttatgtatccaagcactggaacagtgcctggcgcatggtagggctcactaaatatttatggaatggtacttacaaattataaaacacagtgtatggcacacagtgttttataaatattaacatttccaaggttcacaaccactaggctccctacttacctttccagcctgatctccctgcgctcttcctaccattccagctcagctatacttaacttgctcatctgcagagccttccttatgtacttttttctctgtccatctatccctgcatttgagggatcctttctcattttcaggtttcaaggtagagggtcttccctgactctaggtcagccatctctacagcactcctcccaccccctatgcgttccttattcatcacactgcattgcaatcccttgcttctcatttgtctttcctgctgggccctgtaaccacagggacaatgcctgtgacagcagtcattgcagcatctccagcatccagcacaggtcgatacgtgggggttttcggcaaatgttaattcagtgaatgaatgagaaattctcacggcagcgactgcatttctgcaccttcgacacacattatcacgtgttattgtatcttgtgctgttccttagggcataacaattgctagcattttctaactcaatcctcacaactctaggagggaggtactattcacgttcttatttgagaagtgaggaacttgaagtttagaggagttacagttctttctcacggtcactcaggttgtaagtgttggagcgggttcaagccaagtcctctggcaccagcgtccctaagcccacccagagtcataccattctgccattttgtttctggcttttcttcatagttcaaagtcagccaactacctgcccttagcaagcgtggagagaaccccccgcaccacctcagcaaagggcttgtgtgtggaggagctgccacccacgctccatttcaccaaagtgacaactaatgctagggagggcgaacctctcatcggcgaggtcgccactgtcaccagcgcccactgctgggtccaaggctggcgacgcctcaccgcatctgggcttgacttcctgcgtcactggggcgacccctggtcctgacttccactccacgccttcgtggatcaggacgactgggaccactcaaaagcgtatccaagtcctgaggtctccaaagcggtggagagacccgcccagcccctcactccccggctgggaactgagattgtggagggtgggcgccctgccgcggcccagtggggctgggggcttccagagtcggggtccagggctcggtgtccgagactccaccgccagccgcgccgacctgacccacggccgggtacaacagagaaggcggcgcttcccaaaggcaccgatggagtgcagggtagccgccgccctcaggatttatcaaccgcgaggcgctgtcagcaactcgtgcccggaagccaccccgccccggcacacacatactccagcgccccctccaggcgcactccgcaaacacgcgagcgcggcgaccgccccagccctttgtgactggatgagtggggccgagcagcacgcactgtcttcgacctccaatcaggactcggggtctcggagctgtaccaatcggagatgaccgtggcctcaacagggccaatcgggggactcgagcccgacaacagggcaagccgccaacagcgatcaatcagaggggaggagcggctcccagatacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccaggtgaggagtagggacgaccccgagcctggagagggggcaggagtgggggcgcgcgagggtcggggcggggtctcaggatgcagccgggcggcctctcagggctgcggacgcggcggggagaggtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactgttgccatggcagcgcacgtgcgctcgctggcacggcccggcacccctgcgctcttcaccccggaacgcgcgtgccccttcagccaggcccctgcccgcctgcgccccgcggcctccgtcgccgccggctctgggccggggcctgcgcagggaccgcctgcctaggccgctgcctctccctcgcaccccgggctgcctggctgtctctccctcctgctgtctcctccaggcggcgctgggcaccgcaggcctctgcgttttgaccacccgcgccggttcgcggaatggccacatcctggcgactggcaccagagagatgcaaccgtctgagggccttggggtgtctgtcccccagggaaatttttttttttttttggaggtggagggggcggggttctccctctgttgcccgggctgatctcgaactcgtgagctccagcggtctgcccgcggaggcctccctaagtactgggatcacaggcgggagccccaagggatctttttaaatgtcttactgcattarcaagtgcctaaggagtgctcagagaatagctctgattggatgaataaagacccccaagggcagctttccattcctcccaccaattctggtgggcagaaatagaaagcaaaccacatatgtaattgtacatgttctggtaaccactttaaaataataaaacaggttaaattaattttaatatatttgatttaacccaggatatccaaaatgttattacaacatataatcaatattaaattattggtaagatatttgaaattttttttttcatgcaaagcctttcagatttgtcgtgtgtcttacacttaacagcacacctcagtccgcaccagccacctttcaagtgctcgctggtcccatagtggctatcgtattaagctgcgcatttcttgtgtatgtgtgagctgttgccaaaacatgacatcaaattcagtgttcttggaagccctcttcaaagaacastgattgtgttgcagtcaggcaacgcaaaacatgaggcacggcccttttcttcaaggagtttgcggttcggttgagaaaatagacacccacagataagtagtattttaaatggatgcaatttgggcgatagtaaagataactgggagtatatgattgacagtcagatgactgatcattatcgtttcgaattcaagggagggctatcttcaggctcatgcaggaggggaagattgggcctggtcttgaaagatgggtaagtcttggactgttgggaaaagatggggagggccttttggttgaatggaactgaatatcgctgcttttgtttttagagttgaaaacttacagagtcctgaggctttcagactgaaaaaggctttcttctgtcactgacaatcgccaccatgatccatagtcttttcttgatcaactcctctggagacattttcctggagaaacattggaaaagtgtggtcagccgttctgtttgtgattacttttttgaggcgcaagagagagctactgaggcagaaaatgtgcctccggttatccctacccctcaccactatctcttaagtgtttaccgccacaagatcttttttgtggccgtgatccagacggaggtcccccctctgtttgtcattgagtttcttcaccgagtggtggacacatttcaggttcgtgaatgtgggaaagttcatatatgtaaaccgtaaagtgtctttgtagtcctgtttccattgtgtaaagcctccattaagaaacttaaaaaaaaaaatcaaaactctggtattactcacttcctctcccatctgataagattctggtttctatttattgaattggctgcatgcaaaatgacaaatggaatacttttgaacctcttgcgtgggaaagtcatcctatttgcgatgactatatatagcctttctagctctgattctactttttgctcacaaattagagtttagattgtttttgcctggtggtcttgatcctaaccattgttatctgcattgctttgagttgcatcagaaagtgattgtataaagttttagaaaagaaaaagtagaaaaagctaaggaatgcttaatttaactctcccagtcaggggtaactcatgaacctgtactagttctcaggtttgaggtggttctttatagtgagagagtggtactgatgagctctgcttgcaaagatgagattgggaaatctcatgtgcctgtaagaatttaagtgagccattttatgaggcagttttcattttaagctttttcttcaggaatagatgttaagaacttagggggtgatgtccaagggaggtcagtgataccaggacacgacaccatttgcagcacaggagttcagacagcaccggccctggattcacacagaggaactttctcccaaaagaaccaatcaacttctaactgttgtggttatttgcataactcaaatgagaagcgagggccttttggtttaacttctgtgtcrtatgaggtctggaatgagtcatatgaacactggaattgtggaattggagaagagaatgaggacccacacactatgataaaagttaaaaagcaagtcaaagagttccttctcttgtactcatatctgcaccacgtctagaacaacttcccttcccaagagaattaaaatacattttttgtttttccctgcaatactctgtagtactactgttctggaatttcagttctcatgcaacataccggcccctttgcacagtgaaaacgtaagtatgataagtcccagtatgtggaagaactagaagaacccaggagttgtgatcctaaacaacttttaactgggccttgttatgatttccacgtgtgatactttactcattctgagattaacagtcgcactggtgaaactgacagccgctatatggccatactaatgtaacttattacaagacaggaagtgagaagagttgtttgatctagttgaaaccaygggggaatttgggaaagcagagtaaatttgctaatttggaagtctgagacttcagagcttgttattcttgaagcagttgttaaaagtcagtggacatcctgattctcaggtctccgatgtggatgtgcatcctctccggcagcatgatttttccaggaccagaatgtgacaggagcggccccgcaatagaattgcaggctcacaggccggctgcagcacttggctgtattgcgaggctcctttccagctgcttagttcacatgatgcctggtttataaaacctagtgaagtgttttattttttaaaaataaatcacttttgggaaggaaatgtgtgactttttcttcttttaaattatcattcaaaatgagaattttcctcttaaagaggaaatctttttgttttaggaatacattcctgactcttaggtgacccgggtattggaatcttgtggataattgacgttatctaatgtaatttagactctagtagagtctgttcagttttggatgtcaaagaaatggaaagatggtgaaacaacctggaaaccataccttatcatgaacagcggaagtatcttgaaagtgtggccctgagaagaaaaaaactgaggtgaaaactcgtagttttcagataattgcagggctgttatgtacacttgctctgcaaaacagagctaggaggcaaatttcagtttagcaaaagaaagaactttggaatgatcagagccattcatgaatagaatggactttctcaaaaggagtaaattttccttcattctatgagttcaagagggttgcatgaccctctcagaggtcctggaaaagacatactgacattgctggaagggaacattgaatagccacaaacatttcttgctaaataatgatcacgcattccattttgtagtgctttatagtttacaaagtacattcatgagcgttagtgtttaattagtcatgcctaattcttacagccctgtacctccagtggtgttatcctgattataccattaaagaatcaagatcaaaattaattaacatgacttaatctacaaatgacaaaattataatccaggtcttctggtttgaaatccagtgctttcccacaatgcagataatttagcacctaacgttagccttttaaataaaaggacaaagagttcttggaatgctagcgtcttaaagatagtccaaaggaattttcaggtgtgctagyttgtccccttcatttcatttttttcccctcaactcttattcactgcatgaatgttaagaaatagcacagcagtaggggtaaagattttcatgtactgttctttgttatatcaagtattattttgtataattctttcaaattcttgttgataagcacatataatcaagattcaattttgtattctgtgtattttatcaagttgaggaaattaacccaaaagatttaagttcctcttgtttgtagaagaagctagtaatgacagtagtaccataagccagtctagtgctttctaccaaacagactgcctaagagaactatggttatgctgcattccctcgttgtagaagagtagcccagaaacacatggacaggccagatccttattctctgtaggcacattcttttatttatttatttattttacagtatctgagtgatcaatgtgtatattctgtctccatcaggattattttggagtctgttcagagccagtgatcaaagacaatgtagttgtggtttatgaggtattggaagagatgcttgacaatggttttccattggctaccgagtcgaacattcttaaagaactcataaagcctcctaccatccttcgaacggttgtcaacaccatcacaggtacggcrgagggggaaactgatagatagtggccatcctacagcctgagtggcttagtcgagtgtcgcacattgttttgagtgtttgtctttggggatctcaggtgtcccagtgctttaattttgctctttgtagtttttttttttttttttgagacagagtctccctctgtcacccaggctggagtgcagtggcgtgatcttggctcactgcaacctccgcctcctgggttgaagtgattctcctgcctcagcctcccgagtagctgggattacaggcatgcaccatcacacccagctaatttttgtatttttagtagagatggtgtttcactatgttggccaggctggtcttgaactcctggcctcaggggatccacctgcctcggcctcccaaagtgctgggattacaggtgtgagccaccgcgcctggcccctcttgtagactgagtacaacctgaaataatatttttgctttgtggaaaataccctgattttaatgacaaaatgaagtgttctttaaaaatatttttttctgattacagaagaaacacatgattattgtagaaacttcagaaatacagaaaagcacaaagaatgcaaaaattgcttttaatcccaccacacttttaacatgtgatattttatgaacattatcccatgatgatgtcttctacatggttcttttttttttttttgagatggcgtcttgctctgttgcccaggatggagtgcagtggtgcgatctcaactcactgcaacctccgcctcccrggctcaagcgattctcctacctcagcctcccgagtagctgggattacaggcacacgccaccatgcccagctaatttttgtattttttaggagagatggggtttcatcatgttgactatgctggtctctaatgcctgacctcaagtgatccacccaccttggcctcccaaagttctgggattacaggtgggagccactatgcctggccttcatttttaataatttatagttttcttccatgtggagtggacccaaagttacgtactgaatccctatttatgatgttactgatttttgttcttttaaataacaaggattaccattcttacacttgaaccttggtgcacatctgggatgatttctttaaagtagtagaggtagcaatgctgtgtcaaggggtgtatacattttaagtactgtaatgtgttgctctccagaaaagttaggccaatttatactttcagtaacaatttcaaagcactgtagtgaaccctgttattgtcattaataattttttagaaacattggcaatttgatagtttattgatatcttgtatttacagtcattttttgttattaaggagactaaaatcttttcaagtatttattgactgtttttcctctattgtgaattaccttttcatgtcctttgttcatttttttgttgttgaaatgtatttcttttttcatgtggatttaaaatctcttttatgggagatctttatgtcttttgattactgcattacagatattttcttacagtctatcacttgtgatttagctttgttctggtggtgtttagccacattttaaatgttttgatttaatcaaattaatcattcttttcattaaggttttacattttgggtcttgtttaatgcataagcaagcattttcatggaattttataaactgattgaaaaatacattttaaaagtataaatattgcaagaatagccaggacagttttggaaaagaattacaaaggggttgttgggaggatttgccctgtcaaatatcacgacacgttaagtttgtatagtacacaagacaaatattcatacagtagacatcctacaagacccaagagagttttgaaaataatatttttaaaaagaggaaagataaaatgtgtcctaccagatatcagatatattacaggtttaacatcccaaatccaaaatccagaatgctctacaatccaaaactttttggatactgacatgacactcaaaggaaatgctcattggaggatttcagatttttgaatttgggatgcgcaactggtataatccagatattccaaaatttaaaaaaatacaaaatttgaaacatttctggtcctgaacatttcaggtaaagattactcaatctgtatgaagtttgggtagtttttaaaatttggtatttgtctgtaacagacagataggtcattgggataaaatagtccagaaacagacccttgcttttataggaatttggtgtagatagatgtggtcatttatcaaatcagtggaccaggggctggttgttaactatattgtattagggcagtcagcttcaatatggaaaaaattaagtccctccacttcacactatacacaaaataaagtctagctaggttaaggagttaaacacagactttataattattagacaaaaacaggagaatgtctttttgatctcagagaagggaagatcttttttaaaagtctagtttgtgattttatttttggatttaattatttaatccatttgaaaattatcttggtgtgcaataatgtttatttcttcaagagttttcctagcaccattgtgtaatttatccttttcccctgttttagaatgacatttctatcttgtcctgtcattatggattcttggtctgtttttaggctttcctgccttttccctagactgctttgattattatatcttgatgatacattttaatacatagttcctctttttaaggaaacaaatttggtggtttcttcaatattctgagttcattttaagccttaaaagctttgttagtgcctgaatcatttacgaatattatgaagtgagttaagcctgtatctcactttaatctagaaaagggtatctaagaaccacttttgaaaagttgaaatgggcctgacatattggctcatgcctgtatccaatactttaggaggctgaggcgggaggatcactcatgcacaggagttcgaaatcagcctgggcaacttgatgaaaccctgtctttacaaaaaatacaaaaattagccaagcatggtggtgcatgcctgtggtcccagctactctgaaggctaaggtgggaggatcacttgagcccaggaggtcgaggctgcagtgagttatgattgtgcctgtgaatagccactgaactccagcatgggcaacataggaaaaccctatctcttaaaaaaattttttaggtgggcatggtggctcacatctgtaatcccagcactttgggaggccgagttgggtggatcattaggtcaggagttcaagaccagcctggccaacatagtgaaaccccrtctctactaaaaatacaaaaattagccggatgtggtggcacgcgcctgtagtcccagctactcgggaggctgaggcaggagaattgtttgaacccggaaggcagaggttgcagtaagccaagactgcaccactgtactccagcctgggcgatagagcgagactctatctaaaaaaaattttgtttaaagacagaaaataaaaggatccaggtaatggaagaaggaaatagaatttaaattaatgtattttattatgtcagtataaaaccttttaaattaaaaaaagtttatgcctgtaaaggaaaaaacaagtgaaggaattgatctacaattcttaaagacagggagagatcaactttgtgttcttttcctaagtttcagtgttggaacttgggaatgagacagatcatattgatatgtacattttagtacctaccataaatgtacctaagaacctatctcaggctcaaatactgtttttacccatgaaatttttatatcaatatgtagattacgaactctactgaaagccaatacattatttaagctgcatctgagatactaagttcaggttactttcaaaaccaaaatatgatatctgtttctcaggtaactttttcttaaacctttattctgtttgaaaaggcagaccagatrgcaacaaggggttttaaaaatagactaggttaccccatatagaagttgggaaaaacctcatcttctgtttgaaaaattcttcaattgagtgcatgaatagtgggagcatagaaacttctagggaggtgttctgtggtttctagagtcaaaatggtgttaaaatacagtaatattaattgcctcaggaagcacgaatgtgggtgaccagcttcccactgggcagctgtcagtggtgccttggcgacggactggggtgaaatataccaacaatgaggcctattttgatgtgattgaagagattgatgcaattattgataaatcaggtaggtgcttttaatatgttctcagaaatatgaaaatagaaagggacctctttcatataatgcttgtagtttcagaattaacccccattcaaggtcatccacttcaatttagtgcctactttgtgccaggcactgtgctgggtactgggaatggacgttaatattatgatgcagaccagggtttatttcatatgtttacttgctttattggtcttatcctcttgaataaaaaagagaagtaacaggccagatgtagtgactcacgcctgtaatcccagcactttggaaagctgaggcgggaggattgcttgagcccaggagtttaagaccagcctgagcaacatagtgagaccccatctccacaaaaagtgaaaaaaattacctgagcatagttgtgcatgcctgtattcctaactttgtgaggggctgaggtaggaggattgcttgagcttgggaagttgaggttgcagtaagccctgatcatgacactgcactccagcctgggcaacagcaagaccctgtctcaaaaaaaaaaaaaaaaaaaaaaaaaaaagtaacaaatwaatttcttattgattaaattaccttctcgaaagtatttggctcccagttctgatggcagaactaaagttgtaatcacaaaattcagggagctgccttttctatgtgttctgaattaggtaaatatgactagaagtcctggagcttcagaatttgtagaagccagtcatgatggtatgagcctatagtcccaattattgggaggctgaggtgagaggatcacttaagcccagtagttggagactgcggtgagctatgattatggctgtgaataatagctgcactctagcctgggcaacatagtgagatcctgtctttaactaaagaaaaaaaattgtaaaaagtccttttcacattagtgaacttattaaattcaacagatgtttactgaaaacttgcatcatagcacagtgctagatagtgggcacttgatgatgaataagacatagtctatggctgcagaagttaagtctagtgagggagagagaaaggtaaaaaggtagagnnnnnnnnnnnnnnnnnnnnagagaaaggtaaaaaggtagagcatatgagaggtacccacccctgagcaaagtgcaacagagaggtgggggtgtttatgcttcatcagtggattgaaatgaagttattaagatgtgtggatttgggagcaaagtatgcgcaaacatcacaatattgagcaaaaaatcagatgcataagattatagacagtgggattacatgtatatgaagtttgaaaacagatgcaatttagtctaaggtaatagaagtcagaattttggggatgtgaattacctgggatgggtaagagggagtgcttggatgctgaaaatgttccgtatcttgctgtagctagtatttgcataaatgtatatatatttaaaaattcattgagctgtacactttaagatttttacattttactgtttacctcaacgaaaaagtaaaatatatatggccagatcatgaagaaccttgcctgccagtttaaggagggcagatgtgagtgattgaagagttttaagttgggaatgacttgatgagacttgtagtttagagcgatgagtctggctgctgtgtgaagaatggcctgaagtggggtgggcctgaaggcagggagcagctacgaggctgaaatccaggcccaaaacatagatgtccatagtgcaatgaggacagagaggaatgcacagaccagagagaggtgagtcctcgaaaagaaaggagctgatcattggctggatgtgggcgggagaagtggacgttgtcagggatgcatctgtgtttctggcttaggcagcaggataratggtgccatcacacagatttggaaatgggagcaccgggttcagggcatgagagaatggactcatttctgacatgtgcctcagtgtcatccaagtggagatgtccattaggcaggagtggggctgaacttgaaaaaagaataggtaataatgggctgtaaatgaacattgaagccttgggaagtaggtaaaataacccaggagagtgtgtaaagtgaaagaaaatagaagttcagaactgaaaaagcatttaagggatgtgcaaagaaagagaacctgccgaagacactgaggaagaggagctgggaaaataggacaccaggagaggttaggagggagggatgtttgagaaggcagaagtgattgacagtgacacatgccacatagaggatgtatagaataagagactgggagtgaccactcactttagcagcagagctcattggtgaccttagggagaacagtttctgataggaaactttctgaaccattggctaaaataatgatgctctgtttaattctgatattagactgacaactcctttaggctaataactacttcattaatctttttatcaccgttacctcaccatagtgtctcatgcttgatgtgcagttgataagtgttcagaatgatggatagatggattgtataaatgaattggatggctaggcagaaggaaagaaagggagagagaggaaggggagggagagagaggaaggtgagggagagaggaagagaaggagggaggagataagtttgttgagaaggacagagaagtattcagtaatctgtgttctttttgtcttattcctgtctcaggctccacaattactgctgagatccagggggtgattgatgcctgtgtcaagctgactggcatgccagaccttacactttccttcatggtaaaatcctgggccagagattaagttcttgggatgagaaattaaatgctgctggaaagacagagtagtggsaatggaatagaacaagaagaaataattaggacagccacgaagcttgtctcaggcttgaattttctagaagtcactacatgatttctgtgtgtgtgtgtgtggtgtgttttaattaaaaacagcatttaaattgctttcctgaaagcactgcgggtgtttaatgcccacttcttgcttctcctctcctgatgactgtagaaccctaggttgttggatgatgtcagcttccatccttgtgttcgtttcaaacgctgggaatctgagcgcatcctctccttcatccctcctgatggaaacttccgcctgctgtcttaccatgtcagtgcacagaagtaagcagctcttataattaagaatggaatccgtgtatgtacatgtatgtggaaaccgtatctgtggtgattaagaactcaggctctagagttacctgggttcacattccagcttctgtggttactaattgggtaacctcaggtgagttgcttaacccctatgtatctcttttctcatctgtaaattgaaaataataaaagtgccttgttctgaagattgaataagagaatctgaatagtgcttaacacaaagaagtgctcattaagtttgctgttatttttgttgttatgtgtctaaacaagaacattattttctcaaatcagaatctgggcatactgtgttcaatgtccctggtctaaaagaagcattaagttatgctatgaaaaagcataaaacgcagtgatttttggtcttgaacattctctttaatttggaatctaaaggcttttggaagcagttttgtatagtataaggtatgcagacagaagagagtcaggaggcctcagagccaccagtcccttcccgtgtgatgtggaatgaatcatttgggaaaatatctgagtgcttgaggtcaaagcctctggaatcagactccctggacttaaaccycatcttcagtacttagaaccttgggcaagttacttaatctcagttaagtataaggacatcagtattcatctataaaatcagtacctactacatagttacagtagcagtatctacttcatacttattgggaggattaaacacggtaggagttaaatggatagaaaccatttagcatagtgactggcaaacaggaagtactcaatacatgttaggaactgttattacttcagggttattccgtgacttctctgaatccttttcttctgtcaaatcatgacagcctaccctaccttatggggtttttgtaaggaccagatgatgtcagatgaaagcattctaaaaaaattatagagacaagaggatcacttgagcccaggagttcgagaccagcatgggcaacatggccaaaccttgtctctacaaaaaaaaaaaaaaaaaaaaaaaaaaaaaaagtaaaaattagcggggtgtgatgttgtgtgcctgtggtcccagctactcaggaggcagtggtgggaggatcacttgagcctggtatgtcgaggctgcagtgagctatgatcgtgccactgcactccaaccaggctgaccgagccagaccctatctcaaaaaaaaaagaaagaaattataaaaggtccatgagctatgaatattatactccccagtgcaaatgatgactggtcacatgttacaagttaaaaacatggagacataatgacaatacatttttgtacattatgcctttgtcatagtagtgtactttttgattttgtttatattattcagagtcattagaaaagttaatttagttactagacagtagcttttcaaaaagaaaaaattagattactggggtttttttctgtttattttttcagataaaaagtaaggacatagttaagggagaagaagctacccacagggcagaaaaagcatcatgtgaaaggaagaactaccattttcccagtgcacgaatgaaatgactctttgtctctcatttccagtctggttgcaatcccagtgtatgtcaaacataacatcagtttccgggacagtagttcccttggacgctttgaaataacggtgggacccaagcagacgatggggaagaccattgagggagtgactgtcaccagccagatgcccaagggggtcctgaacatgagccttactccatcacaggggacacacacattcgacccagtcacaaaggtagggatgagcaggacatcttgaattgctgatgttaagcagaaaccagtctgcaggttctctgtgtagactctagaccttgtttggaaggtgagatgagtcaaagggaccttgttttctcctgccaggtaacttaacagtaacacgtaggattctcaatggaaagatacccagaggcagcttataatgttgtggacaggtgccctgagtttagatctcagccacctcaaatgcaggattctgctgtaactattttttggaaagaccacttctccatttttattttctttgaagatgctgtcttgggatgtaggaaaaataaatccacaaaagctaccaagtttgaaggggaccatgagtcttcaggctggagcttccaaaccagatgaaaaccccacaattaacctgcagtttaagatccagcagctggccatttctggtaagtgacccagagctcaagaggctccaaagggaacaaaaacggctttctgccatatggcgcaggcaccaggaagcctttctgggcttcctgtttacaaggtttagtttcattacctgataaacaatctttagtaacatcttttctggcatgtttctggggaaaatttacaatccttcctttgaagttggcataagtgacctgaataaaagtgcctaagacacactgagaaagaaacagtattggtagaaggaagtattcactagccatttttggatcatcttagggttgttcatttcaggttcccaaggttttcagtatgagaatccatgtgcattctcagctataactgaagtgtaatttccactcctttcttctgttttcagaagactttcatgtttgctcttatttctattttggaaccactgggcctttccaggtcagttcactatagtctgtgccgaccttagcacggtagtcatcagttaccactttgggggcatttaccaygttccaggcactgttttaagctcttttcatgtgttttcttttttaatccttagaaactctgtgatgtggaaaggagatgactttagctttatatgaagtttctgtttttctgtacaaacgggccttatacaatttaagtgattggaattcatttgatgtataagctcttcaatcttaaaacaataaactataaagctctataccatataaaatattcttggcttagtctagtgagaatacttaggaagcattcatttattaattactttcattgttaattcctttatttataatttacttcattattcatttgttttgttattcattttttcagtccaataatttgagaaaaatcatgcagtggtctaattttttccttatcctcattttagtctgcacattactttgtaccctttccacttcagggacaggtcttctcataggtagcttgtctgttggagcctttttttgctgtcagtatctgtcccaagactggagaatccatctgctctgcataagtggttccctgtcacagcaatgtcggtcccactgacytcagtgtattgaacagaaacagttaggcgacctgctccttttgaataatactcatgtctattttccctctctccctcctttctaggactcaaggtgaatcgtctggatatgtatggagaaaagtacaaaccctttaagggcataaaatacatgaccaaagctgggaagttccaagttcgaacctgaagggagcatttgctgagggaatagtcttgcacattttttcatttcttacttgtctaaaagtaaaaaaaaatatcagcctgtctcctaggtcagtcccctcctggacccaccygctcccttttttccttagccttcagtgccatggaactaatcaagggaggaaaaggtcaccagggagaactggacagaactgaaacacagcaacaccagttctcaaggacaaggtgtgtgatgggggtaggaagcttggtgcttatgtaaccattttaaacgtggtttctataggaaagaccaacatttgtttagcttgcttggctttaattatctaaagccaatgaaagacttctttgttgattttttaagatagaaagattaaaaagaaagaaagatgggaagaaaatgaatgtyagtcaaggaaaggccacttaaggatctgctctatgaaggagaagaaagaggaaaaagaagtaaaggagttaggaggagacacttaaatgaaagattggcaagaaaagcagtcggactctaccttaaggagggatgggaaggaaagagttgwgttggtttctttctgattcctctactcatgtagaaaacacttgtacttctggaaatggactggagactttttaaatttgagtccactattgacatggaaaccccagtggaatcagattttccctcaaagaccatgatggtatcggactagttttcagacactgcctgttgctgtccatcagcacttggtctcttatcttcagtgagaaggtgacccgccttcttcccatggtggctgcctaaagtgcttcttttctaacccaaaacagttctactcacttccttttacagaattcaccggccattttcctgttacctgatccttctacaggatttttaaaaagtaagagagtttcagagaagccgatcccataatccccagtgcagccagggtytgtgtgtcatcgtactggagtagagggccgactcttcccatgaaggtgagcacagctgtgagtgagtgagctcatatctccatttgtcagtgctggactggtaccagatcgtaaccttcccgttggtcggaaacttttccatctgtcrccctagaaaaagagaaagcttaccatcgagggtgtggttgatccttgaagctgcttggtaaagttatcatttcctcagtcttttcttttgtactcctatcatgtattcattaatatctaycagtcccttttcattctaagacaaaacatttctcctaaatctctgaataaaatcagtgctgtaggaagatggactgtgttgatcatgggtgtaagcaacccagtttaagaaacatggcaactaaagggatacctcaggctttctttcccagtgggtcatttttgtcctagttcagtgtgtctgttactatttaaatatttatacaaaagggtttttgtttatagcttaaggaatgatactgtgctctgcttggtgcatggagaaaaaggaagacccrtactctccacaccctagagcttttctctaaatattgtgcaaagtttttgctagttttatcttctgactttgggactagtttttgctgcagagttgtgttgctttgtgattttcctctgggatagtgtactgtacacaaccagatgtgttccacactccgtgactccgcagtttgtcctggagtgacatacacatccaccatggaaagggaagcatctctgcctgtggattctcaagtacttggaagcacctctcctgaggaacctacaggattctaaggtttcctaggtcactgaacaactaatcttggtccctgaatatttctaggtttgtaagtgcagcagttttattkcctctagaactcatcctgtttcaagggaagtacctaagaagatatagagtgtttctagggtaagggacctgcaggtgtaagcatagatgaaataactgtccwgtcacaygtgcagcaggccatggagtgtagcgggcatcgctgccgccattcctgcagcatcaccataagcagtgcagggtgtctccatcgagctgtttggttccatgtgtgtttaacatgtgcagaagtagcttctctgtttaagtttaataaagttgagtttcaccagtcttctatgtcctaagtggtttgttaccagaactaacaacagtgctatgccactcaaacctcagtagaagcagtgagtaaggaattcatcgactcaggaggatcttactgcttctgtcctgtctagccagcagacctaaagcatgtgttttgatcgattctttggtcacatctggaagatagcagatgctgatattaatgtcatttttagggttgtgagcataaggtccagatccacctagttatttttcaccagagttttaaaagacgaaatcgttgaagctgccggcatttagtctagggctttcygcattctcttgacctgcttctcttgtcttgttaatttaggcatgaaacggtgtcgcagtactctggcgtctttattccaggagaggcttcttacaagataaggcactgcgagtcgattgttacgccacacctgtaacaattttctataaacatctcatggccatcaaaaaaccttaaaactcaatgcgtactcactgtgagtgttcagtgccagctagtgctccaccccttctccctctcagccggcgtcaactgtctcttcgcctgtgctcccgggtgctctgaccctggtggtgggacaggaagttggttgtatacatgtacttttctctgtggccggtaggtggggactccatgccatcaatactcattattttaatggttagatttttttttttttttttttttgggggacgtagtcttgcactgttgcccgggctggtgtgcagtggcgggatcttggctcactgcaatctccgcctcctggattcaagcgattctcctgcctcagactcccgagtaactaggattacagggcgcccaccaccatgcccagctaattttttttttttttttttttgtatttttagtggagacagggtttcactatgttggccaggctcgtcttgagatctgcctgcctcggcctcccaaagtgctgggattacaggcatgagccattgcgcctggccaactgttagaatttttttttttttttgaggcggagtctcactctgtcgcccaggctggagtgcagtggtgcgatttcggctcactgcaagctctgcctcctgggttcacgccattctcctgcctcagcctcagagtaggtgggactacaggagcccaccaccgtgccccgctaatttttttttttttttttttttttttttagtagaaatggggtttcactgtgttagccaggatggtctcgatctcctgacctcgtgatccacccgccttggcctcccaaagtgctgggattacaggcgtgagccgtcgcgcctggccctgttaaaatttttaaaaggaaatttgaccagcctggccaacatggcaaaacccatctctactgaaaaatataaaaattagctgggcctggtggcgggcacctgtaatcccagctactggggaggctgaggcaggagaatcgcttgaacccgggaggcggaggttgcagtgagctgagatcgcaccactgcactccagcctgggcaaaaagagtgagactccatctcaaaataaaataaaataaaaggaaatttaatttcaaactctgaaacttcctccaagatcctaagtactgaggattgcatgagtctttggcttttgaagttaagtggagtgaaaagtttatgcactttctgataaacagacatgactggggctctgggagggtacagtgtcaccatcccagagttcctctaggttttcacccagtaagaagagttgcacaggtacctggagatcttgttctcctggactgttaccatctgcttgttttattaactagctgggaataatgaggagatgatatttaatttcccctgacacccattcccggtaatgatgtgttgctctttgagcgtgttttagaatttgcatcactgggctggggccccgtctctcagtcaggggcctcttctgagcaattgtctctatctagtctgtggttccaagactgcgtgggaggaatgctggggcctttttacctcccatttccatccccaggggcctcactgcctcagttcatttcattaatcctgaagaagagcttgtcctgcaaagggggaggggatgaaaccagctgaatttctgccggagattcagtggctgggggttccttcgcactggtcctcagtgtttttttttttttctttctttctttctttttttttcttgacagagtcttgctctgttgcccagggtggagtacagtgacacaatttcagctcactgcaacctctgcctcccaggctcaagcgattctcctgcctcagtgttccaagtagctggagccacaggcgtgcaccaccacacccagctaacttttgtattttagtagagatggggttttgccacgttggccaggctggtctcaaactcctagcctcaagtgatccacccacgtcagcctcctaaagtgctgggattataggcatgagccaccgttcctggcctcaaacaatgtttttcttaaatggctgagacacacatctgtctaaaaactgtagaacatgcaagtgagcagtctgaagtcaagaaatctgtgacttaagtctctgtgacctgcatttatttactggcctaggtacttcaacacttcagggatgtcccccgctgcctccctcaccccagtcaagctcttgggagttaaagaatctctttcttttgtgagtttaaacgacttttgttccaagaacctctaaactgagcagttctgacaactccaccagagagacgaccacctttctcctctctgaggagctgtgtcagcatatccccaacagcagcattgcagcatccgatttattcttggaactaggatgtcagtgagaacaaaagctgccagacagcagccaggaataggggttgcatctcgcgagtagaaagtagtctaagagggctgggtgcagtggctcacgcctgtaatcccagcaccttgggaggccgaggcaggcggatcacgaggtcaggagatcgagaccatcctggctaacacggtgaaaccccgtctctactacaaatatgaaaaattagccgggcatggtggcgggcacctatagtcccagctactcgggagactgaggcaggagaatggcgtgaacccaggaggcagagcttgcagatagcgccactgcacttcagcctgggcaaaagagcgagactctgtctcaaaaaaaaaaaaaaaaagtagtctaagagaagcagaatgcaacattacttagataacgtacttgtgtggactggtttaggggttcaatttctaatgagcagaaaattaagacaatgggagacagatggcccaaataccagcttctaggccgaaccaacggttgggatgttgctgtgttagcaaggtcatgcgaggttcttcctccctatccccacagcgttcctctcctgctgtctgcttgcttgccagccaccccctggttaattttcctaaggcatgcccagttcctcacttccctgagcagaatctccatggctcctcgttgcctacagaagtcaattaagtccaaactcagtttggtgttcagagcccccataatctaaattccagcctatgttcctcttcctgaagttcacttcagacaagctcaactcatttctccctgtactcccctctcttggccctctacatattcatacctccatggagagtgccttttccacacctgtccacagtccacgtctcacccagttattttttccttaagattctattttttccttaagattccccaatccctcttgcaactgaattctactacaagtctgcccttttgtgaccggctccactgtaccttggtacttctctaaatgccatattagcccatcagaccaagcattcctgtccctccttttcccggtctggagcacctagcccattgccttgtatgttacaggtgttgtgtatatgttaagcgagtgaagcagaattccaaatgattttaaaatgtgaacatgaataaagagtgggatacagcatctataacaaaaccattccactctgattttggaaaaactgtgaaaaatatatctgaatttattaagtacagtataaaacagggttgtggcaacagaaagtaaaaactaacatggattgctataaatatgctgaagcctagttgttcaaatgatacaattctctcatgctactctaaagtttataaagaaaaaggatttacactttacacactgtacacaaaaggaataccttctgagagccagggagtggggaaaggggaaggagacttgacgtcaagggtgcttttgaggaacatgacgggccagccagcctgccccaactttgaggccctgctgggctcttgtgactataaatatactgtctatttctaatgcaatccgtctttcctgaaagatcttgttatcttttactattgagacatgctttcatttttgtggtcctgtttccaaagctgctcacggtgacaggtcaggaggttgggctttagctgaaaacagggtggcatggccactttctgcccagggaggaggcattcctggagaggctagtgtgcattcatgtcttcccatctgacagagtatcctgaaatcagaccaagtcctgaaaacttccaaaatgggaagtatctgggaaaatgcactcttccctctcctgtagggtctcgtcccgcttctgcggtgtggtgggtctggagaagtctgtagagaagcactgcgcctttgcagtgtcttctgaagaagaagaggcgggatctcatttgcttttgaggagtcgggtgttcctggtcacggtcgcatgttgtcacgaatccagtctaggtagttggtaaccttggtgtacacacccgggacatccttctgtccacagcccaggccccagctgatgatgcccaccaaagtcatgcggccatcgttcagacacaccagggggcctcccgaatcgccctgcaaaggagatagcaggtttggcgtttgcaaaaaaagcagactatctggagaaagtcagtatgtgtagcatgaacatcgtaatcttcaaaatacagcaggcccttcaataatattccattcagtgtcatttcattataactttgatgaggaaaacaaaaatcaattcctgtctggggacactgtctgcctgggttttgtccaggtaccccggtttccttccacatcccaaagcttgcacattaagccaactgaggatgtatctacgtgggcccagtctgagtgagtgtgggtgttagtggctctgcaataggatggtggcgtctgtccagggctggtcccgcctggcgccctgagctgccaggtggctctggccacccccacccaagaccctgaaccggaataagcacgttggaaaatgaatgaatacaaagtgttataaagtaaaaatctgtctagtctgtgctaaatacacgaatgcatgataaactgtgaggtgtggaggcagtcagggagcctgccctatttgtgattgtttttgaacttcatggtagtaagaggtgttccttaccatttttgctttgcaaacatttattccctgaattaacccaccactattatggccgccatcattcacttattctccaaaaattgggtaaataaataccatgtttgtttttattaacctttcttaaatgttgtatagctcacatttatttcaatattgaatgttagaagtgttttgggtctttatttagaagtttgctgatgtttttatgactagaaatattgccacaagaacttcactcttctttttttgtttttttttgtttttttgttttgagacagagtctcactctgtcacccacccaggctggagtgcagtggcgcaatctcagctcactgcaccctccacctccggggttcaagcaattctcgtgcttatgggcacgcaccaccacacctggctaatttttgtgtttttagtagaggcagggtttcaccatggtggccaggctggtctcgaactcctgacctcaggtgatctgccttcctcagcctctcaaagtgctgggattacaggcatgagccccgcacctgaccaactcttgtttatatcaattagctggtggtaaaattggttttgttatacgtcatttcacttacagttgcagtttctaagaacctattttttccaggcatgctgttaagtggagacttactgaagagtgggtagattgtatctcagttatcttggtcccatggaggattaggctgtatctattctggtaaagtagagttaattactcaaacgtttcaggcctcaaaaaccctggcttggctccatcacttactagctgatggccttagactaaccatgctttggttttcttatctgtaccatagagataatattcatactacccatagagtggttatggcattcagtagaagaatgcatgaaaagcactggaagacatctagtaaaactcttggtaattgttagctgttcttatattgaatt

SEQ ID NO: 17871 - DNA, 12442 bp, Homo sapiens
atctacatattaataaattctgtacagtggtttggcttaatgttttatatgttataagaaataagcaaaacatagggatgatatttttagtaaaggtatttcagggtatatgagaatcagattcctagggccctgggtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttcttggccttcctggctgctaatattccagttcccagcagcctcctctctcacccttcacctcttctgactgggtgcgaatggtaactagaccaggcagtgccctccttgtcagtctgcctgtctgcctggttccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcctcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaacgtataagattgtatgtacatggtggcttggtttccaggaattgctgattaggtaatttagaccattccttccactgagtacaatgggaaaaggaggaaaacatacatatttgaaaaatctggttgagcaaatggatgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacggtcccttggtctctctagaattcagtgctcatttagaccgggctaagaccctcacactcaatggctggaggatccaagcttatggcatgactgcctctggagcatttcatgctagagagatcccaacaggtgtaggtaaatggtctagagggtactagccaggcttccatggaactctgtgtaaggcacttccctgtgttgttactcatgttggccatgtcctcgggaatttagtggaacggccatgtcgtcttgagtggaagtgaggacggtgagggggtccctgggcagtcagagattttgtgtccctgcgtcctttccttccatctcaaccagagaccacttgtgaaagcccaagaacaaatgtcattaaatgtccgaggcgaatccaagaccaccgatccattgcgcccaggagccttgggccatgtagcccagcagtagtgaggtctgtgaggccttggtcacccccaaagtgttgccccaagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccctgttgttccaagtgcagaagagaaagcttcttcctgctttcagctgcgtgactgacaacggaagctggaattcagagaatcagtggcagcctctgtctctccaggccccaaccctgcaggtttaaggaatggacttaggtctctggcactttgttctcaacacacattttccttcactcattcagaaaaaaaaaaataataatagaaaatgaaccaaaggctgcaattctcatggcacctagagaactggagtacggaccaaggttgccacatgcctgtcattgctccaccacactcggttgccgtgtgacctcgggagaagctctctaccactagggacttttaaactcatctgtgaatcctggataaacacagacattccggtaaccttactgaaatgaagtgaggaccaatgagttgacaggtggagaaaaatttttttttttttttttttgagacggagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttagtggagacggggtttcaccatgttagccaggatggtctcgatctcctgacctcgtgatccgcccgccttggcctcccaaagtgctgggattacaagcgtgagcctccgcgcccggccgcagaaacagaaaaatttaagtgatggcctttactcctagacagggcttttttaggaacatgcaccttaaaagtaggaggaaaacataatgccagcaacaccctgcctaaaagcccctttagtgatgataattatcattcatctttctataaaagtacagcaagactttctacctcaatatctcaaatcagttaaatatatcttctgatcatataccagtgtggacccacatgttttgctccaagtgaaaatgaaaaggaatgagaacatctccacctttgtgtggtgaccatgggaccacggaggcttggaagccagcctacatctgcccaaactctacatcacctgccattgtcaattttcaatctatccgttctatgctttggaatcctacataattcatactcttgaaaaatctcattttcatatgtagggcagggtagaaaaggtgatatctctgttttaatttgctaagacttccataataaagtggcacagactgggtaagttaaacagtagaaatgtattatctcccagttctggaggctacaggtccacgatggaatgtattgcagggctgattgctcctgaggcctgtctctggcttacagatggccatcttctccctctatcttgtcaacattggcctcaaaatatgtgtacagggacacagtttagcccataagagtctgcgccatccttggcggtgcatattataagaaataaaagagaatacaaccctttggctggactctgttgatattttgaaatgttggtcttgcaataagaacaccaccaaaggccaggcgcagtggctcacgcctgtaatcccagcactttaggaggccgaggcgggcggatcacgaggtcaggagatcgagactaccctggctaacacggtgaaaccccttctctactaaaaatacaaaaagaaaaattagccgggcgtggtggtgggtgcctgtagtcccagctgctcgggaggctgaggcgggagaatggtgtgaacccaggaggcagagcttgcagtgagccaagatctcgccactgcactccagcctgggcgacagaccaagactccatctcaaaaaaaaaaaaaaaaaaaagaacactaccaaaacaagggagccgaagtttagttttccctggaaggtgagcactccctgagcctggccgccccagggcagcaagacccagtgctatgtagttctccaaagtcctatttactttagtgattctgattctgtatttttaactgggaaaaggattctctttcaggaaagcaaccacttctgatgctatttaggtattattctccttatacttataggagaaaaaattgatgttaatgaacaggaaatatttgccaaattatcacacaaataatttttgtatcattttaaaatactccttattgtactgagcttgttggtattttaataaaaattattggcacataatatttatacatactttggggtacacataatattttcatgcatgtgtagaatgtgaaatgatcgagtcaggatatttaggatactcatcacctcaagcatttatcagttatttgtgttgggtgaatttcaaatccactcttatagctattgtgaaatacacaatacattgttgttaactacagccagcctgctgtgctatcgaatattagaatttattcctcctatttaactgtatctttgtacccattaagctacctcgttttatctcccagatcccccacacacccttcccagcttctggtaactattattctactctccacctccataagatcaactttttttcagttctcacatgtgagtgagaacatgtgatatttgtctttctttgcctggtctatttcacttaacatactgacctccagttccatccatgttgctgctagttattatgaggtagttctagctggaagaatagagaattaaaagaaatctttgtgaagcccctacccaggtttgtcaatttgtaacattttaatattattggctatatgtagtatacatagaaaataatagaaatatatgcagatagccctgattctccacagttctgttatgtatgtgtttccgctgaaacacatacagtacagtactctatgtactgtacagtactactgtactgagtactggactgccagtggggagtggcggatgtcttgaatttggtgaatgcctttatattgctacaaagtgtttttttttttttggttgtttgttttgagacggagtctcgctctgtcgtccaggctggagtgcagtggcgcgatctcggctcgctgcaagctccgcctcccgggttcacgccattctcctgcctcagcctcccaagtagctgggactacaggagcccaccaccacgaccggctaatttttttgtatttttagtagagacggggtttcactgtgttagccagggtggtctcggtctcctgacctcgtgatccgcccgcctcagcctcccaatgtgctggcgtgagccaccgcgcccggcctacaaagttttttaaatcctttcgtttgacatgattttagactttgtaaaaattgttttttgttgaatgtatcattctgtggcttgctttatcgtttaatatggtctatgaggtgaacccacacacccatagaaacagttcatttgttttcagtgctggatagtatttatgagacgaatatcccacaatttatctcttctcctgtccgcgacctttagcttgtttctgttacagacactgccacaatgaacatcctgggtcatctctctctggtcccctgtgtgagttccccaagatacggatgtaggaatgggattactgtgcttttaccatgtgatgttataggatgtcaaattgttctctgaagaggttgtatcaactcccccctttaaaatcttctttgacattttacaggtcaagttatcttcctccccaactagctgctcmkcctcagtcccccttcaktggctccttttgctgtagatgctggagcactstggggttttactgcctcccaatcactcyagtgtcctccactcccaggrttttaaatatcgtctagacacagatggctcccaaatrtatatctctacatatttctataatcaaaaaactaatggtaccaaaacaggtactctgatatattgcagatgggcctgcaaactggaaatgttttcaggaaaggcagtayggcaatttctgtctaaattaaaaatgcatacacccagtagtcccacttctagaaatgtgtccaaaaatasacctgcattcctgaaaaatgactgtattcagaattatatgwtgcaaccctgtttgtaaaatcaaaaaggaaagaagaaagaaamtgaaagataaaagaaaaaataatccaaatgtctgtcactagcggactagttaaaaaagcattgcaagctgggcacagtagcattcacctgtgaatacactctactccactctgggtaacatgaggaggcctccctaccttcctaagaaaacccaaacaagcactgcatatctacacggcggagtctacaaacatttaacacaaaagaagaaagacataggaaactcttgatattccctcatgggatggtctccatgatacattgttaagaagaaataaagcaaggtgtagaataacatatagagtctgctaaaatttgtgtgaaaagggacaaagagatatatatacacatttatatttgcttgcatatgcataaaatatatttggaagaataagcaagaagatatccctggttgcctgttggggatgagacagggtaagaaagagacattttaccttttgaatattttgaattttgaattttgaactatatcaagaaataaaagataattcctagggcaaccaaacaaaccccaaaaaaattcaaaatgaaaaaccttttaaaaactaatagaatttttttacctttattaaaataaattttaaaaattttctaaatattatattattcctttaacaaggaggtttaccgccattttaattcagtacgttgttttctttttaattgcatgatctttctttacatctatcttttttccattacaaggtaaaataacagcatgattaattaaatgcaatttgtttggtgaatgaaattttgttcaaatcttggtctaagtgggaaagggattctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcggtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagattggggtggggagctgtccagggtgggtcaggtgtggtctcactgatcctacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctgtgtgtgtgtgtctctctctctctctctctctctctctctgtgtgtctctctctctctctctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctatcctgggtgcctgtggggctcccacttacaccacaaaacaaagctcaaataatattattttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcgtggatacaaagggtgaggttggagcaaaagtttaataagcaaaagaagaaagctctcccccacggagagggggcttggaagatggttgccatttttacagctgaatgcaaaggcttttacaagaaactgatgagggctgggtgtctcatttgcataaggcacgaatttccggtagctccaccccatcctcctagtgcccatgcaggcccttagcttgagttactccatattgctttgtttccctgactgcccatgtatcgggggacagaattttccattgcgggcatgtctggacaagtctcctgtgcagcctttcttatttgtgcagctgtgggcatgtcttaggcaagcccccctgtgcaagttcccttctctgtgcctgcaggccgttcttttgtttgaaataattcaactgaggacccaccataactgcccgcctgaccagtttcttccttttttctctctcaatttgtgttatgatttccttactgatctctgcctgagcaagactgggcacgccttgagggcaaggagggtttatttcctcttacctcagttccagctcctcttaaaacaatgccccacgcacagtaggtatttgataaatgtttaccaaatgaagggattgcctggaatggcttggcagacaggaaagcagaatgaaaacccacaggccaaaagtggctgggaaaagattttccaaatcctagtgctgggcacagggcccactgaaattcactttcggaaccttcccatctgtcttgttctcctctcatcagggacttccatgcccctcaaagcccacctagtcacacactacctttcaggaccaccttccagatcagccaggtgcaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgctccaccagaaatgcagagtttttgtatgtgcgggtccggggtcttcaggagataaagaatgatagctccaggagcgctgggacccccgtgcagccaccagtcaccacagcctaggcaggggttgggctctcacctcggcccctcccctgcacgccctggatgtggatggtccccgagtgtgaactcgcctgggctctgaccctgggtgctcttcccgccgttgtggagcctctgcgggtgtggtgcatgcacagggggcttcacaggagacccggggccctttagagtctcaaggccaacattcttggagaatccatgtcaggcattcaggctctcagagactcagatgcccaaactatgaaaatgagagaatctatcccactctctcaggtgtggtgagattcctattatatgactatcggtcatctatacatggattgtactctcagagttgcctttatcagtcggccaatgcctaaaacccaaagatgggtcaggcatggtggaggaagagttcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgaggtggcttactgcaacaaacccagtgtaataaatacatacgaattactttaaaataacaccaaggaaaatatacattttaaaagattaaggctggggtaaagctggaacattactaggcgggaaggaacatctgaaacatttgctgaaatggagttgaccctttacctagccatagatttgttgcctcacgatttcattacatctgagcaccagggaggggggtggcagttcaggtcaccagtcccttgtttcctgcttcaggaacagtgtcctgttctatacttacagtcaaagcaaattacatcgttgtaagatgtttaatgatgaagtcaaagtccacagagtcagcaagtaagtgtaaaaacctcaggagtccaaggacagtctacgtttctccccagaaatggcctcactatgcactgttgaagggagagggtcctttcaaggggccccaagatgcaggagcaattgggctgcagctctaaataaagatgtcctttctacctgcagattccacaaaacctcacaggcaaatttggtgatctcacctgagctaggaattcggttttttgatgttggttctctttgagccattgtgtgagctttaaaatgtgacgtggagattttgctatactggtatttccttgctggaatttgacatccacagtggctctggcttccctgtctggtcccaggaggaaatggagtgtcctgcactttttttcagcatcgctttgtgtaagaaggatcaggagacctggagtcaggggctcctccaatctcactctccttcataaaacagtgtcccttaagctttctgggggtgagggccttaacaccgtgctgttctgatgaatataattgtcccagctcccgaaacaaaagcacaggtgcacaaaataccgactgttgcaagcaatgccaaggtggggatgtttcctaggtgccaggtttagcactttgactttgtatgtacacacacaggggccaggcgttgtggtttatgcccgtaatctcagcactttgggaggctgaggcatgagaattgcttgaagccagaagttcaagaccagcatgggtaacaaagcaagacccagtctctacaaaaaaaaaaaaaagaaaagaaaagaaaaaaatacacacacacacacacacacacacacacacacacatactgggtgtggtggctccagtctgtagtcccagctactcgagaagctgaggtaggaggattgcctgaatccaggagttggagcctgcaatgagctgtgatcaggacactgctctagcttgaccatcagagtgagaccctgtctcaaaaacaaacaaacaaaacaaaacaaaatacatacacacacacagccagagccagcactgagggagaggctggcctcaggggtggggtcacaggcatttctcaggtccctctcagtggtctttgtctctttttcctggaggtggaggagtctgtacttcatgaggagaagtcctctgaagaaggcgggagatactcaggagcggggtccggagagggaaaaggatgaggaagtggagacaaagtggagggggcagggcaagaagggcacatgtgaggaatggggagggggaggaccttccagctgtcagaaaggtcccacgcagaatttggctcttggtttttctgctttatcaggatggatttgggaaaccagccggagcgggagataaggagtctactttgcaaaggacacgtgtgagtctcctcctaatttgaactcatgagtagcagctgacagccaggacccttgtgtggggcgcgtgacgcccctttgcaaccagggcgttttctgcaccccaccagccatccctcctgggaccacgctggtcctctccaaccctaacagggagagaaggaaggagaggtctggaggctttgggtcctccctcgtgctccttcttcctctgccatttattccctgagtgtccttgactttcctccgctacccggaccccactacagcaaagcacatcctgcacactggcctggactccctttgtaaccacccagtgtgttcaccttgctgactgcctagacaaagccgatttatcaaggcaggggaattacaatagagaaagagtaattcatgcagagccggccgtgcgggagaccagagttttattactcaaatcagtctccccgaaaactctgatcagtttttaaggataatttggtggatagggggggccagtgaatcaggagtgctgattggttggctccggtatgaaatcatagtgagtg

SEQ ID NO: 17872 - DNA, 13650 bp, Homo sapiens
gatgccatgatgatcatattaatgagggtaaaaattaggaccaacaggggatgtcccctctgcacatgtgtacaagtgtgtgcctttcacagacaatagaggctgaagtcagggaggcagcatgcacaggcaggcctggctcagacaggggccacgtcccagtcagacagtctcctgccacgcgttcccagcaaggatgtgaaaacagccctgccactcgctttccacccacacccctccatgccttgcctttctccctctttttcatgagggaggagagtgtgctcgccctcttctctcccaggatgacagtcaggcctggaaaacagaaggcaggaccaagggacaaatcagggtgccctcaggtctaatgccagccatgtcctgccatactgggtgcctgcggaacccacatacccctctccaggctgagaagatggccacctgacctcctttgggaggtcattcctttggggtggtcatgttttgggggaaaccagagagaacctgaagtgaggaaacagcttggggatgaaggtgctgtacagacaccgggccagtcccgccggctactcatgtttactatgcacagccagcacacccatgggcgaaagaccttcggtgccccctgctcctaagagctaagcactaaatagtgcatccgctgctgctccctgctaactctcccaatggaccctcacgctgccccactagggactgggatttgaagaggtaacctttaactccattgttgagtgaggaaataagggcaagggattttaccctaaaatagggaatatagactagttggccttgggatctaaagccaggagtcccgactcccagccagggctctccccatgagacatgggagagttggccaagctttctggggaagagcaccatctggggttcggttttcctagctagccaaggagaaggagccggccctgacaaactcagtgacattcacacagggcatcgtgggaacaaataaaagccacaaaccacaattcaacacaaagcaggctggatcctggcagctgcagactgatcagcccaatatgtcccgggggtggggcaggagaggactctgagatgcccgggaaggacatttgtcatgccagccagaccaaggctgccccgcagagtgagagcaacaaaggatgcagatccaggaccaggatcacaggcttagctcagctgcttctaaccaggagccttggacagatcacttggcctctctgactctcagtttttctacctatagagtggggataatgcatcttccttacaggaacaatagaagtgctttgtaaaccataaacagcacaggaaaatgaaggaatatcctagtcctcttgaggattagagggggagggaagaggagggaaggaagagaaaaaggtaggaaaggatccacaatgaggctgagattttgaaacccaacctgctggctttatagccaagcttttcatcatcactggaaactcaaacctgcagcaattatatgctgaggtcataaacgtgattaaaaaggttgtttgcaaagctgattccagggaaatgagctgcagatggcggtggcatcaatgtccttttgcagcaggcagcagctggctgtgtggactcagggacagctggaaggagttgtgctaatgcccacccccagctttggaaggcgggggcaagctgactgccctctctgtgcctggggacaggggagacttgcagagagctgaaaccctaagccataaaaccgccatttgttccagagagaaaagccagtttttcaattccagcccaaccaggagggcgggccaagctcagagaaagaagagtggactgagagcacgagtccttccacggcagcctgcctcgggcgggacaggctgcagtggctctggctgtccactgggagtgtccttggtgagggaggaaagaaggcaaagccacatctgaagtctctcggccagaagaaccctctgttctgaggccaacaggtagccctggtataaggagaaggtggaaaatacaggcaccagaaccttctctgctgcttatggcttcatagaatgttttgcaggtgacatttcacataagtgggcaccagcctgtctgtctttgatggaaagacatcaggaggcaggacccaggtctctgtcagtggcttcctgtcagagtggccaacacgggatacttaaaaatgtgaagaaggagacgtcgatcaggataatacaatgagcccttggcccaaatttgggaagggccctctcttttgatgtatctcactacctcagctgccatccctctcctggtcacttctacccatgcttcagccacagccccacttactccaggaagccctccctgatgagtcacctgcagcaacctcctgtcctgcagatcctcaccccgtactgctcactgccttggctgctgctcccaatcactcatatgcgtgcccatgtctgtctgacaactgggcgctccctaatggcagaagcacatccatatgacatttctcaaatgttccctatagtacagggaacccagagcacgtccaatgacgttgggatgtgagcctgcagagcttttcacaaatttgcagaacaagctgtgtccttcagcatcattacctgccctccccctccgactgaacctggagaagagtcaacagcctgctaccaaaaatcccccacagcccggactcggatgattcgcctacaaaggctggggagcacagtcccaggcttactaatctcctctctaccccatccccattttttccagtccccagaaagtcccaatcaatctctcagcaaattccacaggatctgtcagattcagatccagtcaactgcaggccgagtgctcttcgcatctcatcttatctactgcaggaagcaacctgagggcagcaaagaggaagacagctggtatgaacgggctctgaaacctaccagctgtgcggcccagagaaagctacctaacctctctgagcttcagctgcttcagctgtaaaatggcaagtataccgcctttctcaggtttactgttgaaatcatgtttgtaaagtgtttataaagtgtttagcactcttagaaagtactcaataatggtaattaacatgaaattatcataccaatctcttcaggtaggtattattgtcttctgtctaccaatgagggtgaaggtcagagacgttaagcaactggttcagagccacacagtatctgctcaggaggcagagctgggggttcagacagagcagcagagcgtgccctcagccctggggaagtttgcaacctcaagtcacagggacagagtagctgtgggaacttgggtcaggtacctccacccctccccaggttcagcagctccccaggaatcctggaacatgaggcatggcctcagcaagtctccatttgagagaatcagctgggatctcccagattaagtgttgttgcaggcagctgggccaaaccgcctgccctggaccctagagctcatcagattggcacctgctcttcccacacaggcaaacacggatggtgccactggccgaaccccgccatcagccttcacacagttgagctcaccaggaaagcagaatctctaaaactccagctgcagtgcaagcccagcccccagggacaccgctgtccacatctgaaatagctggcgatcatcacggggtgggagacaggatgcagtgggcaccttccacattgaaacccactcaattaaaaccccacgtgtgggggacagacacacacgtacccatcacacccagtcttacgtgtccactgagaccctggttacgttagacatggcctcaaaggaagtaggtactttcacaaacatcatctcctttgatcttctcaaccaccctgaggagtatgtacttttgccccactttacagatgaggaaactgagaagacatcaggcaatttttccaacatcacacaaaggataaggaaaatgttaggatgccaaccccatgtctccaggtttctttccactacagcatgctgttcatttgtgatctcgttcattcatccatccttccttccactcattccttcattcactcacctatatttttccctaaacagctacaggtcaccactgtctgggttgtttgctactaccttctgctgctgcctgagaaaacctgggagactgtgatcacattttttttcctgtagagctgcccgaatacagctcttctcaaagccttgcagcagagatgatacagccatcagcagctgatcctggaatgagtgttgagagcagcacagaccactctacgtttctgctctgaccacaggtctggcctagaatttgcccctccactgcacaatgcagctaaaaacctttaaaaaaataaataaatggtctctgagcctcccagaaatacagcacttagaatgttgtttttggagggggcatgtgataaagaatgggaaagataataaagtagcctgtcacccagctcacaggcaggtgcatgtggctgcaggggatcgtttagtcaatttaatgacatatttgttgagtatctattactgtgcctggtacgggatggagtgggtcagggaataggggagggcacaaagggagtcaaaaagaatagaaagaaagccgtcaaagggctgacggtctggttgagggaaaaagacaggaaccatctgcttagacaacacagatataaagtgtacttgagaaattcagaggatggtaaggtgcctgcaagtggggacacaaaaatttcattcagaccatggaatttcagctagacagggaaggatggccagaatttaaacctgggatggtatagaagaaaattacccaggccaggcgcagtggctcacgcctgtaatcccagcactttggcaggccaaggcgggcggttcacctgaggtcaggagttcaagaccagccccgtctctactaaaaatacaaaaaattagctagccgtggtggcgcacacctatagtcccaactcctcgagaggctgaggcaggagaatcacttgaacccaggaggcagaggttgcagtgagccgagcacgcaccactgcactccagcctgggtaacaagagtgaaactctatctcaaaaaaagaaaagaaattacccaaactgcctgctcaacaccattgctaatgaaaaagcctgccttggtctctccttccctgatcttagcttttctttctatctctgcaaagcctccgtatagaaatctggttttattgtgcctggtaagggtcctagttcagttctaaaacaattaacaaccatgaagggacaaaagtccgaagtgggcatctcgcttatggcacatcagcctctagtcatagtcaccctcagaccccatctagcggctgcccgaattatttcattcagggatctgtgtgtttggctgataaccaggcaccactggcccgtggggtgctatgactattgcagtgttaaaaacaaggcacttggctgggaagacgtctgccgttaagtggcaggctcatggacaacggcctcaaggtatttttccttcagacatttggtcccactttggcaagacatcttggcattgcttgggcaagatattacgctctgcttcttcagagcgttgggtgggagataccccatagacagctgaagggactgggaccttgggaaatcacatttaaaatttttggacttgtttaaaattgtttgacttggtttaaacacagttcaaagcccagctgaggcattaagggtttgtcacctaaggttgtcatctaaaatgggaaatgtgtgctctattcctccttgtggcccggtaggatgtattctgcagaattgggctgcttttagctttgagcttgtgaaaaagaaaaagttttttttattgcaatgcttcctggctataatattccctaggacctggggaatggtagccaggatttggatctttaacgtaaagccaagagctaaagaaaattttagttagttgttagtcatggtggacacatttattggacaggtgcaagcctttccctgccacactgagagggtttcaaaagccttactgaaagaaattttcctcagatttggggttccattccccatacacagtgataacgagagtgcctttattgccactttattgccacttttttttgagacagtgtcccactctgtcacccaggctggagtgcagtggtataatcacagctcacagcagcctcgaccttctgggctcacaggatcctcccacctcaacctcccaagtagctggggctacaggcacrcaccatgtctggctaattttttttttaataggaatgaagtctcactatgctgcctaggctggtctcaaactcctgggctcaagcaatgctccagcctcagccaccccaagcctgttgatttcaccataattaacccactgtctaatttctcattttctgactcaactacaaattactgcataacagaaaaatagcgccgggcgcagtggctcacgcctgtaatcccagcactttgggaggccaaggcaggcagatcacctgaggtccggagttcgagaccagactgaccaacatggagaaaccccatctctactaaaaatacaaaattagccgagcgtggtggcgcatgyctgtaatcccagctactcgggagcctgaggcagcagaatggcttgaacccgggaggcggaggttgctgtgagccgagatcgygccattgcactccagcctgggcaacaagagygaaactccatctcaaaaaaaaaaagagagagaaataccattacatgtcccttgcttctaggagctaccttgatcaagtttgccgaagaaggaatcatatgcctcccctttgtttagtttactatcagattgatgggaattctagatgcccttactcttattactgtsattccctaacagcctgttcaggaatgcctccaagctgtatcttggatcgagttaaattcagcaactccttactacaaagcaacactcggaaatagacctaccaggtccttggtttaatccaatccacgaagccctgctacaagattctaaacttaatctatacaatctttctgtgttcctctgtgcatcctcagaatatctatttgtttgtaggggataacaagaaaccctctggatgtatgaatgtattgacagctagcatataggaggaacttgcctgtaagratactcatttatcccagttttctgtacacaaaactgctgaaaccaagcactggaaaagctccctaaaattacttggtaaaactaaatggtccacaactcactttcgagatatacagattcatacttgcctggtaccaagaagacagagctgggtatttcttcagataaactttgttaccttggcggagaacggtgccccatgagcgcagaattagaaatctctccctttatgaattcttgtcaaggaaattgcaatcgcagcccagcagagaggaattaaygtattgggtcaggttgtcttagataataggatagccctagattacatcttagcggagcagggaggagtatgtatggttgcaaataccgcgtgctatatttacataaacgaatccgtggaggtagaaactcatctaggaaaagttagagagcaagccacttgggtacaacagcctcccagactgtctctgaggactggttttcttttctgttttcttggattcctcgtggaaaacagtctatgttttctgggtggctaaaactaggcatgtcagtcttgttaattgtgcttatgctttctattatgaccaaatgtgcattaaaatgttgtagtgaagctgtgactaaagcaactaatacaatgatagttcagcaccacggtgccatgcctgggactcgtgaatattgtgaactccatgctattatagaaactttctctcttcatatcctagtccccgatctttgccccaattcagcaggaagtagccagagtggtctgttcccctatacccctcaggattgtggagtgacaaggatggaactgagctgcaacaggggcccctttcttaggagcctgaagaccccaagcatgaaaataaagaaaaaccctaagttccttcaagagaaattccaggcacctcactatccccagaagtaaataagaaggtaatagtagcctaaaacaagagccaaggacgtttgagttccagagatgtttgctttccctgtaggaactaaagacaacagctgaacatacgtccttgagttgtctttcagaaacccccactgaggaaccacaccgaacagatccactggcatttagacctcagataagggggaaactgaagataaaacttcttcctgatggggcttagagaaagtcacaccccatcccagccagttaacatttttctgcagatcccaaatttttaaacaaagcttctcttctttaaccagttgcaaatccgaaaatcttcgaatctacctatgacctgtaagcccccctcaagatatcctccccttttaggcctaagtcaatgtgtaatctccatgtattgatttacgattttgcctgtagcttctgctttcctgaaatttactcctgcctttaaaaacccttgcctgcaaaccattgggaaggtcaggatttgagcatttaactgcttggtcctctttgcttggtgccctgcaaatgaacacttttctgtcactgcaaaacctcagggtagatgtctggttttactgcaccaggcaagcagaccccagttcactataacagaaggcggtgaggaagaacttaggtttttattccgagtttagcgggaagcagaggctattaagctgagttacgacatagtctcaccattttagtccaagtcttagtcctagcaaaacactttggctgctgtgtggaataacgcttataagaaaacaagcatgaagccgaaagggaagtaagggcctgggcgcggtggttcatgcctataatcccagcactttgagaagccaaggtgggaggattgcttgagctcaggagttcaagaccagcctaggcaacatggcgggaccccgtctctacaaaaaatttaaaagttagctacacatggtgctgcatgcctgtggtcccagatactcaggaggctgaggtgggaggattgcttgagcccagaaggttgaagttgcattaagccatattcacgccactgcgctcccgcctgggcaatagagcaaaagcttgtctcaaaaaaaaatttgtttaaagacaagtaagggaaatcttccagtattctaggtgagaggtgatactctagactaggttgaaagcactggtaataaagaatagtggatggaccggggatatattttgggagtagggccagaagaatttgctgaatgcctggatggggaaaacaagcaccagggagagctcatgagtgtctagctagagctacggaagaagatgggagaggggcaaggcaaagggtcgaaatcaagagttctctttggttcaggtaaatccaagatgaaattagatgtctggacaacatgccgaaaagaagaaaaaaaagaaaagagaaattagatattgaggtggaaatgccaagtgggcagatggatacacccatcctgagttctgaggagaagtctgccctagaggctatggacaaatctacgcaaagatgacacttagcatccaagaattgcagaagattagccacggagggagtgcaggtgggaaagacgacccaggcctgagcccagatggaggggcctggcagaagcagaggagcagttgccaccagggcagctctgcagaaccatctgaacttgacaaaaccccagaggcagcagtagggagccacagatatgactgggattaagcttcatacctgggctgaatgaaggcttagagtcagaaatgttccctgttacagaaaaattttaaacttgtacttcttggccaggtgtggtggctcaggcctatgattccaacattttgagaggccaaagtaggagaattgcctgagcccagaagttcaagaccagcctaggcaacatagggagaccctgactctacaaaaaatttaaaaattagctgggtgtggtggtgcacacctgtggtcccagctgctcaggaggctgaggtgggaggatcacctgagcccagaaggtcaaggctgcattaagatgtgatcattccactgcactcgagcctgggcaacagagcaaggccctgtttaaaaataataataaatttttaaaaaatatatgtgttttgagacagagtctcactctgtcgcccaagctggagtgcagtgacacgatctctgctcacggcaacctccacctcccaggttcaagcctttctcctgcctcagccccccaagtagctgggcccacaggcacctgccaccacacccagctgatttctgtatttttagtagagatggggtttcaccatgttggccaggctggtctcgaactcctgacctcaggtgatccacccgcctcagcttcccaaagtgctgggattacaggtgtaagccaccgcgcctggcctaaaataaaaactttaagttgtacttcttgcatacctgagtctgaggaatgagatttatatccactactcataaaaataattacataaaattttatatatacataattaactaggttatgtatatgtctttatatgagtgtcacaaaataatcagtgccctgaaggcaaagaaagaactaggaaggagaatgggaaggggctcagtcaagatacagccttcaggggaggcatctcttaagaagtcttcatagcatttctcctttccaatcagacctctgcggcaaacatcctccaccagatcctcggccaggccaagaagcttccaagcttgatcctcctcttaatatttattggagctggaggtcctggagcagcactgtatgtcttgcatctggcactgttcgatcagatgttagtaggggcagaaagaataacccaaaaaccctgagacaaactgggtgccaatgatcagtacaagttcaactcggtgaatgtggattacagcaaactgaagcaagaaggcccagatttctaaatgaaatgtttcactctaaagctgcttagaatgaagctcttccaggagccatccgcacaatttcccacttaaccaggaaacatttctcctctaaaatacatgaaatcatcttgacgtattattttggagattacactaattaatacatatccgagactcgaaaaaaactaaaaaagaaggtttcataaacagaagacaattcaagggagttcctgtgatcctaaagggaggaaggatttttgccaaagggtgagagaacagagagatgaaagctatggaaaggacaacagcgcaatttaaagcttgagaaaccaaaggtaaatgagaatggcaaccacaacaaaaactaaacctgagattgaaggggaactgagtcttcagaggaaagaaagcaaaggaaacatcgtttgaaaggttaaggatataggtagcttgcaactattctcaactgggcttcctcatccgaacagggttccttattcctcatctgacccagagtacatgacataattcgagtgattatttcttaattcccataagaatggcaaattggccgggcacagtggctcacatttgtaatcccatcactttgggaggctgaggtgggcagatcgcttgaggccaggagtttgaaaccagcctggccaacatggcaaaaccctgtctctactaaaaatacaaaaattagccaggtgtggtggtaggcgcctgtaatcccagctacccgggaggctgaagcaagagaatcccttgaacccaggaggcggaggctgcagtgagatgagattgtgccgctgcactccaacctgggtgacagaacaagaccctgtctcaaaaaaaaaaaaaaaaaaaaaaaaggcaaatctagaatccagaaggatggcactgatctagatgcatggagggtgaagttgatcaattccatgcaatagatgacatcgggcactggggcttagaatccagattttaaaaggcctgctgttaagatgtctgtttgataaaaaatcataataccagaaaaccagaatcagcaactaaaatttaaaataaaaatagagatctcacccaggggacttttaagcttcactgaggcaatgtggtatgattctggagtggagtgaaagccttttctgacccagatatcctgtcattagtgttcacagccaacacggtctcagttgtgcctacctggcttgcagcattgggctctgccccccggcctctgttatttcgggaccctatcatccccattgctggcagcaagcccagcgctgtaacagcatctcctgccatcagcctgccctttggaatgctgggcggcaactccagggcttctctgtgatgctggtgccctcctcaccaggccatgacttagcacgccggtaaacggagtatgctctgggccctcctagggaacactgtggggggtggattttctggcctctatagtctaaccagtttggcatgcccactgctctggacatcctgattccttccttcaccatttgctgtggcagttcttccaattctacctcacttaacgtgggtcaatacttttccaggcctctaagaggcaacctcttagaggttgtgatgtagtagtatgttggcgccatctcccggggtcctcgtcagggtgtaaattccgtaccgtaaaagaaagttctcccttttccaatttgtattttgtttcctttggttcagcaccctcaagatccagtcccgtacatattcccccagttcctgatggttcacattgaccaggcctacaactacttttttttcttagcaggtttgttttcttagcgggcccagcacttctgtggctgggttatgttctaacttgcccttagcttcgggtctgatggccaagagaggaggcagagctgaatcctgagcagagcacgagttttcttgcaagacacgatcctccacatgatcttcaaataagccggaggctctagcctctaacagagaggagtggatcacttctgcaggccctcttccccacttattaccggcagccttgcactcacaggaatgcctttcttcacaggcttccattccaaagatcttattatcgaaaccgcaaatatgtcgcataccaacgtctgagcccttttaattactgtcattgcctcctccctgacagctgtctacagcacccgaattattttctttgcactgttaggacaacctcacttcacggctgtaattgtcatcaacaaaaacaaccccttcctaatcaattcaatcaaatgcctaacaattggtagtatttttgctggatttttaatctccaacaatattattccaatatcagttccccaaatgactatgctccttcacctaaaactcacaaccctcagcgtaactattttaggcttctcactagcaatagaacttaaccttgtaactaacaacctcaaactcaagcacccatcacaaatatttaatttctccaatatattaggattttacccaatcacaatacaccacacaacaccacactcaaatttccatgcaagacaaaacctaacctctcttctactagaact

SEQ ID NO: 17873 - DNA, 16006 bp, Homo sapiens
ggtgggctcgttcgtgttagacgcggtggactcgttcgtgttgtgttagacacggtggactcgttcgtgttagacgcggtggactcgttcgtgttgtgttagacacggtggactcgttcgtgttagacacggtggactcgttcgtgttagacacggtgggttcgttcgtgttagacacggtgggttcgttcgtgttagacgcggtggactccttcgtgttgtgttagacacggtggactcgttcgtgttgtgttagacacggtggactcgttcgtgttgtgttagacacggtggactcgtttgtgttgtgttagacacggtgggctcgttcgtgttagacgcggtgggctcgttcgtgttagacgcggtgggcttgttcgtgttgtgttagacacggctcgttcgtgttgtgttagacacggtggactcgtttgtgttgtgttagacacggtgggctcgttcgtgttagacattgcccattgacttcctcagtggatgtgaggaatgggacctgagacattgctgttccttcgtttcctcccttcagtctcccaatattaaataatatccaagtacattacaatagtatgcaattgtgtagacaagtattgtaaatactattgcatattgtatattattgtattttattgtctatgtaatatatgcgataaaaccccacactaatgggatgcattgggctccaaggatggagcaggatggagcctcagcgtgtaagtcaggacgtctcagcatgtgctggccatgggtttcccggtatttacaacatttggttgaatcagtattccatgattacatgataggatgtaatatatataataatcgtttcaaatagcctgaaggaggatggggaaagttcccaacacagaaaggatgcatgtttgagaagatgggtgtgctacttaccctgatctgattactatatgtatatacacatatagtacatatatgtaaacctacatctatacatacatgtgtatgtacatatacgtgtgtacatacacatatgtgtatatgtatgtatacgtatatatgtatgcatgtgtgtgtgtgtatatatatacatatgtatacaaatacatgtgcataagcgatcccctcctggaattgcttgagcccaggaggtcaagtctgctgtgaggtaagattgcaccactggccgggcacggtggctcatgcctataatcccagcactttgggaggccagggtgggcggatcacaaggtcaggagttcaagaccagcctggtcaacatggtgaaacaccatctctactaaaaataccagaaattagctgggcatggtggcacgtgcctgtaatcctagctactggggaggctgagtcaggagaatcacttgaacccgggaggcggaggttgcagtgagccaagatcacgccactacactccagcctgggcaacagagcaagactccatctcgaggaaaaaaaaaaatgatattgccccattgcactccagactgacaacagagcaagaccctgtctcagaaaacgaagaggaggaggaaaaaaaaagtactaattatctgaaattccaatttaaccaggcatccagtgttttatctggtaaccctcattcttacacacacacacacacacacacacacacacacaaaggcgggatagttgtcattcccactgtaaacataaggaaactgggcagaggccaagcaaccttgtgtagctcacatagcaagaagtgggtgaacccagctcatgtcttgactctgagctcagagagtgacaacttgtcaccagcgcccccatagccaccaccctttgtccaccccaggctccctctgcaccccaacccaagctccggccgcttctctgtccccctcctcctgccgcatcacagcccacctcagcctctttgtaggtttccatgcgacgctgtaccatggctgggagtcttccaggcgccgtgctgagcgccttctgtgcatggactccaagtcgccataatcgtacgggttacccaccattatcagtcccctcttatacatcaggctagtgagacagtatcttatccacagtcctacagctggcaggagtagattcaaaccctagcagcaccaattagtggtaaagagtgtggacttgggaacttacaggagtagagagcacagtggtggttaccggggcggtggggtaaggtttggggagatgttggtcagaggaggacagtttcagttggacaagaggagtatgtcttggagatctactgcacatcatggtgactgtagttaataacaacatattgtacacttgcatatcaccgatagtagattttaaatgttctcaccggccgggcgcgctggctcacacctgtaatcccattttgggaggccaaggtgggcggatcacctgaagtcaggagttcgagagcagcctgaccaacatggtgaaaccctgtctctactaaaaatacaaaaattagcggggcgtagtggcaggagcctgtaatcccagctacttgggaggctgaggcaggagaatcgcttgaacctgggaggtggaggttgcagtgagccaacgtcatgccactgcgctccagtctgggcaacagagtgagactccatgtcaaaaaataaaaataaataaaaataaatgagcgtggaatactactcagccattaaaaggagtgaaataatgtcttttggccaggcacagtggctcacatctgtaatgccagcactctgggaggccgaggtgggtggatcacgaggtcaagagatcaagaccatcctgcccaacatggtgaaaccccatctctactaaaaatacaaaaattagccgggcatggtggcgggtgcctgtagtcccagctactcgggaggctgaggcaggagaatcacttaaacccgggaggtggagtttgcagtaagccgagatcacaccactgcactccagccttggtgagagagcgagattccgtctttaaaaaaaaaaaaaaaaagtcttttgcagcaacttggatggagctggaaggcattattctaagtaaagtaatacaggagtggaaaacaaaaatctgtatattctcacttataagtgagagctaagctgtgggtatgcaaaggcatgcagagtgatgtaatggacttcagagactcagaagggaagggcagaagtggggcagggatgaaaaactacacattaggtacaaggtacactagtcaggtgacaggtgcactaaaatctcagaattcaccagaatataattcatccatgtaaccaagaaccacttgtatcccaaaagctactgaagcaacaagccagatgcagtaacctgtacaggccacacctgtaaccccaacactttgggaggccgaggtgggtggatcgcttgagcccaggagttcaagaccagcctgggcaacatagcggacccccgtaactaaaaaaattacaaaaacaagccaggcatgatggtgtacaactgtagttccagatactcaggaggctgatggggaggcactggttgagcctgggaggttgaggctgcagtgagccatgatcatgccactgccctccagcctgggtgacagaagtgaggccctatctcaaataaaattaaataaataaaagttaaaacaggctgggtgcggtggctcacgcctgtaatcccagcactttgggaggccgaggcgggtggaacctgaagtaaggagcttgagaccagcctggccaacatggtgaaaccccgcccctactaaaaatacaataattagccagacctggtggcagatgcctgtaatcccaactactcgggaggctgaggcaggagaatcacttggacccgggaggcagagtttgcagtgagctgagatcatgccattgcattccagcctgagcgaccgactgagcgagactccatctcaaaaaacaaacaaaaagaaaaaaagaatacatccatggatggataatgaatgagaggttgtttatattcacagttaaccctctcatctccagtaatgcaaccatcttcttcctgcttagccttttggagatgctgtccctttagtggtcaaattctgaagaaatcaggaaataattcattcgacatgcccagcacaagtgaagatcaggcagcagaaatgcattcgacctgccacccatccatcaggagactatttactccactactgtaggggatactgacaaattaaatccatacctagtccagatatcaattccacaattttttttttttttttgagacggagtttcgctcttgttgcccaggccagagtgcaatggtgtgatcttggctcaccgcaacctccacctcccaggttcaagcgattctcctgccttagcctccagagtagctgggattacaggcatgtgccaccacacccggctaattttgtatttttagtagagatggggtttctccatgttggtcaggctggtctcaaactcccgacctcagatggcccacccgcctcggcctcccaaagtgtgtaagccatggcactcagcctttttttttttttttttttttttttttgagatggaggctctctctgttgcccaggctggagtgcaatgcctgacctcagctcactgcaacttctgcctcccagtttcaagcaattctcccacctcagcctcccacgtagctgggattacaagcacccgccatcacgcccggctaatttttgtagagatggggtttcaccatgttgaccaggctggtcttgaactcctgacctcaggtgatccacccacctcggcctcccaaggttgagattacaggcgtgagccactgtgcctggcccacattttttaaaaaaggggcaactgcagtgtagtagaacaaagttgtgaccaatgctaggatactctgttcatttcctgacccagccatgaatacactggaataactcatgcaaaatgccagctcgctggccccccgtttccccacccaacaaatgaaggggctcttacaggttcctttttgtcctgaaattcatcaccaatgcaaatttcttaaaaatcctttgtctggcagtccatgcctgtccttcagcatttcccagatctgaccctcaggactcaccaagacagaagagggcggtcggggatggagacatggttcctcagccctgtcctgagctctgtggccagggagggaagtggtgggagcctggggcacaggctcaggatgtgatgaggatgaagaatgctctcctcccttcctccaccagccccggcctttcctaattgagactcatcgagccgtagccggctcctcagtacagtgacttgcacacaagctccaaggagccgcgcttatctcctctggccagcctggcgttgcaccgtttgtccgcctgctggggcctggtctgtgttcccgtgctcccataaactccctgatgtcactaggaaaatacgcatcaaaaccacagtgagatatgacttcacaccttctggaatggctgtattttttttttttcttttgagacaaagtctcgttctttttgcccaggttggagtgcagtggcgccatctcggcccactacaacctccacctcccaggttcaagcgattctcctgcctcagcctcccaagtggctgggattataggtatgtaccacaccaggctaatttttgtatttttagtagagatggggtttcactgtgttggccaggctggtcttgaactcctgacctcagttgatccacctgcctcggtctcccaaagtgctgggattacaggcatgagccactgcacccgaccggctataattttttttaatggaaaatagcagatattggtgagtatgcagagaaattggactgcgcgtgcattgctggcagggacgtaacatggcgcccctgctgtggaaaacagttccagcagctcctccagaagttaaacgtgggattgccataaaatccagcaattccacttcggggtacacacctaaaagaactgaaaacagggtctctaacatatttgtacacagtgttcatagcagctttattcacaatagccaaaaggtgaaaccacccacatgtccatcaacaacaatggataaacaacatgtggtatatacacacaaggtaatatcaaccagccttaactaaaagaataaaaatcagccaggcacagtggctcacgcctgtaatcccagcactttgggaggccgaggcgggcggatcacctgaggtcaggagtccgagaccagcctggttaacatggtgaaaccccatctctactaaaaatacaaaaattagctgggcgttaaattagccgggcatggtggcaggtgcctgtaatcccagctacttgggagacggaggcatgagaatcgcttgaacctgggaggcagagattgcggtaagccgagatcgcaccactgcactccagcctgggcggcagagtgagactgtctcaaaaataaaaataaggccgggcgtggtggcccatgcctgtaatcctagtactttaggaggctgaggcaggcagattgcctgagctcagsagttcaagaccagcctgggcaacacagtaaaacccccaaaaaatacaaaaaaaaaatagccgggcatggcggcasgcacctgtagtcccagctactccggaggctgagacaggagaatggcttgaacccgggacgcggaagttgcggtgagccgagatcrcgccaytgcactccagcctgggtgacagagcgagattctgtctccaaaaaataaaaaatattataaaagaataaattcagatacatgctacaacgtgatggaccttgaagacattatgctaaaggaaatattccggacttgacagataaatactgcattgtgccgcttatctgaggtatcgagaggagtcaaattcatagagacagggattagaatggtggttgccaaggcctgggaaaagtggggagttactatttaatagggagcgcttaggttgaagatgatgacaaagtctgggggatccatagtggtgatggttacacaacactgtaaatgtatttatatttaatgccattgactgttttttgttttttggttttttgagacrgagtctcactctgtcgmcgaggctggagtgcagtggcgcgatcttggctcaccgcaacctccgcctcccrggttcaagcgattctcctgcctyagcctcctgagtagctggractacaggtgcsygccaccaygcctagttgattttttgtatttttagtagagacggggtttcaccgtgttagccaggatggtctcgatctcctgaccttgtgatttggcctcccaaagtgctgggaatacaggcrtgasccaccgckcccggccagtgccgttgacttgtatgtgcacttacaggtggttaaaatgagamctatcagggtgttgatatctaaaaacctccctgccatcatcttccctacatctctcattcagtgaccatggttgaatgcctgccacctttcaaatattatgtcaggcactcagtattggcagttttatccattataaatgctttaagctgcatagaattttaaacgtgttaataaaagtagttataaatctttaatacataagctggctttaaaattattggtaaaataagattagaaatgtcttaagaattgttggcgtttttgtttgcacttattgaacragtggtttcatgcttatccctgcagaatactatgagatttgtcataagggttataaaactataaacccggctaggcgtggtggctcacgcctgtaatcccaacactctgggaggccgaggcaggcagatcacctgaggtcgggagtttgagaccagcctgaccaacatggagaaacgccatctctactaaaaatacaaaattagctgggtgtggtggcgcatgcctgtaatcccagatactcaggaggctgaggcaggagaatcgcttgaacccgggaggcagaagttgcaatgagccgagattgcgccactgcactccagcctgggcaacaagagtgaaactccatctaaaataaataaaaataaaacatttgttttttgtagagttggggtttcactatgttgcccaggctggtcttgaactcctcctgggctcaagcaatccaccgacctcagcctcccaaagtgctgggattacaagtgtgagccactgtgcctggccctattgggtccttttaaaagatacataaaaaatcaaatgcaacagtgaagtcaatcacccgatggcagaaattggggtgctcctggcatgtggtcggtcgaagccaaggacactgctcagcattctgcagtgcacaggacggccccgcccaggcggagaatgatccggtgacacatrtaggtgggaaggatgcacgaatgatggcgtttaggaagaatattatcacttctttcccgtaagagcaacttagagcaagaaaatggwattcttagggccttctctcttatggaggctccaagccagggttgccatggcagaagatgctgggcttgctttttccttgagagaactgtactcaagatgatgtaamtgtcaccccgggtgccacttgggtgctttggagaagcgctcagacgcgacacgccgtgacgactccgcggcaggcagccggacctgtcctctggcgtgcggttcacgggctgtgtttatccccctggttccttcacagccaccttgggaaatacgttgcctctgaatcacgccaggcaggvtctcastgtgtgtgctgcggggctggaaatcagggtgacactccgctaccgaacagcctgactaggaagccagaaagacgctgccggctttagtttgtcctttgactttccttgatatgaatgaagatagagcacttccacactgcacaacaggaaaagcccagaacgcttcctggagatagcgagggggtgatgcagcggacagctatggctgatgaccccctcacctctgactccccctccctccctgctttctgaacgcacatccatcaccaaccataggttcctgtttggggtttgctggctggaaaaaaaaaaaaaaaaaaaggaaagctggctttctagtaaaaaccacttcctttgctcatttatcaaactcaaaygctaggagggccacctaacatcctccgtcccacgcaatggggtgtttctggagcactccggtktatcagggaccctgtcagttgccatcgcacatgtatatggggccagcccctgtgccaccgaagaggggggatattgaaaacatgttacagccaggagcggtgcccccttggttcaagcagttcttctgcctcagcctccctaatagctgggattacaggcgtgcaccatcacgcctggccactgttatgtagtttttaccacaatttaaaaaaggaaagagtgcctgggtgagtcctacgcacctatwcggagaaccaaaggctttgaggttatcctcggcccacccatctgatgggagtgtttctcaaacttgcttttccgtgatctcccagtaagaaatacctactacacacacacagtctccggtcggcatgcttagggtagtcttccaattccccctcctggtatttacaccctggagtggtccrctcctcttgggctgaacctgtaacttgctcccaagcaagagcacacagcaagctcacgcacrtggttgttggtgtgattctgtttctccagattgtctccattcctccctggcttctccacagggccgctcaccatggcagccggctccatcaccrccagccagcgagagggcaagacaagagggctgacgagggacgctaccatcacagaggtcagttttgtaacctaaccacaagactaacctactgtcacttctgccctatcctactgctagaagccagtcgctacatctcccccacactcaaagggaggtggtcgcacygtggggtccactggaagttgcctaccagactcaggtcatcccaaacacaccctctagccatttggtgtggcatcggaaagaaaactaaggccaggtacggtggctcatgcctgtaatcccaacaatttgggaggccatggcggaagggtcmcttgagcccaggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgayggcactgcactccagccttggcaacacagtaagacctcgtctctaaaaaagcaaaaagggctgggtgcactggctcacacctataatcccagcactttgggaggccaagacgggtggatcacctgaggtcaggagttcaagataagcctggccaacatggtgataccctgtctttaattagccaggtgtggtggtgggcgcctgtaatcccagctactcgggaggctgaggcatgagaatcgcttgaacatgggagacacaggttgcagtgagctgagatcatgccattgcactccagcctgggcaacagagcgagactaggtggctgttctgtgtactgtgggatattgagtagcatccctggcctccccagtatctcaaatatgaaaacatgttttctatctcgattactgagcttttcggtgcctccttcggttctgcacctaagctaagagccccttcatctcaccctgatctctatccagtttctaacacagcagtcttgtaagatgcccggacttaaacggttatttcctgtgaaacaggtgaaaggggctttcatctctaaaaagtcggaactttttttttttttttgagacggaatcttgctctgtcacccaggctggagggcagtggcatgatctcggctcactgcaagctccgcctcccgggttcacaccattctcctgcctcagcctcccgagtagctgggactacaggcgcccaccaccatgcccagctaattttttgtatttttttagtagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtacattttcttcttttttttttcttttaaatgagcaagtttgagagtctgcagtttggactaccatgagaattgataggaaggtgggagtcccaggcaatcccaggtcctgtagcagcagctggtggggttcccactccatgccgtgcagagcctgaactcaggatgacacctgcacctgctctctggctgggctctggcacaggaagccctcagcaaacacccccggcacagccatgccatagccagacaacagctcgctgtaccacaccatcatgggagacagcagttattctgagcatctcactgctgaagaaaccaaggctcagagaggaccatgcatgcacaaggtcccacagggacccaagaatccaccaagtgtcagacaacttgcccatgctcttcacggagcaccttggaaccctccccgacaggcaccgctggctctcctgacgtggcctgcaagtgcacggagccccttcctcctcggccattcccagtttagattcccaggggaagcatcagatggcccctctcccctgctggcagcagagcagacggaaccagccagagcccagggcagtgctcacctgcaggccagtccactgcggccagcaccgccccctagaacctactgcgggcatggcggccgccagtcctgggtctcccggctcaggtagtgccaggaagctgcgggcatggcggacagctgtcctcggtctggaggcgccatcctggctttcaaatctgctccagaggttatctggggaggggctgctccctcacagagggagcctctaagcccaccaggcgggcactttcagcccaaagcctccgggccacctcctcatcctcagcctcgggggccggggccttctgtttgagtccatcgaagtactttccggaaacatccgccagttcctccgccacggccaggtatgtgctgggctgggcggccagctcggggctcttgaccagcagccagaagatgggccctgcaatcagcccacagggcatttagtccacactcgctcagagagaaggaaggaagccccgctccccggtcagggagctccgggtccctggagtcccacagagccctcctctagccctttccccttggctgcctccatctgcagttcccttccctggcactgcccaggcaaatcccaccagaccagggatcagaccaaaagctgcctcccccaaggagccttcctggctttgtccaggaaaatggaagctctcttcctcttggtcagccccagtcctcaccctaccccatttctcctttaataacatcttattaaatgcacctggcaccagcctcaggttaaggatttttttttggccaggcgaggtggctcaggcctgtaatcccagcactttgggaggccgaggcgggcggattacctggggtcgggagttccagaccagcctggccaacatggtgaaaccccatttctactaaaaatacaaaaattaactgggtgtggtggcgggtgcctgtaatcccagctgctcgggaggctggggcaggagaatcccttgaacctgggaggcggaggttgcagtgagctaagatcacaccattgcactccagcctgggtgacaatagcaagacttcgtctcaaaaaaaaaaaaaaaaagggctgggcgtggtgactcacgcctgtaatcccagcactttgggaggctgaggcaggtggatcacctgaggtcaggagttcaagaccagcctggccaacgtgtgaaaccctgtctcaactaaaaataaaaacttagctgggtgtggtggtgggcgcctgcaatctcagctactttgggaggctgagacaggagaatcacttgaaccgaggaggcagaggttggagtgagccaagattgtgccactgcactccagcctgggtgacgagcaaaactccgtctcaaaaaaaaaaagacatttatttatttatttattgagacctggtgtcttgctctgtcacccaggctggagtgcagtggtgtgatctcagctcactgcaacctctgcctcccgggttcaagcgattctcctgcctcagcctcctgagtagctgggactacaggtgcacaccaccacacctggctaatttttgtatttttagtagagacggggtttcaccatggtggccaggctggtctcgaactcctgacctgaggtaatccgcccaccacagcctcccaaagtgctgggattacaggcgtggctattagcctcgccaagttaagattcttgatgccaaccaatcacccactccatgtttttcaggattataaacactagtcataaagcatgaactgcctgggggtggtggctcacacctgtaatcccagcactttgggaggcagttggatcacctgaggtcaggagtttgagactagcctgaccaatatggtgaaaccccacctctagctgggtgtggtggtgtgcacctgtaatcccagctacttggagacaggagaatcgcttgaacctgggaggtggaagttgcagtgagtggagatcatgccattgtactccagcccgggcgacagagcaagacttcatctcaaaaataagtaagtaaagctccaactgtttgttccacctattctctgggcggggtcctgtgctggccctttcaaggaaggtctcgtataacccccccagtgactgtgaggtgagtcctattaaggcctgcactctgcagatgaagaaacaggctcagaggggtaacagctcttccccaggaggtgcagctggtttggggtgaagctggagttaccctgagtacagcctgactccaggcgtcagctccacggcctcttcctctgagacacggttttctcatccgccagcagggctctgcctgcttcccggggctgttagaggctggcaggccaggtcaacggaggaaagggacctgtgctctgtgcctcagaagacgtaggcgaggagcaggcatgaggcctcagggacggtctctgagggagggtcctgggccctgggctgagaaagcaggggtggagggctccacgtggagaccccaggctgggaggggactcaccgagtgtggtgctggagaaggtggagccatggatgcccgtgtgtctgcccagctctgtcctggccacgccggggtgcagggcgttgacagtcacaccagagcctggggaagaaagaaagagaagactgagggaggggtccagcctcacctgggaggctgtggcagcccacacccagctgtggggcttccgggcaccaggctgcttcctgcactcaaaccccatcgtccctcttgctctggaatcttagtgaagtggtcttatcttgcggagcggctctgccacatggctgctgggagccgagctttcctggagggcttcataaacccagaacgctgagcttaccccgggagcctgcatcggtgcgtggcggtgggacctaagatactgtaactctgaccagctcccagtggggctggcaccgctggtccacagaccgtctttcagaagcaaaggcctagcacagatttctcaatctcagcactgtggatgctgtgggttgggaggagtgaggggccatcccgtgcgctgtaggacattgagagcatctgggcctttaccctccagatgcccagagcaatctctccccaagccagctgtgatcactgtgtttccaggcattgacaactgcgggtcaaaactgcccctggttgagactcactggctggagccaaaaggctgagctgcctgcccaacagcagcagggaaggacatctgatccaggcagactagaccacctgggatgaacagacaatcctcagaagaacgatcgattagtgatgtctgcttcaggcaccagaagcgggcagcgtggtccacatgctctacttttgctgactctgttctggatccaccgtttggcctcccatcagcctaggatcatggaaaggccgctctaggctcagagtaaagcaagagggaggccgagcctagcgcccccgtaccttgcagccgccggctcagctccttggtgaagaggacgatggcgagcttgctctggcagtaggcggctttggtgttatacttcctcgtctgccagttcaagtcgtcaaagtctatgtgcccagcaacatgggccagggacgagaggttgatgatccgcgaaggggctgaggctttcagcttgtccagcagcaagtttgtcaagagaaagtgacctggattaaggatgatgaaaaggtcacttttgactcacacctaaaatcccagcactttgggaggacgacgggggaggatcgcttgaacccatggtgcagcccctgcccaggcctcacccaggtggttaacgccaaactgcatctcgaagccgtcctcggtggtccagtgggggcaccgcatcacacccgcgttgttgattagaatgtccactcgctcctcctctggaagagaggggtggaggaggagacatcccggtgaggacagaccccagcctgatgcaccagcagaaacactcctgtgctcccacaacctgtgaatgtggcctgtgccggaaacagggtctgtgccgaagtggccatgtcaggatgcggtcattagggtgagccctaatccaatgactggtgtccttataggaagggaaaacagagacagagacacatggggagaaggccatgtgtggacagaggcaaagaccggagaggcacagctccaaggtgagggtgggccgcccccgctggaagtggaagaggctgggaggattatggcccgtctcacaggtcacag

SEQ ID NO: 17874 - DNA, 15065 bp, Homo sapiens
gttccacctttgtgaaggagaggtctttacttctaactgctcttgaagcccagtgaaggggtctccagagggtaacttgtacaaactggaagtacctgcaaacaaggcaactcattttccagttggatgtcagcttacatggtgaacctcatgatttgcctgagccaaaatgagcaggggagaagaaaacaggagataggaaccaaagcagggaaaaggattgctggaggctgctctcccaccacatggaatgagctttccattggccgagtgatcctgtggaagggagctgggctcgagccatcctcccagtgacactccgcaaaggttgggggaatcacatgtcccattttgtctgggaaatgacccagtttatgccagttgtgccagcatagttattaatagtaacccctttgagtcttaaagtgctcatcctaccaataggagatccactgcttagcttacaaggatcttaacagcagtagctgatggggtggtctcagggccgctgtctacaaaggcccctggatgtgtgggcaagagggtgctgaaagccagtctgcccatcacctgtaaggtcttgcactcacacagggctaggtgtgctccatggtgcttttttgtaacatgctcaatggtgtcttccaggctagcaaaggcccagggtatgctgccagtggtgtgagcagaagagagaggtgaaagatgttgggcaagggtgggatctctcacctaagaaactatgcagagagaggaccctcaggaatgcccatctatccgagggaaatatacatgcattgcccataacttcaatatttttttaaaagatgcagggataacctagcagtgggggcagggactacatctgtaggcagttaaaagaattctttcccctctctcttttaaacatttaaattaaaaaaaattcttttagagacagggtcttgctctgtcacccaggctggagtacagtggtgtgatcacagctcactgcagactagaacttctgggctcaagcgatcctcctgcctcagcctcctgagtagctaggactatagctgcacactacaatgcctgctaattaaattttttttttttttgtagagacaggatctcactgtgttgcccaggctggtcgccaactcctggcctcaagtgttcctctggccctggcctcccaaagcactgggattacaggtacaaaccaccacaaccagcaaaattttctctttatattaccccacacagacaacccctctttccaacatgccagaggagttaaaaagagaaggagagagggtatctcagaaccaaactaaagcttcatcacactccaactaccagagcctgttttgctctggtgaagggcgaggagaaaggaagaagtagaaatgttagttaagtcaaatttaagattagggttctaaactgaaggaattttaataactggatgtgaccaaaacgtgataggatctccccaagatgttaaggtggagctgatgattggagaacagttaagcattttatgtttatagtctatatataagtaaggatagaataggttgtacctagataacaaacaaactcccagtggtctaacaaggtaaaagttttccactcatacaaaatctgatgtgggctagatcactggatctcacaatttagttgcatcagaatccactggtgggcttgtctaaacacagattcctgggttccacctgagactctgattctacaggtcttggtaagactcaagattctgcctttctaatgaggtttcaggtgatcctgatgctgctgacccatgaactacactctgagcagtattgatcctagagcagctctcctccaggtggtgactcaggaattcaggctgcttccatcctgtagctgtagattctggaatgagaaagaagacagaaaaggcatactgcttttaactgtcttggtccagaagtgacatgcttcacttaatcttacaattcattggccaaaattagccacaagagcccaatgcaaatgccatgaaggggaacatgtggactatttagtgaaccctactttgtctgccacttactcttaaaaaagaggttaaccaaggaaagagacctagccaatgtgaacttgcagtctattagaatcttttgcttttcctttcccccgattataataggctgtcagtttagtattcatctaatatacgaaggatttatgcaatattcatgttgttgagatgtgaaataaatcctagatctatttgaaatattttaaagttcatgggccaatggtgccagtcatcagatgttgagaggccttaggggaagaaagaatgagactctatggcttcaccaaggcagagatggctactatcatgattccggataatgcccccacacttgccctagctggtttgctatgacgggctagaggaggaatatctcaaaattggaagggaatataaaatgttgcatgagagaagctatttatgcaggtgtgtttgtgtgggtgtgtgtgtgtgtgtgtgtagagagagagagagagtcaaaatgtactctttgggtctagacaggacatgtttgttgccttgatctcttcatagaatgggtaacataacagcagcgagcattcctgaagttctctgaactagactgaaatctgcaaagcttgtcccctcaatgagggacccagagcaagtggttcaagaggactaagagagaaccagtttttagtgcaaggccccagcttctcaaatcttggtttttgagttaaaaatcacatactcatacttatgaaaatcaaagcacaaagaatggaaaatgaaaagtggagatcctcatttcttaaaagttatggttgccagggaaatcacatttaatagattgggatatatcacacacatcaaatgtccttcttatgtttatgtaaatatatatagcttttaccaaagcaaaatattattatatgtacagttatataataaatatgtggtaatatagatattggtatagagatacacatatggaatgtatattctatatacatagttttacattaatatcttagatacctttcatttcactatgtatatccacttcattcttttcagtaattttgtgtttattatgtggttataccacgatggtttaaactattcatcttttaaagaatttatttctattggttgttttacaaacagagctgcaaacaacagcaatgtgccaacactttgtgtctttttttttgagacagagtctcactctgccacccaggctggagtgcggtggtgccatctcggcttactgaaacctctgcctcctgggttcaagcagttcttctgcctcagcctcccaagtagctgagattacaggcgccttccaccatgcccggctaatttttgtattttagtagagatgaggtttcaccgtgttggccagtctggtctccaactcctgacctcaagctatccacctgccttggcctcccaaagagcagggattataggagtgaaccactgcacctggccctcctttgtttctttagatagtgtttcttgaaatagattcctagaaataagattgaagagtatgtaaattttaaatttttctacagactgtgtaatttctcttcaaaaatgccgattatcaaaatgtcactttttgatactaaaaaatagattgttttaaacacacaaagtaagtagggcttatcaaaaagttaatatattttgcatttctcacaagtatgttgaatttctcccacttgcattttacagcaggaatcctgactcagtctaactttcttatacttaaaaacataacaggccagaagttagcacacattttctatagaaggccagatagtaaatactggtgtctttgtgggttatatcatttctgttagaacaatgtgactccacctttgtcttgggaaagctgcaatagataatatgtaaaagggcaggagtggctgtgtttcaaccaaactttatttacaaaacagggtcatgctagatttgttctgaggaccatagtttcttaacctcaatctaggcaatccgtcaaataattctgcattcacaatagaagtcttgttgtatatattggctgactgtctttcctttctctaatgttaaccactgattttgtggagcatggattctagggaaataatacccaggtaagatgtctattaccatgtgtgtcttatttttaaaagagtggttaaattcttattgaggccgggcacagtggcttatgcctgtaatcccagcactttgggagcctgaggcaggcggatctctccggtcaggagttcaagacctgcctggccaacatggtgaagacccgtctctattaaaaatacaaaaattagccgggtgtagtgccatgcacctgtaatcccagctacttgggaggctgaggcaggagggtcactggaacctgggaggtggaggttgcagtgagccgacatcacaccactgcactccagcctgggtgaccaagtaagactccatctcaaaaacacaaacaaacaaacaaacaaaaaaacaaaaaccagttttattgagaaattcagtagtttttggtctttggtctgtatgtatatcacataggggtttggtaaaagtctagattcccacatccaaacccaattctcttgtgagcattttaaacgaccatcccaggtggttctggaatgctcataggtttgcatattagttacactatttatttgctgcatggccatggacaagttgttttaactctctgagccaacatttcctcttctatcaaatgggaatattaataatacttagcccttggagacattgttagaatttgaaggacaatgaataatttttaagagagcttgacccatgagaaaaataaacttaaatgcatgaatatatatatcaagcatgaatttacctagtgcatatgcattatacactgggtgcataatattttataaaataatccttgttttataaagtagtgtttcattatttggggagaggcattaccgtcatttcctttctgttgacttcccctcttcagagttttctactcttcccctcccatcccaccaccttgctttgtcacaaaacaaagccaatgggatcaccaacagtttaagactggtttactcaaaacaaattcattattttacatagctgaacatagaaatgataaataatgttctataaatatttgttggttgacagctttggaacaatgtcctctagaaaaagctgaacgtagccacccaccttgtatgagagccacaaagaatagccatgtgcctgaatatgtgtcagccgctgtgtgactggaggggctgaggaaggggcgtagagggtgttgtgaggtcccttctgacaagcagtcaagaacgcatagaaatacattacaaaaattaaatagtctagataagttgaaatgcatgttaagaagagtcccagagtgtggttgcttgggtaggggtaggttcaggaattgaagggacgtccctagggcctgggtccctgcttcctaatctgccacaaacgtaacagtgtcttgttgcttccaggtcactcagggatttgactctgagatcaatgatgcacttggcaccagaacttggtggggttggcacagacatgccagcctcagccactttcattctggaagctgttaaaagagacagttataaaaattgaggaatcagcaagggaattcctggtcccatgctgccttcccatctctgtcttggcaagcatagggcctatccacttgttcaagattctttgcccaacctcagctccctagactttacctcagtggctcaggcggtctcctcaggcagcctcctcctgctaacacttcctcctctcttccctctgccaggggcagctcttccctggttccctgcagaccccaggtcaggccagaaaacacctctatggcccttccctgtgtcccaccaccagataggacctcaaaggcctggggtccccaggatggccctcaaaccgactggtgcccttgcaggctgccaccctccaagtcctgcttctctccagagatgggcagaagcacmagccctygcctggcaccagcagtgagtctcataattgccatttaccattttgctagggggcttctggggrtcctaggaaaagcagcagatgcctgggtgcttggggacctgggcattctgagggaaggagcagcgtgaccctgagtcatttttcactggggacaagtgagccaactccttctacccagtgataaaatcagaaggaagyagatggagacagcactgttcaggggatgatttggggatgagaagaactggcaggaagttggagatttgggggtgagaagaaccagcaggaagttggggatttcttgtttccccacttttcccttccatttctgtttgagccttaggtttggcctccatctccctctgtagaaattgcagctagttagatagtctgcctcttattccagctctactgggggaacataatatggtctaagaagaaatttttscagcaagaggccatctctgcaaatcacctgtgaggcagacctgtggcaattttatgactcagctggccaccaggaagcgattgtagctgggttctgccccttattgaaacctactcaatgttctccttcmctaagtaggacaagaccgtaycctgcctttaaggtttatagaataraaastgaaaacwctttggggaagaaaatcttccygaacagatagcccagggcattttgaaaatcccttaggaagttctctgtttcacttgggtacctctgtccttggactttggcgatgtggtttgaccccagccagagagtgcagggaacaacagcaaaaggcaggacaaagactgactcgtgagaggaggcccrggaacaggggggcatcgtgagagaggaggacgtgagggcccaagagtgtgagcagaagaggataggacttgggcactcagtcaccagctgtggggtctgagctgtgtccccttctctaaagaggtaagccctgagtcatgggaagatggaaaccggggctcatgagacaggatgttttttaagcaccgtggtgtcttgttgacttgcacatgcamgggggtcttgggtaaccacagggctcagggtatttgcaggaacagttcaagtgctcacttgtcttggggctgtttrtggggaagtggtttccacagcaacaggaggtgagatattgktgtyaccccrgaccacacttagctacttccttctcactaaagctctgtagtcatattttccctggcagagcagaaacttctmtgttatcccacagctgttctaacggygtagacttgacttatgcaaygatgccaggagtcctgagcagcacagcccaacttcaatcacacacagatggacagagctgtattagcaaagcctgagctactgagcgatgagagtacagccaggctttcagacatctgttcattcaagagagatatgcgctaagccaaggacctaaagatgtgtttaatrtgggtgctaatatgcataaggaaccttgaaataaatgttcttagcctttggccaagagggtccatgtctaggaatctattctccatagaaataaattcaaatatggaaaaaatgaacaatgcataagtgtatttggtccccagcatatttatagcaacttaaaattggacccaatttaaattgcctatgatatggaaatkgctragaaaattatgggmtcttcccttrattggctattaggcagcctttacaaacaatgcagtgacatgagaaatgcttatgttatggtaagcttaaaaaactcaagatgcaaatcagcttattttaatcaggagccacctagcatttgggatgtggtcaatcccacataatgtatttttgtgggtgcagttcccaggaaagargaggaataaaaacggcaagtatgaagtgtctccttcgcttgcagtctccttgtctacccctttgtccatccactatgaaaggactcccttctgttccttaatatggacaatttctattgaggactcattgttctaagaattgtctcatctcctcctgcatcctcagtgcccgatctttggcttctatgaaggaargtgggyagtgcbtatggcaggkccagttctacctttctyagtatgttctggcstgggtatgtagccccattttctagtggttaccttgacatcatgaagagtttatgtctcttttgccctagatttgggcaatagtcattcaytgkgcaacwggaaataacacaagtcagcatctyattaaaaataaagtcattcaggaaagtggacgactaatagtttctaatctagagagcataggagaagaaatgtttaccacacacaaagtattagtgccttttatatcaysaaracaaaaataacaggaaaaagacaaacacattatagtgaaaacttgtttttcctraccagcatctattctgcatgttccctgatgccagaaactcacatttcttcagggcaaacccccttccccaccattctcaggctttaagtttatgtaaaattcagtaaacccaaagattcaagttatgtgccttgattaacttaagcaaatcaatgaaacccatccccataaccacagcgactggttaggaattcggttcctaagtcagtcaaatccaaaagggcctagtgatgttttttccaatgggaacacagactcactcttccctgcagaaaatgaacaaggattcatgtacactggcaggtactggcagccacccagggcctctcacaggaaagggagatcagaaagagaagcaaagaggactcatgagataccacagggccgctgmgtccagccttgcctggagctagggccacctcgatgccctatagtcttggagccacaasgtgcatttactcaaagcctctttgagtttggtttgcttgtttgctttctgcctggaaactgccagcatcctgagagatacgagatctgcatctgtgcagagacacagggtttgttaaaagtcacaggccctgactgaagtgtggaactggctgaaatgagaaagtaggaggtaatttggtgaggaccttgtgaaatggaagtgagttttaaaccttacatgcatcagaattacctggagccttgtgaaaacacaggttgctgggccctagtctattaagaaaggaagtggggctcagaatatgcatttctcccaagttcccaggtgatattcaccatgctgtcctgtctgggcactaccttttgccatacccattacaaggtattgcacgtgctggttgaactatggtctgtcttattttggtgctaaaagcctgtgccaaataccaaggctgcagcattaaggaatttgttagaaaagattctgaatattggaatttagttgctgtgtattatatcagtaaggtcctttaagaaagagtttaggctactttgaaatgggctcatctgaaattgaaaaagaagaaatgcgacttgctaaaaaggcccttccagcctgttgactgagaatccagtaatctgaagactgaaagggctgtaaatgcaggattttctactctaagataaagttagcatgagcagagacaggaagatgagagacataatgaggccaagcgtcaaatattcatcacctccacatgggccaagatgcaggcagaggtctctcaccaggggctgggaggtcggggtgacaatggtagtgcagtctgtgctagaaagtgcacatccccagctgggcgcagtggctcacgcctgtaagctcagcactttgggaggccaatgctggcggatcatgaggtcaggagttagaggccagcctggccaacatggtgaaaccctatctctactaaaaatataaaaacttagctgggtgtggtggcgggcacctgtaattcagctacttgggaggctgaggcaggagaatcgcttgaacccggaaggcggaggttacagtgagccgcgatcacgccactgcactctagcctgggtgatagtgggagactccatctcaaaaaaaaaaagaaaaaagaaaatgcacatccccaaccccagttaaaatgcaaatgcaaactatgtaactgacaacctgtctgcttctggctacctggcccatggaattgatcagaagcaaatagtagcctacagacattagaagggagtcacattgccaaagaaaccataagactggttccaaaaagttgctgattgcacaatacctaaggcaacctcaggctaactcacacagacaggaagtcagcagcctccagaaagcagatcctccacattgcacatctcagattgtccatagaggacattctcccagggaggagagctagggactgccagatcagctgaactgcttaaaaatgcagtacccattctccagttccctatcaggggtctttgttcaacttactgttttttcataacacttgtatttagggaatgttgggcatgattaaacttcgtttagctttgggtttctagaccttgagaaacaattcagtgcaggcaaatattgtatgcccctatattttttcctgaaagccaataaagaaggaatgatgacaccttcactgcgtctatggggacaaaagctgcttgtgtgtgtgtgtgtgtgtgtgtgtgtgtgtgtgcgtgtgtgtgtgtgagagagagagagagagagagaaacagccttgtcaaaaagacgtgtttgttgctgtaccctcattatatgaaagccatcatggcatcaaaacagtataagccaggttgagctctatcctctctgcatcaactcagaatccctaccagaaagtggttgtgatggatggaatatcacccatcaaagaatagggtaagatgagaccagagaggtaagctatgcaagctaatcagaaaataactcaaagttttaaaagtgcagaatataaaaaggaaaaaccctcattcctaaaaaaaaaaaaagcctcatttcctcaaagaaatcagttagctatttgatgtgtatctttccaaatatttgcctatgtaaatatatatgtatatatggcatttaaaaataaaacaaaataatatactttacagatagttccatagcatatgtagagaatatatatgcatatactgaatgtaattaggtctgccttttacatataatattatggacactttccacagttatagatgtgtgctactttttttttactgacttcagaatattccactgatggacatcttaatcctctactgattaatcccctactgatgactgtttgcatttctttgctgtttgccaaccacactgcaaagaatatcctcatgtctacatatcttatcttttggcagtgtttctatgaagcagattcctagaaatgggatcaggtcaaatgggatgtagttcacatagtatatgcattttaatatttgctaagtagtagtgtttatgctttaaagagttggaacactacaattctaaacatgtttggacacaaaaaatagattatttgaaacaaaatgaaataagcatagctcgtaaaaattaacacgtttggttttcacacaaatattttgaatttctctttcttctgcaaaaaggaccctagcttagtatggatttcttgtacagataatgcaaacaatccatctattaaataacttacctttcacagtaaacctatagacagcatcctgctccacacagaagctgattgtcttttccttctctaacattagctatttattttgtagagtgtagattctagagaaataatgtataatacacctgttgccatatgcagagacttaccacatttagaaaacagtggtgaattctattgacagtggctctcagtcattaacatgctatggaacacctcatgagcttgataaaaatatcagttcccaggtctacacttaaagatcctatttaagtggcttcaacaatcactgctcaaacactctatgtcaactcagaatcctgacaggaagtggttgcaatggataaagtatcatctgttaaagaatggggtaagatttgagtataggcgggtcatactttgggaaataacttggtcaatggttaacagcatagtctgtagttcaataaaagtccagttttggaacacaattgaccgtttacgtgctgtgtaacctcagccaagttgtctaacctttctgagccctgggttacttttctgtcaagtggaggtattaatagtacctaagctgtactattgcattggtaagattaaatgagcaatgtataaaaagcactcagtaggaggagtaagcctcaacaatgtaaataattgctattaagagcttgattcatcatgaatatgccctacagaatactctgcttaatggtggccattcgagtagtgaattctcctagagcatgcatgttatgatttgagttataacatattcgtagtttcaatgttccagaactgtgtctccgttgtaaagtggataactctgtggtagccctccccatctctcccaatttccctccatttcacctcttcctaatctttgcctatgattcctcttaaccagtgattttgatttgccaggaaaacaaaaccaaactcaatactggtttaccttttaaaagagcatctttattatttccccaggccgatcacagccctgaacaaaagcatccgatacacatttgtcagtctggtggctttggtgccatgactgcctacacaggctgatgacagccactcggttgtcaccagacgcggtgtgagggaagggggaggggacaggggaactctcagagcaaacaatcacaaacacactgtgaaatcgaaaataaattacaaaaactaaatagtataaataaattaaaatttaagttaagaagagtcccacagtgtggctgtttggcaacaaccagtccatagaagaggtagctgtggaggtcacacgcatgttcccaaggctcaggctcctgctcctccccactgggcccaccgaggtcgctgggcctcgaagcttctggacccctcaggcactcagctccaggtcgctgacatatttctggacccactcctcactggggtcagcacagacctgccggcttcgcttggttaggaagctgtggagaagggaggaagagttaagcactggggaatccagcaggggaatcctgggcccaccatggccccaccattctgctctctgtcctgggcagctcagggcttgctcctctttcaggggccccctgcctatctctgtctagagagcttctctcagtgactcagtaggggtggccctcagagtgtcccgctgcctccttcttcctgtccctttcctctgggctggggcagcccttcctgactctgtaacacatgcctcactccagctccaagtcaggtcacacctcggagccctgcgtcctgtatccccgataggctcctgaaggctgggcctttccaggatagccttctggcctgtctctgccccaaccctgaccctccctacctccatagaggtgagcaggaagactggcacttacatgacaccgggcttggagcactggctgctcgtctcaaagtagtcagctatgaaattctgtggaatctgccgggaggtgtagctgaagcagcaggcggtcggcgtgtcagcagcaactgtggagaaaggaagagaatgagcccgagtcacagctcagaagaaaaggccaggcagcttctgatccccgagcagttgaggaaggcaggcttgctcagaccaagtgactggaaggcatttgggcatttttgctgagaaatgtctctttgtttctgtctgtatccttctttctccttgactcttcatagtgggttctctgtttctctgtgtgatccagatacctgaacggactgttctcttatctcagttctcttcagggaattttgtctggttcaagaagtcataccccaacccaagagaagccttggacatctctcataagacatccaagggacagagctcctgggagacctagagtgagctggagagtgaacaacataccccactgggaagtaagcagccctggattctgcctcttgctaactgattcgtttcgaaccctgtttttctatctgtaaaagggactgtaactcccctgcccctgcctagattctcatacctggagactagggggctaagaccccttctagagataaaaataaaagtcttaaagagaaagaccaagatgtttggcagccctttaagaagttctcttttctcttgggggcttttaggccacaagaaaagattgatgtggtctaaccatggccagagagtggtgatacccacaacgaaactcagactcacgtgatgcagagaactggttgcagagagccatggtgcagaggaggacagcaagggcagcagtggagacctgcatgattctgagcaggtgacggaatgtgggctcgagtgtcagcagagccaagaaaggactgaccactgtctgctgcccgtgtccttctgaagtctgaaaccagctctcctctttataggcagccctggcggatggggaaatggaatctgggggtgaggagggaaatttttaagcgtagtgatgctgtcatgctaagttgcacaactcagggtccctggtgaccacaggggctcaggatatccaagaatagcatctttgagctattctctaactctcagctctcaactcatgacttgttatagtttcatagggaaatggtttctcctgtgagtgtgaagaggggtatatgtcaacccaaggctattcttagtcagtcccttctcataagaactggtctgtgcatgaactctccagccccattccttcccacagagctgcaattctgcttcctcagctgctataaccacagggatagggttgatgggctgatgctgtggagggctgcacaacccttcctcctcccagaggcaaagaactgaatgaaagctggaggaatagaaagcatgaggtcatgtttcagtcatttgtctatttattagtcatgtagtgactagggcgctgtgttaaac

SEQ ID NO: 17875 - DNA, 18557 bp, Homo sapiens
tttcattgatcttttgtgctactttatttcaaaatctttaattctgctctgatttttattatcttttcttctactaattctgggtttggtttgctcttgcttttctagttctttaagatgcattgttaggtaatttgtttgaagtttttttttctttttcgatgtagatgcttttagttataaacttccctcttagtacttcttttgttgtatcccataggttttggcatgttgtgtttccattaacatttgtttcagaaaacttttcaatttcccccttaacctcttcattgacccactggtcattcaggagcatattaatttccatgtatttgtatagtttctaaaatttctccttttattgatttctacttttatttcattgtagtcagagaagatgcttgatattatttcaattttttgaatgttttaacacttgctttgtgacctaacatatgatctatccttgagaataattcatgtgctgaggaaaagaatgtgtattctgcagctgttggatgaaatgttctgtaaatatttatgaggtccatttggtctatagtgcacattaggtgtgatatttctttattgattctctgtctggaagatctctccagtgccaaaagtggggtgttggcgtctccagctattattggtctgtctctttagctctggtaatctttcctttatatatctgcgtgttccagtgttggatgcatatacatttgtaattgttatcctcttgctgagtcgatccccttatcattatataatgaccttctttgtctcttcttatagtttttgtcttgaaatctattttgtctgatgtaagtgtagctacttctgctcctttttagtttccattggtatggaatatctttttacatcatttttagtctgtatgtgtcttccataaatgaagtgtgtttcttctaagcgacagatcactgaatcttcattttatgtcttttgattggagagtttagtacatttacatccaatgttattactgataagtaatattcatgccattttattatttgttttctgattgttttgtggtcttctcttcgtcctttcttcttgtcttccttttagtaaaggtgattttctctggtggtatgatttaatttcttgctttttacttttgtgtctatttgttgtatgtttgtgatttgagttaccatgagattttccagcactattttataagccattattttaagcttatcactgttatcacaacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctgggcgcggtggctcacgcctgtaatcccagcactttgggaagccgaggtgggtggatcacgaggtcaagagatcaagaccatcctgccaagagatcaagaccatcctggccaacatggtgaaaccccgtctctactaaaaatacaaaaattagctgggcgtggtggcgcatgcctgtagtcccagctacttgggaggctgaggcaggagaatcacttgaacctggaaaaaaaaaaaaaaaagagtagtttacaaatcacagttacagtgttttcatattctgtgtttttctgtgtacttactattaccaatgagttttggaccttcagatgatttcttattgctcattaatgtccttttctttcaaattgaagaactcgttagcatttcttgtagatcaggtcttgtgttgatgaaatcattcagcttttgtctgtctggggaagtctttatttcttcttcacatttgaaggatattttcacgatatgtattattctagagtaaatgttttcttttccttcagcactttacatatgtcatgccgctctctcctggcctgtaaggtttccattgaaaagtctgctgtgagacctattggagctccattttatgttatttgcttcttttctcttgctgctgttggaatctttcctttatgcttgacccttggtagtttgattattaaaagccttgaggtagttttctttgggttaaatctgcttggtgttctataaccttcttgtattaggattttgatatctttctctaggtttgggaagtttactgttattatccctttaaactttttactcctatctctttctctacctcctctttaaggccaataactcttagatttgcccctttggggctgttttctagatctcatagatgtgcttcattcttttttattattttttcttttgtcccttctgattgtgtattttcattttttatttctttatttttttatttgactattttcaaatagcctgtcttcaagctaattctttcttctgcttagtctattcttccgttaagagactctgatgcactcttcagtatatcaattacatttttcaccctgagaatttcttgattcttttaaattatttcaatccctttgttaaatgtatctgataggattctgaattccttctctgtgttatcttgaatttgagtttcctcaacacagctacttggtctctttaaatctattttctatctttatgctttcttctttcttccctggaaggatactattatgagctttcatacccttcggctagttacttctctctttcctctttcctttgggcccagggatggtgccagctacactgctgccagcctcaggctcctgcactatccctttttggttccatcacaccctatccaccataagttgttcctttgtaaataaaccctcctctaattattctaatttaagtgttccaactgttttatattgagtccttgactgatatgggaaaattggcagaatatgaatctcctagtaccatcactgaggtgtagaatactgaaagttattatggaagagttctgagatcttagcagtatagagcattgcacagtcttattcctccattatggagaagaaggggctatttggcatgtattttctgaatttgggagcatattttaatatagcaactcatgtttgctactgtttgaatgaagaaatttcactgagcattttttaatgagacactggtcaagagtgccaagcctgaaataatcataatgtattgtgccttagaagaagatgcaggccattttcaactcattttacttctctgcagcccttaaagggtaaacaagagcatgtcagggattcctgtggctccatatgaagggtcgtggagactagcagaagggcagaaaccatcagactgcagtttctccaggctaaacaatggaacatccaacctgaaaatgacgttgggatagtgtcccgatgaaatacggatttcattctagaaggagttcttttggtagcaaagataggcatgaagctgaacattgctccaagaaaaccaaacattgcttataagaaccatataatgttcacacaggtagccagtagcagatggcagagatacatttgactacttactaagtggtttcttcattctctctttgcttccttcataggagatgtatgagaatatgagactcaaagagagagaaaaaagggaaagttcatttttaaaaaaaaagataaaaagataagccctctcctttactgtaagcctctaggttcaaaaacaggtttagcttgagttaggacaggtggagaggaacatagtttaggaaaggaggctggaggcaaggagatgagtctagaatggactttgatatggaagctataaaagaagcaatcttgaatattgaaacaagagtatactattaaacaagaatgattggaaaattgtggagttggccacgaaactgttaagcaaaccgctactcaggagaaaggaagagttattagaaaaggaacacaagttcatgtttatacttcaactcttgagactcactgcaattcccttctgacaggaatttttttttgtcttatatatggtagagttaattgttctagaagcctacttcaagctaacttaagcaacaaagtgggatttattggaaagccgcttgggtgtctcacagaacccaaggaagagaattgagctggatttcacaggacctggaaaaccctcagaaactcaattgttctctctctttcttctctctccagtcagaaccttcaggaaggggagagtggctcatgggctgagtggataaaccacaaaatgggtaatatactataggtgagttttaagtgacaaatgaagtctaagctgttattgcactggtcggtgactgaaactgaaaatgggaattagaggttaagtggagggaatatgttgccaaaatgttagaaggatcttcttcaaagagaagttgaggctctagaggataatggtagggcacagagtggaggtgaagcttgtgaggggtgggggtcaatggggaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgaggcatgagaatcgcttgaacccaggaggcggaggtggcagtgagccgagatcatgccactgcactccagcctgggtaacagagcaagactgtctcaaaagaaaaaaaaactgtttatatcagttatatttgttattgtaatgatgaaatttatagacaaactaatgaaataggagtataaacataccagtattttttaaaaataagttgaatattttatgactacataaacaataatcttttaaaagtcactgtcaatttgatgactaggagtcagccatacaactataaaaggttttgagaaaactgtaaagatctaaatagaggctgcatttagtttttttccccacaagaacctttaggttctagacatttatttcaaataaatgtcaactcatctggatgtagcttatgcaagaaagacctagaagagctcttattatggacccccattcaatgaaaacacaatggccctttatttctctttcaacatgaggaggtggaagggctgttcaagcccttctgttcacgatagcccaggaggtccaggagagaggcgagccgtgggtgagcaggagtgtctggggagtgtcaactttccattgaaaaatacccctatgatcaagccatttcacttccgtggcaatcttatttatgtattcaccaaaattgggtgggagctagtgtttagctgtcatcgtccgtaggctgctgtgtttggctcatggcagggtgtgaaactggcatcagggagtgtttgccaagtgaataagggtgaggctgccctttccagagccgccgggagaaactctggatacagagaccctagcctggcgccagtcccagcgttcctcctagtcggggaggaatctgtgggtgggaggtggggagcctgaaacccaaatacaacagccactctgggctgggcgtggttccctgggagctgggtctcagatccttttaaagctgatttctccccggatctccgggcaagatgggcaagtacacggtccgcgtagccaccggggatttgctcctggcgggctctcccaacctgstgcagctatggctggtgggcgagcacggggaggcagacctagggaagcagctgccaccggtgtggggaaaggtgagcgcggactgcggtgagagctggggccctgggactcagaggtgtcactgggggccggggccattcggagggtgctgctgccccacccatgagaaacctgggaagcggggtaggggctgaggtcgggtgcacttggtgcgcctgataggaaaagcgagaggaacaggagagatgagaggcattttcctgcccgagcggaaggacagagacgcccgctggggtgggcacggcaggcccggggggaggctggcgccccgcagtaccagctgctcctcctcacctccacctctccccggctgtgctgtggaggggaaacggagccaggattctctgaaggttcaccgaccccgccgtcctccctraagaccccaaaacctgagctgtgtactgtcgcgcaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgmggcctttttcccctgctaccgctgggtgcagggccacggaaytatctgcctgcctgagggtactggtgagctcggtggagaaggggcacagcccctggcaggctggaggaagaagcgggtggggggaggctactgtaaaagagggaaaatgagagatgagggagatggggagaagtgaagggggagggtggctgatggggagacccgagcgcggaggggtgaccagggagggcatgtgctcttgtccctctcccccagcccggaccgtgagtgatgacccccagaacctgtttaagaaatatcgggaacaggagctcgaggaaagaaggaaggtgtaccgttgagccccaggaagtctttgatcccctaccagatcccaagaaacctgccacctgcctccttacccctacctgtgtgttcttcctccaggtggggctcctggaaagatgggttaatcctgcctatagcagggaataggcaaccggaccttcctagggacgagcgattcctcgaggataaggatttagactttaatgtctccctagcaaaagggtgagtaccaggtagaggctgggcacttgcttcctagggcacaaggtgggatkcttccttgatcttcttgcactccattctttccacaggttgaaggrcttggccattaaggggacactggatttcataaattgtgtgaaaaggctggaagatttcaaaaaaatattcccacatggaaagactgtcctggctggtcagttttcacaacctcccaaaaccaatatacagacttccaacccagggatttgaaaaaggagggggatggaggattagatcagtgggattaggagttcggagctcagarctcacagggtgctccccaattgatgttcctagagcgggtttatgattcttggaagaatgatgccttctttgggtaccagtttctcaatggtgcaaaccccatgctcctgaggtgttyttcaaggctcccagcctgcctggtgctgcctccagggatggaagacttgaagacccagctggagaaagaactccaggtgctgctgggctttytgcccatccaccatcccagccattacccccacctcccttytcctcccatytccagccccttctctcatctcctccatctacacccaaggtttytcaacgttggcactattaacattytgcaccacataattytytgttggctggcggggggggggggggggggctttcctgtggatcgtagggkgtttagtagcattcctggcctctacccattgatgccagcagcatccccccggttgtgacaaccaaaaatgtgtctagatagtgctgaatgtcctggggttggggaraggaggaattgcccctgattgaraacattgatctacaacatctcctcctgtatcttcttttctttctccacattcctctcttcyttcttcattgaacatatatcagccttagggaaaagcgcaagcttctggagagaaatagcaagaaaaactaaacaaagccttggaragctaaaagctgaatctgtttttggggggagatgggtagctaaaggaaatatttttgctacattggctaaagctggcagaagaggggatacgtgaagaatgcagtggccttatgtggtggaaaaccagaaacttcgctgcagggagctccaagtctgaaggaaracatcastcatgaaaactttgcattcagttttttggttctgcagaaagtgattggtgtttaaagtaaaaaagacttgggtgggtagaggaaggatccaccctggaaaatgagagaagggcagctccagaaacaactccaaccctgttttctattcctgcccctggccctgtaggctggatctctgtttgaagtggatttctccttgctggatggagtcaagcctaatgtcatcatttttaagcagcaatgcgtggcagcccctttggtcatgctgaagcttcagcctgatggaggactcttacccatggtcatccaggtgagagggcccaggtatttttctaccagacactgatctcctttagggacttagatacacaagttctcagcccccactctctctcctgctctagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaaggtacttcagcatctctgtcattctgtatctgactgtccttcatatttcagactcctacaaagagtctaaccttgtacatttcagtctagcagcaatcaatttatatgtggagacacatacacagatacatacacacacgcrtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtgtagggcatgagttgggatgaggaggaagaagaagtgggaggagatgagagaagaagccatgttacttagcggggagaagaatcaagagttattttctgaccatgtggggcttccaatgcctataaagacccatttgcacatgtcaggagggcaactggatatgtgagtctggagttcctagaagaggtgtaggttgaaaatacagattttagagtcattagaaaacaaaagtatcaaagtcattgtactggatgaagttctctagggtttgtagagaatttgaccgagatataactctagggtgaaccaacatttacagactgagagaagggagcagagtgagaaaagaaacaagaraaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggggtgagcagcaaatgtgaggtgggtaagcaaagacaacactgagtgaagatttgctgtgaaagggaaagcaagaaacagggagatggcaagacaaggatgtgggggtcaagcacaggttttctttagggtatccaatattgcacatgtttgtatgacagagagaggagaaggaatataattataggagggtgaaggcaaaaagggatgggctcatatgtgggtacctgcgaggatatgggatttttagaattcttccaaggacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacrtggaggggatggttgggcttttctacaatagtgaccaagccatgaaggatgatctagagctgcagrcctggtgcagagagatgactgagactggactgcagagrgcccaagaccaggggtgagacatggatccytccccactgaaccctgtcaacaccyactccyctgcaaacaatctgcttcttctcacatcatcatgagacaccccacctgcccaaggaagctgagaattctccagagtgtgtccagaaatgctaacaagcactcctgatctccccagccctgttcctacacagtgttctctctcctctgcactaagagcttcctctggaactagatacaaaacttctcttaggtattttccctcactcttccctcccctctccccatagctcaaggttcatcccamgtgcattaacctttgagcacacacaaggtgggagtcctagggtgtgcaggccagaaccacagaaaagttcttttctgtatctccacatagctttccctgcstgagacctatttcgtgttctggtttcgagatctctgattctcatttcaccaggattctcatttcaccaggttcctcatctccttagagtcccgggctcagctctgccactttgtcaccatgtgcatcttcacatgcacaggtcagcatgcttctaaccacctgggccaggtaaccyatgtgatcatcccacaasggctcctgggatggagaagtgggggatcaaatgcccaggtcatcagcctgcatttctctgggctctcctccctgcagctggactggtacycctggatccctaatggcccatgcaccatgcagaagcccccrcccrtctctaaggatgtgacagagaaggatmtagtggacttactgcccaatctccaccaggcacgtatgcaaaagaccttcacaaagttccttggcagacgccagcctgtcatggtgagaagcaaatgcctgggtcctgggaaggaggcagctcaaaggaggggaagtattcygggctgagagtcccaaggggctgagccaacttgtcttctgcctctcagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccstgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacggattatatgtgtggtggtggaaggtgggaggagagaccttgctttgtttcctgcccctttattcagattccaaagaaggaaagaaaagttttcctggaatgaaaattttttctagcaatcaatgctttttccaagggtatcttggaacctctctaagttaaatgacaagtgttctggatgactgagtccactggggctaagaaacctggctcttgacaagggtttttggcttgaggcctctctgaatcctcaataagccatcccttaggctacctgcagcaacgcctctggtgcaactcccagcacagccctcctgcatgatccctccccagctgcatcccagccttcctctcagtcctgtcccaggactcttgataaaccctcttctcatcatgctctatccttgcatccttaaaacataccatctagcccacagtcctagatactggagataaatggataaagaaggaactagtaggccagactctatgttagaaattttaaatatataatctcaatttatcacaccgggcacagtggctcatgcccgtaatcccagcactttgggaggcccaggggggcagatcatctgaggttgggagttcgagaccagcctgaccgacttggtgaaaccccttctctactaaaaatacaaaactagccaggtgtggtggcaggtgcctgtaatcccagctacttgggaggctgaggcaggagaatcacttgaacccaggaggcagaggttgcagtgagccgagattgcaccattgcactccagcctatacagcaaagagtgaaactcggtctcaaaaaaaaaaaaatttatcctcacaacttctctgtgaggttggtatcactatcaccatcttataacaggaaaatgaaggttggagagataagggcagaaatgacctgggaccaaaatgcagcagagtcagattccatttgctagaaggaagcaaagcccaggattgtggtcatagcaataacagttaaaagactgatcataaaatctagaggccaatgaaagcctcggatggatctgatgtaatgggaaaaaaaggagagataaagattctttgagtcttttaaagaatcttatgcattcaaattacttatgtcccatatatttttaaaaggaacatatacaatacggttaatacggtagaaatagacatgtgtgagccatccagattcacctactgatgccctcaaccttctaatgtcccgtcctgttctgtgtattgcttccgtccatcatatgacttttttcagtagatgacgaaagaattttaagatagccacagaccatagactcacagaatctgacttggttgctagaagtttttgtggttgcatggaatggtagcaaggagagtcagaagagagggaggggatgaggaagaggcagaggtcacgctgaggttttcagttgcggcacaactggcgagaaatacaaagattcagaaggaaggttgtttaagtttgatgtaatactgtggttcttatgggaagaaattaaacaggtaattggagaggctgaactgaaaaaagaaaggaggtgagttctggctgggcgcggtggctcacgcctgtaatcccagcactttggaaggccaaggtgggcggatcacgaggtcaggagatggagaccatcctggctaacatggtgaaaccccgtctctacttaaaaaaaatacaaaaaattagccgggcgtggtggcgggaggctgaggcatgagaatggcgtgaaccgggaggcggagcttgcagtgagccgagatcgagccactgcactccagcctgggcgacagagagaaactccgtctcaagagaaaaaaaaaaaaatggaggtgagttctacagtttggatgacttaggagctgaatttatgaacaagggaaaaagaagaggcagagggccaaggtgtccttggccctaacaagaattagggatataaaaaagaacatgaggccaggaacggtggctcatgcctgtaatcccagcactttgggaggccgacttaggtggatcacctgaggtcaggagttcaagaccagcctgaccaacaaggtgaaaccccatctctactaaaagtacaaaaattagctgggcgtggtggcacgtgcctgtagtcccagctactcgggaggctgagacaggagaattgcttgaacccaggagttggaggttgcagtgagccgagatcgcaccactgcactccagcctgggcgatggagcgaaacttgtctcaaaaaaagaaaaaagaaaatgaagccaggaagtgagaatgatcctagtttgaaaggtaagaagaaaagctggatgatgcaggtcacggaagccctgtcatcacttcctatgactgggttgtctccctgagctctctcattttcttttttcttttttctttttttctgaaatggagtttcactcttgttgcccaggctggagtgcagcggcacgatcttggcttaccgcaacctccgcctcccaggttcaagcaattctcctgccttagcctcccaaatagctgagattacaggcatgtgccaccaagcctggctaatttttgtatttttagtagggatgaggtttcatcatattggtcaggctggtctcaaactcctgacctcaggtgacccacccgcctcggcctcccacagtgctgggattacatacaggtgtgagccaccacacccagcggctctcccattttctagatgtgtcacctcactcccattttcctccccaatctactccccatcctcgtgtgtttcctcagcaagtgtccccatctctgcacagcacagtcatatcctcagtccagctttcaaattctcccacctcatctctcaggagggtctgatataacgactcttttactcagataatctgttcaggcacctgtgcctatgagaggcttactgtgatctctgaatctatgtttgtggtaatcctacgtggactgctcacctctagatgtcttatgaaatcacctccccttatttctacaacaggctcaaattgccttcgggaatcattaaagctcagtgttctggctttgattggtccttcgctccctagtccgcctgcactcatgtagggtcatgctattacaaaactccacagggtaccatttatgttgtattccatgtggaaggtgtcctctggagtttggcaatatagcagctgtctgtaaaaatgatattgaaagcatcctgagttctggagctgcgccgattctattaggctgagaaccccagtttcaagttcatctcttcatttttctctcattccatttcacagcggcttaacagcaggtcctttgtattcgtttctggcccatagagggatctttattcaaaatcacagggttgtctctaaatttctgctaagctaatgaatggtgttagtatgttctcttctccagggcagaggcagagttttttttttttttaattagccaaaagcaacattacacaataaatcacatatcattgtagaagagaagagttaactattataactaaaagataaaatgccatggcattcaggcaacggtggattagaagtacttcgaacctatcagttctgtaaagcctagcttaagtctgttggtctaactttctaactagacttaccttcctttagaaaatatttgatgtgcagagagctagactgaggatctagcagtcacagatcaccttaattcaatcaggaactaagattatttgatgctgggttttaacccctttaaggcctgaatttccaccccacctttactgctagggtgcagctctttgaggtcccaacccaaagtgggtgagaaagagacagagagagagatacagggatggtcgagaatccttcaaagacaacatcagccacagattaaagagaaatcttcaatgtggagaaaaatctcattactttcacatgggcatcaataatacaggtagcattttctcaaatgaaacattagctgccagagacaatgaataatcttggaagtgttgaaagaaaatacctgccagactagaataaagactttctacaaatcagtaagaagaaataggcagttcaataaaaaatggacaaaaggcctggcacagtggctcatgcctgtaatcccagcactttgggaggccgaggcaggcagatcatgaggtcaggagatcgagatcatcctggccaacatggtaaaaccccgtccctaccaaaaaaaaaataataataattagctgggcatggtgatgtgtgcctataatcccagctgctcgggaggctgaggcaggaaaatcgcttgaacccaggaagcagaggttgcagtgagccgagatcgcgccactgcactccggcctggtgacagagcgagactccatctcaaaaaagaaaaaaatatactcaagacttaaacatacatttctcatggggacatccaaatgtcagtaaatatacggaaaggattatatttgatgattctatttgtcagtttaatatcacatcaacttttatggtatctggaggaattgatcccattctgggtaagtctgatgcccgtatggctcaattcgttgcttgtatctctggctttggttactgctccagagaattgcctgattccatactgcatgaagttttaagatatttgaatactagagaaatttccaaacctagcaaaagggtcctgtattatacaaatcttacagaaatctccaaggcctctcatcacatctccaggagatctacatctgtgtctcttatatgtggccaaagaggctatccttgactaactctgggtcactgggatgcctattttccccataccaccttattatttggatactttaccagaacgggtaggaagtctgctggtcagatatagatcatagttatcacagtcaacagcagtctatgtggattcttggtggcatttgacacagccactttcactttgcttaaatacttttatctcttactttctatgacatcatagtctcctggttgtccactttccttaatggttctctgccatgcaggtacccattccagggagtccctggttcccaaagtcatcctgattttcactcacaagctacccttaatatttaaacaaataggctggaaactctgtctctaggcttttgggaagggcccataggagaatgactgggtttctcattaattgattagaaggtacattgttaaggtaacagctgctgtaacaaatcagcccaaataaataatggttcaaagacaatagttgttcttttgtttcactcctgataaatttaaaacaatggttcctaattggtgcgtagtcctccttcactaagttagggactcaggctcccttcatcttgtggctctgcatatttaacatgtggtcaccatacttaagaacatttaggtagcaaaataagagagaacataaaagatgacatgtgtgatatttttatgggacacacacatagcaatcagaatccctggcaggaaacagttggcataatcaaagtcagtgtttgtttgtaaatctcttttattttctctaccataaaaattgctattgttattttatattgatatggattattgttatatttttattgtgaattattccctctagccttcaaaaggctgggcgtggtggctcatgcctgtgatcccagcactatgggaggccgaggcgggcagatcacgaggttaagagatcgagaccatcctggccaacacggtgaaaccccgtctctactaaaaatacaaaaattagcttggcatggtggcacgtgcctgtagtcccagttactcgggaggctgaggcaggagaattgcttcaaacccgagaggcggaggttgcagtgagctgagatcacgccactatactccagcctgggcgacagagcgagattccatctcaaaaaaaaaaaaaaaaaaaaacacgtagccttgctttctgctctgaattctataatgtctaattttttttt

SEQ ID NO: 17876 - DNA, 13883 bp, Homo sapiens
atattaaagaaccactatcaatctcatatatacatgtgtatatattatatgtaaatatacacctatgcagacatatgtgcgtgtgtgtttataaaactatacacatgagttatcttacaaatgcatgataagtataaaggactttctcttggagatgagctgggaaaaggttaatgtgtcacttctcatttcatacacttcaagacagaaggaaggaaaaaagatgactagaatttgatgtgtatgatttgttcacttgtttaagctttagagttgacataaggctaataatttcaggatcatagcatctaattaccattgcatttatgttcagtaaaataaaagtatgcagtgcaaaatagaaaaaaaataaagcctggtgaggatttctggagattttgctcttgtttggaagagaaaaataacagtcattaacacatgattagccatatgaaagcatatatttagacatgatctaagttggaaacacaaaggaaaaagattatccaaatcttgatcttgtgtttacagtaacacaaaagcagagcatgaattcaaacacttaatgttcatccctcttatggatgattgttccagtatttccctacaggttacagctgctcctggacatagtttttttttccaaattcagacctccaataactctaggtggcatttagctaaaacagctttcctaccctcttacctttctccctttttgtgcttaacactatgagggccagcacagcctcttcacattctattttctttcatttcttactttcattttactcaaaagaaagaaatctaagaactgacccagtaaataataatcatttttatctagagcatgcagagaataaatggctctgaattgtcatttattaatcatttttctttgttttctagtgataacatactgacaactcagcagtagataggtattagcatatgtggtggtcaatacaagtgatacagagtatggagaatagcagatatatttaggaagtgacccaagaaactctctttaatggaggttggatgttcattggatcttgagggaatgggaagatgtggattgacaagtcagagaaaatatccctcacagagagaagggagaggccaatggccctgataagggagaattgcaggtgacagcacaggagcagccaaactatctgcccttcttcagacaggaatgaagcagagctggtacaagggtggcacacgaccaaatgcattggcaatgggggtgatgtcaatatcctttgggtcaacctgagatttcaggttaaagttctgcaaaatggtggtcaggaataaaaacagctccatgcgggccaggccctctcccatacacatccgttttcctgaaaataagagacataggggatttgttccttgaacattaggtcatgaacagtcacaaagagtatgcagtaactatttgataaatgattaaatagatggatggatcgaaggcagaatgactggaaggatggctggatacacagaaaaacaaaaatgaatacacttcctatctacttaatatcttattttactaggcacccttcactcaacaaatatttatggagtatcagctctatgccatgcacttcactaagtgttcccacgttataactgctcttttgacactacaagtttccatcagtctttttctagaaatgcattcacagggaagatgggctgaaaagagaaggctcatatagtgtgttcccctttgtacttctggcacaatgtttagccaaagattttttttcctagtgtactttcaaaagtacatgtctaaacatgtcagtctctcattttacaactttaaacaacacccatctgtcctatgggataaaggccaaatggcttgacctgactcttcacattctgttcccagtctgatgttctatatcactccttccattcttcatctcctccactctcagctctaggcatatccattcttcatcaatttccaacacaccacaaagtttcaagctttatctcttgctgtcacatctgcctaaaaagctctactcctatgcttccttcagaagctatgccccatgtcatttcctctttatgatttctgtgatccctagtcaatagaaactcaccctctctaggtttcctcatcatattcatgcttccactggagcatagatcaccgggaattctattatctgtgtatttacttttctatcttgctaaaacgtgaaatccttaaaagaaggccttagttcttgacatctcagtgtatacagtgccagatccaaagcagggatcaaaagccagaggaaaaaatgaagggaactctatgtccacagactcaccacacactttagctgtagagattgaatatccaagatgtatgatcatgagtggagggagatcaaggtgctctggaattattgcagactatccttccacattcccagggttttcctgaccctgaaatttgttggtaggttctgaccccctagatctacagaaaatgtcctgctactatggtccattacctctgtaaaagtgccttgccttctcttcttgtcctgtttcctgctgcaatgaggcagcttaagtttccttcctcttggaagtggtatggcctatgaatgagcaggaagcaggcagattcccccactgagctccccaacatcctgcgctttcccctctggcagccttcctcctactagattacaatgatctgtttacttgtctacttctctaaatcaggagtgagcctcttaagagcccattctctgctctcagatacttgtatctccagagctcagtctagggagctagggacaccacagggaagatattcaaagttgtggaattagatacttttctcatggcagatgagaaatgtctaaataagtttcacccattaagaagagctcttgggtagctcagtgatgtatctagaggcagaattaaattaacctacattctagctttttcagtttgaaaaactggatcaactccccaaagccccactaacctggcccaataatggggatgttcatcagcagggaaatcgcatgggcatagggaatggtgctaatgatctgcaaagcaattcagccaaacctcagaggtggcatcatgtaagagtcaactgatcccaaaaaggtatcatgtgccctgaaggacagatggaaatgaatatctattacctgctgagaaaggcatgaagtagtcacttttcttaaagttgccactcttatccagaaagtggccagggtcaaacatctctgggttggggaattctttgtcattgtgcagcacagaagtcagggatgttattatggtcgtgccctgaaaatagcaaaacagacaaactaagttataaagaagtcaaagagtgggaagaagtgatggaaatcacctagtccaatctcttttatcaatagataagaaaattgaggtccaaagaagttacattcccacccagacagacctagtaagaagcagtatgactttaaggcaagtggcagtgactttgctgaagtcccctccaattaattgcacttgaagtcctgagcatttgagtactcgggggcagccttctgaatcccggtttatcatcaagcttggaccctggtgtacatccccacttgctgctgtatttcatcacttcagttttcacacacctcacacatggattaccttttttgttgttgtttgcaggactgttacatgggtatattgtgtgatgctgaggtttagggtacaaataattccatcacccgagtagagagcacagtatccaacaggtagtttttcaacccttcctccccttcagcccccatctagtagtccccagtgcctattgttgccatctttatgtccatgagtactgatgtttaactcctccttgtgagaacgtacaatatttggttttctgttcctgcgttaattcactccagctgcatctatgttgctacaaaggacaagatttcattcttttttatggctgcatagggtttcctggtgtatttgtaccaccttttctttatccagtccactgtggatgggcatttgggatgattccaatcctttgccattgtgaatagtgttgtaatgaatatacaagttcacatgtctttttagtagaatgatttattttcttttggaaatatatccagtaatgggattgctggatcaaattgtagttctcttttaagttctttgagaaacctccaaactgctttccacagtagctggactaatttacattcccaccaagagcctataagtgttcccttttctccacagccttgccatcatgcattgttttttgacttcttaatcatagccattctgactgatgtgagatggtatcccattttggttttgatttgcatttctctgatgtttagtgatgtgaaacattttttcatatgtttattggccacttgtatgtcttttgagcagtgtctgttcatgtattttactttttaatggcattatttgttttctgtttgttcaattgtttaattaccttataggatattagacctttgtcagatgcatagtttgcaaatatttcctcccattctgtaggttgtctgtttactttgttaatagttacttttgttatgcagaagctctttagtttaatttgtaactaaattatcaattttaagtaacatatcaattttttttcattgtgattgcttttgaggacttagtcatgaattctttcccaaggccaatgcccaggatggtgtttcctaggtatttcttttgcaattcttatagtttgatgtcttacatttaaaactttaatccatcttgagtgcatatttatatatggtgaaaggatggggtccagtttcattctgcatatggctagcctgccatcccagcatcatttattgaatagggagtcttttcccattgcctgttttttgtcagcattgtttaagattagatggctgtaggtatgctgctttatttctgggttctctattctgttccattggtctgtgtgtctgtttttgtaccagtactacgctattttggttactgtagccttatagcatagtttgaagtctggtagcgtgacgactccagctttgttctttttgcttaggtttgttttggctattcaggcttttttgtttccatataaattttagaagagacactggtagtcggataggaatagcattgaatcagtagattgctttgggcagtatggcctttatttttttattttattttttttttgagacagagtctcactctgtcacccaggctggagtacaatagtgtgatctctgctcactgcaagctccaccttccgggttcacgccattctcctgcctcagcctcccaagtagctgggactacaggcacttgccaccttgcctggctaactttttgtatttttagtagagatggggtttcaccatgttagccaggatgttcttgatctcatgaccttgtgatccgctggccttggcctcccaaagtgctgggattatgggcatgagccaccgcacctggcccagtatggccattttaacagtattgattcttccaatccatgagaatggaatgcttttccatttgtttttgtcatctatgatttctttcagtagtgttttgcagttttccttaaagagatctttcacttccttggttagatgtattcctagggatttaatattttgtggctattgtaaatgggattgcgttcttgatttggctctcagcttgaacattattgatatacaaaaatgctattgatttttgtgcatttattttgtatcctgaaactttactggtcatttatcccttccagaggcccttttggaagagtcttcagagttttctaggtgtagaatcatatcatcagtgaagagagatatttcgatttattcttttcctatttgaatacgttttctttcttcctcttgcctgattgctctggctaggacttccagaagacagtttttaaatagaagcctctaaacatacctggtcttcattaattcctctttggaactgggaaagagatccctgtggctattaaaaagtggggagggttcttatacaccactaattatgaagcaaaaggtttatttacttaaaatgtcatttaaagatacttaaactgcatgcaaactttatttactgtacagagttctggatgtatttatcaaacagaaaaaccacccttgacttggttgttcacctgttttgtgatttcccttgaaaagagaaatgaattgtcatagctattgatattttactaggtaatgttctgttacactgaaagggatgtttttaaaaaacattatttggaaacaagttttcaagtagggggacagttgcttacataatatcttgtatattcacatcctaaaaattttcatttatgagtatgggatgtgtatatatgacttagccccaagttaactgtgctgattaacaagtacttataaaaatagctaaaatagaaaattaatgatcagttgtactagaggaacatcatagaagagaaaaatccaactctttatattaaaaatgaatacaataagaaaactgcaaaagagaccaaaatgaacgtgttttgtaaattgttacaggagcaaaaacttctcaactagttttcaacatactttagatttaaatgttgtttggacagttttgtcttcaacttggaccagttgtagattgttacaggcttcctaggatttagcattcctattttctctaccaaagtttttttagaagcatcccaactcttctctttgttgataaataagcctttcctgtcatcttcattttaacttgctaaaaccctagatacaaaagtcctccctcatttttcccacgcagcccctgtttgggaatttgagattctgggtcatgctggtgttcctttcagaagtgcttgaaattgagttctcttagccactggacacctagttttcagaagaatgtcccaagattgtttatatatacaaaatggcaaaattactgtttttcgaattgataattcaagcaaaaggcttctctttaccatcactggtttttttygtttttgttttgtttccttgtttctatttccttgaagctttgaagggaggagaagcagaaaattttgtttttgttttttaaaaatcagaactacttaatgctttttgccacagcatatttccttgcctgttggagctgttaggaagattacccatgtcctaatcttcaacctgagaagatttttgactcttgtgtctactgttgattattttcttgagttctcaaagacctgtggccaggtattttaaaaagtcatctgtttctttctagttgcatcaacttgcacactggtgtctacctatatgtggtattcggaacttawaattcttattgagcagccattgcctatattttctcagctcctcactgacttctttatatgagctcagctgacaagcgaatacagctatttggttgccctctcttcataytggaccatcaacaacagtgttctaactcatccatgatggtctgtgagatgcagactattacacaagattcaagttactcgtaagcaacttttagatagagttggtcctgttaggaggagactcttgatgtcaccttcagtatcttgaaagcgggtcccctcccgaggctcttaatttttggaaaacttgatgctgtttcagctgaaaaattagcaagactgttaaaaaaacaagttgaggggagctgtttaagaaactgaaaagtaattgcaaactacattgggtaattgtgactttcagttgttgttctgtatcagttgaatttttgtgctcttttccctgtgtacatggtggttctatctccaataaaacttttgttaaaaaaaaaaaagtgaggagaatttggaatctgttcatagggttttttaaaatggaggtctgatctaattaaaaatgacttctgagatgatatcaacaagtacactaaaatttattgaggggttgatcacagaaatgctatatgtttcttttagttaaaacacgtgggggaactcttcatcagagatgaatccaacctaaaaaacacagaaggaaggataaatttagaaaaatcatcatttttgcagccattcaggtaggaccatagattcgggcaaggatcatcaattaactttaaaactactgggtaaattatttgggaaagtaatattcacaggatcttaaagtaccatgccatctttttattaactgcatatgaaaaacagaaccccaacaatggagagacctagcagatacaggcttacaaaatgtggaccgcacatatgatgcaatggcacgtatataacatcacctatgtaactttcttgccaaaaacacataactggaatctaattgtcaaaaaaaaattctaacaaaaccagactgagcaacattttacataacaaggggacaggacttttaaaaactgtcagtgtattaaagtgaaacaaactaaaaaaaactgttcgtgatgaagaaggattaacaaaacaagataaccaaattaaaagcttgttccttgactggactacaggaagtccatcaaaaaaaagctataagagatattttagtataactgggaaaatgtagttataagatattagataatattaatgtattgataataattccttgagtgtgaatgttattattattatgtaggagaaagtccttgtttttgggaattatatactgaagtacttaggtgttaaatgtgacagattagattacataggtagatagatgatagataaatgcagataaatgtatagattaaaatgtagatgtatgcacatttccatatattatatgtatactatatacctacacacacatatattcattctagaaagatattatgctacataatagttgctacagattttctaacactcccaataatgtggagagtggggagataccatataattgaatacatgatatttcttttctttcctcttttttttttgttttttttgagacagggccttgctctgtcacccaggctggagtacagtggtacgaccatagctcacagcagcgtcaacctcttggacaccagcaatcctcccacttcagcctcccaagtagctgggactacaggcacatgccactacacccagctaatttttttattttttgtagagatagagtttcactatgttgctcaggctggcctccagctcctgggtgcaaatgatccttccactttggcctcccaaagagctgggattacaaatgggaatctccacacctggccttttctttagcaaaacattaatatttatacaaagtatgataaataaggaaaataaatacattcactccacgcaagtaaatgtttagccaaatgaaattacacccaccttaaatggtttttaactactcaggcttttaatattacataattgagaatgagatatttctaaccctgtattacagaaaattaaacaatcagatatgtgttctgtagcacggtagccatgaatgatccatggctatttgtatttaaatttaaagtaatgaaaagtaaataaaattttaaattcatttcctcagttgcattcattacacttccggtgctcaataggtacctgtggctagtggattccatatggcacaatacagacattcagaattccctcttccctataagatggcaatagtgatttcaaccttatcaaactccaatcctttttcctctcaaagttaaattttcattattttatttctttataatggcaatatgtactcgcttcaagtggaatggagcagcttgcagaatagcaactaaaaagtctcaataaacacagaaaccatgtgttagaaggcactggaaaagatgttgagacaaaaattactcaggcttgcaggcatgggggaactcagagaggttacagtcaatttttgatggctacagtcaatttttgactgtgtttcgtatgtttattgtggcactattcacaatagcaaagacttggaaccaacccaaatgtccatcaatgatagactagattaagaaaatatgacacatatacaccatggaatactatgcaaccataaaaaatgatgacttcatgtcctttgcagggacattgatgaagctggaaaccatcattctcagcaaactatcacaagatcagaaaaccaaacaccgcatgttctcacttataagtgggagttgaacaataaggacacagggagggtaacatcacacaccagggcctgtgggggatgttggggctaggggagggataacattaggagaaatacctaatgtaggtgacaggttgatgggtgcagcgaaccaccatggcacgtgtatacctatgtaacaaaactgcacattctgcacatgtatcccagaacttaaagtataataaaaaaaaaattgaaaaaaaattttttttgactgtgttgatatctaattctgaatgaaggtagaaggtgttgcataattctgtctgcctagcatgggagggatgaaccctttctggaagaagatgaacctcatctgacattctgcattttttcatacatcataactggcacttaaccaaaatttatgagtcactccaaagacagaactaagtgagcacaaaaagaatagagaagggagaaaagattataaaaacaaccacaatacagaacattatcttccttattttacgaagccaacatttcctcaatatcagaaatctgacaagaaaattttgaggaagaaaaattgcaaaccaatgtctcttgtaaatataagttcaaacaccctgaaaatcatagcaaataaaacccagctgtgtatgtctctgtgtgcacatttgtgtgtattttaactaatatatatattatatctatagacaggacaaaatatatggccatatcgattgatgcagagactccatttgatcaaattgtatacacattcaagaccaaaaaaagtcatcaaaagtagaaggcaaccttctctaatctgattttttacttatgaaaatatacataaaacatcattctcactggtgagatgttaaatctccacccatcctgaacatcatatatgaaacaaggatgcccaccatcatgatttattcaacgctgtcctggaaatcctaaccagtgaaataaaacaataaagagaaaactgagttataagaattgaaaaataagaaataaaataaatattaaaagagaacacagaatacatagaaattacaaataaatttacaaacaaaaaattagcaatgccaagtaaatttgcttgatgtaaggtcatcaaaataataaagtcaattatatttccatgtaccagaaacaaagaaatggaaaaggcattttttttaaagtatattatttaaaagccaggtgcagtggcacacatctctaatcccagctactcaggaggaagaggtggaggattgcttgagcccagaagatcaatctgtgcaacatagcaagactctgttttgaaaatatatttttaatattatatatatttatttcatattatatatattttatattatatattaaatacacaacttacaattacatagaaatatcatttcagaaaaaaaacgtaatacatgagaaagccactgaactgaagacaaaacattactgacacaatagaagaaagcccaaataaataaagagcataatcatatccatgaattgaaagattcaacctgtcaggacatcaattatttctaaattgatctaaagatttaatgtcatcatgataaaaatcccagcacagtgttttgggaaattgacaaaatgatactttcaacacttacttggaaatgtaaacacctgagaatagccacaaaaaaaaaatactaaagaagcagaacaaatttggaagacatacactgctagatactgagacctgttataaaccttcataggcccaaactggaatggaaacagcagagtccagaaagctgccccacgtatgaattttacacttctctcatcatgtgttgttagaggattgggactatactatgaatttggggacttgaagagcatggagatgtagtgtaggagaaacaagcttaccttggggatgaggtagtttttgaatttaacatcacaggtcactgcatggggcaggttggtggggaggaggtcaatgtatctctggatctcgtgcaccacagcatctgtgtagggcatgtgactcctgtcctgcatacaggggctccggtttctgccaactacacattcaatctcttcctggactttagctgataagacacaagtaagaaatgatggaaaaggaggaaaatggcacatttgttgtagcaattcaggttacaagaagcataaggaaggggtcccaacatcattataaacttataggactgaaagtacacctagacttagggaagaaattactacattatagatacatccaactctcctacaagctaagtattaagataaatctgtaaccacctacatattagcatacaagataatcagtacaaatataaatgataaaatacttcaaaatataaatatttagtacattataaactcaagaaattactgttcttgaagaaagaaaaaaatcaaattaatgttgtatcagaataacatataatgttttaaaactttaattctactaacagatctatatgtatggatggatttgtgtattgtgtgcatatgtttatttgaaacttgaaatgatattctctctcatcctcacactccacaaaggtgactatgttgaaacattctagaagtttcttctgaagtttatattcatatttctaaatactgactctctttttattttttaatttatctttgaaaatttctaaaacctcatggtaagaaagatgaggacttatatctccatcatcaccccataacaaatagacacacacccacaaacagaaacatgcacacacattcacacttcccccactctagtttccccaatgtatttatatcacatttttattatattaatactcatgttcacaccattattatttcataaacattgaccacaagtgggacagctgtaattatgtctcttttttgtatattcttggacttgtgtgtccatttcaattctaattttcatatgccaatttagaattactgcaaatgctcagaaatgtttcaaactcttactaataattttctaaacactaaaaataatcaaataatcaatcaacttttctttgcccttaatgtcttccctcacacctccatgatccacctggtccattctaaagcatttgttttctagacctggtatccagcagcctccctgacacttccatcctcctacatgagatctcctgatccctgcagcccatgatttcccctgaattggtttcagacatttggatggaaaatattctctagtatctttctaagaaaataaacacaaagggcaaaaattttttgccaaatgcagatctgaaaatattctttatctacaaatacacaagatgacagctgctcttgagaattctaatgccattctgattcctgatccttcacaggtgacctaatttatctctgaatgtttttatgactttccctttaactctgatgttctaaaattccccatggtctggtgtcttggatgaatattttccatttcattcactttgctggacatttggtaagaattttctatctaaatggtgaaaaatggaggtctttccactggtgctacttgtcctctggagtttacacctggctgctgtattttaggaacaagatagaaaaaggcgctaaaggccttagaattcaagtggactcttacttaacccctcactctttcccagtctctgtctgttgtccatgagtgagcctctt

SEQ ID NO: 17877 - DNA, 12795 bp, Homo sapiens
atcaaaaattcacagtgaactacttaatggagtgaaaaatgtaagttttcttttagtgtataaaaatcttattttaaggccagcacagtggctcacgcctgtaatcccagcactttgggatgccaaggcgggcggattacctgagctcagaagttcgagaccagcctggccaacaaggtgaaaccccgtctctactaaaaatacaaaaattagcagggcatggtggcatgcacctgtaatcccagctacccaggaggctgaggcaggagaatcgctggaacccaggaggcagaggctgcaacgagccaagatcccgccactgcattacagcctgggcgacagagcaagactccatgtcaaaaaaaaaaaaaaaaaaatcttattttaaaaacatgttttcaaagaagaaaaaactactcaacaaaacctagatattgtaatatcctatatattaaggctctaatttaagaaaatgcaatatatggaaagatagcagatactttaaatgaaaaaaaatttgcataaataatggatatagtatgcaactatttctgtatcaacttaacaacaacaaaaaactgcaactatatatctgcacagtagtagggtcagagaaaggaagtctacataaatgccaaaataccaacagtgatcacaactgaggtacggaattagaaaattggagtccttttcaatttatatgcaacagtgttgctcaaattgatattgactacatatcactcttttttaaaaaaggtggaaaatatgtaaaaatttgaacttatgtaacagataaatcaaaagagtaaaaattcctattacaaaaggagccattattttgccaagtgatttgctacagacttttatttcctcttaattttctgaggggagaaaattctaatctaatctaaccactaaattatatgagagactcatctatctcacttaaatgtactatgaatatattataattaagactttaacaaaatagggttagtttaagaaacaccttagctcaatggataaaaatacttgaatactgataaacaaattaaaggaatttagcagaattaaaggaagggaagaagatggaaataacgggcaatgctctgaagccttaattaccctctacctcactgctcatgaagaggaaagtttctgttcacctaagatctgtagaaagcattctgactctcaatggtttcctgctatcctaagtcttcttggaggattaaaaatgggtacaaaaatctttcttgatctccttaaaaaaaaaaattcatattaaatacctagatcttcaatactgttgaatgttacactgagtctggtctttatttcctagtaaggagttccagaaaggtattccagacttaaggatgtgtttgcagacaataatttgtaaactgcatagaaagcaacaaggggcactggggagagggatatctgttggggaaattataatagtctcggctaaaaagtaacaaagacctcaattagcagagtcaacatgaaaaacagaaagaaacatttgcataggattataagaggaccaggacgtcagaaaaccaggagaacaatattacacacaaaaaaggcaaactgctttaaaaaggagagtgttattataagggaaagtgccatagagagtgttattataagggaaagtaccatagagactgaacaggatcaaagattaggaggagataatgatctgactgtggagactctaacctaggacaaacagccttcttcaaaagaacttttcctctttaggatgaaagggaagtgaaacacagtgagtactcacttcagagagcactagaatggccagaacactcagaatatattcgatccattcttgttttattctgaatataggacaagaaagccaggagcaaatcctacatttcaattattccttaaggtcctcaagaataactccaggattttcttggcctagcatcaatattccctttagaggaaaacaccaatgatgttctttaaactctatttgtctatgcttgttttgtgtttgtattggtagaagctttttttttttttttgaaacggggccttgctctgtcatccagcctggagtacagtggtgtgatctcagctcactgcagccccaacatcctgggctcaaatgatcctcccacctcagcctcccaaatagctgggactacaggcatgcaccaccatgcccagctaatttttgtattttttgtagagacagggattcaccatgttgcccaggctggtctcgaactcctggcctcaagtgattctccaacgtctgcctcccaaagtgctgggattatgggtgtgagacaccatgattggacaagaagcatttattttaatgtttaaaattataaactggccaggcgcagtggccaacacctgtaattccagcactttggaaggccaacacaggtggatcacttgaggtcaggagttcgagatcagcctggccaccatggtgaaaccccgtctccactaaaaaatacaaaaattagcctggcatggtggcgcacacctgtaatttcagctacttgggagactgaggcaggagaatagcttgaacccaggaggtggaagttgtagtgagccgggattgcgccactgcactccagcctgggtgacagagcaagacactgtctcaaatagtaaaataaaggcttataaaaagtaaaatataggcttttgaaaacttcttaacatatatatttaaaatgcctttaaacaaaataaacagaaaaaagtactaatgccagtttcctcaacaataaaatgaaaataatacgtaacttactgagcagttatagggattaaattagatcattttatatagaaagcgcctacaatagtccttggaacacaatacaggctccactgtgtttgtaaggtgaccttttctaagctccttaagactgaagtcatgtaattagtaaactagacagaattcagatgaaagagtcattttatgtttgcttgtttacttatcaatcattaaaagtatatgtcctagccaggcatggtggtgcaagactgtagttccagctacttgggagactgaggcaggaggactgcttgaacccaggagtttgaggctgcagtgagttgtgatcacaccactgcactccagcctggacgacagagagaccctgtctctataaataaataagtaaaattttaaaaaataaaaataaatagtatatgccctgtttaagcaacagaatggggtattaaaatattaggagaattggtttctgcttttaaaaatacactagtctcaatcactgaattgattatataacatcatgcttgacttgaaccaaaactaggtggaatttgaaatatgttaaatatgcattagaaggaaatcgtaaataacataaaatacataagttgttaaaaaaaaaaaaaggaaatcattaccaaaattcatcaaccattaaatccttaccttgttttgacaagaaatggctgcagatcctgaaggatattccctgtttttcgcctaacttctaaatacaggtttggtcgatcaaaaccagtacaggtgatctgaggatttctcagatttaagcaacgtacaatgtcttcccggattgaagaacttgcagtagcagtaagtgcaacgattggaacctgaatgatgtaaaactgatattttaaaaaggaaagagctcattcattcccaacatgtctatagctttcttacaaagagactggtaggacaacagtttgtggtacaatgttaaagacacaactgtaaaatttttttgcaaagaaaaaatctccctactaacttgtttctcagccttctggatacaatatttactttttaaaaatcagaaatcatttaaataaaacattaaatccatgaggtttccaaatgccatttactttgtcttattaaattaagcctacttgttagctatctacttctccatttattattttttaacattacatttgaaatggtgctgatataagcaggggggtatattatgccttatatttgattaatgtataattacaaatgataaactctcaattcactgaaaatctaactatataaagcaatggtcgtttttttttggcctcctattttaaatatataggtttatggcttcacaaatctagaagcaaagctccaatgacccagataacctctcttcagtggtactgagataatcaataacatactatatataggaaatatgtataaatgaaacgtattattaattgattgctagcaaaggcttcttgactggattggcagacagagcaggagactcagcagttatcaggaaaagcatgaatatgtcatcttccagaaattctaaggtacagtaacaacatgcctcccctaaaactagaactcgtgtttttattctattataggaaattacacttaactatggtattatttcataatcagaaaaagtggactgtcttacagttgtttctaaattatcagctgttctatcaccaagaatataactttcttaaaaatattctttttggctcgtgacagatacaagaaacaatattctcataaaatagctcttcagatgcactgcatctattatacaaaccaaccatagcaattatcttgtatataagtggaaatgtatgtgcaatttaccaatttgcaaagaagcacttctagaatatgactcaaaattaaaacaagatcaatttattaaaaattataaactactttttcaatcactataactttactgaattaaaaattatctccaaacttatatttaaaaaaatcaattaagtttaagagtaggttttttcaaattaaaaaaattaaatcaaaactaatgtgatgagataattggcatcatttttgcattctttatccttaaattttgtgacactattttaaaaggcaaccccaaaattaatttcattgatttgtggcttacaatcagattgttctctgaatttacagtgcctgcctagcaacttaaagatgaacaagctaatctataaagaggttggtttctctaattaacccctaacatgggtgcatctgtgttaacacacaggttttaacaaatataaggctgagaataagggaggtttaaaaattagaggttcttagaacatgcacattctcactctcacagtaaagcactttcaccggttaagtgttttggttaaataatttatataaatgcactaataaaacacttgtttaaccacatattaaaaacagtgattttcaggatacagtccataagaaaacagggttgggtttgtttctaagcaatataatgtataagtgagcaggtaatatatttatgaaaatgaggaagtaagcatgaaacatgacatatatttaagaagttaacagaaaaaccaggcaaaagaatggcagcacagtgaaaaaagtctgttttggaatcagattgcttgagctgaaatcctgtttttgccacttactagatgtgagattttgagctctttatttaactctctaagcttcagtttcctcatctataaaatggctacaataacagtgccaatctcataaagttgtgaatatcaagtgagataaaacatgtaaagtgctgaacataatgcatgaaataaaatatagtaagcactcaaaaagtttcaactatcataaatattgttattaaaataaataaaaagaattctatataacaacttcagagacatgagtactactcccagatttgcaactgacatttgcaagggctcagttttttcagcaaaaaaaatgagatggagacggctatatgatgtgttagacccttccaacttaaaaattcccatcttgctaccagaaattccctattccagcaatctggtaacagtgaaaatcactataaatttactcttttgcctcaacattctagaaagatatagctaagaatgttgcttctacaattagaaaataaagtatcagactatattaaaaattaatagtacttcgttactactaaacragctagtacttcgttttcattggatacattttcagcatcatgagttgtcacagcctctgagcccctgatcttaagccacaagggctgagtgtattgtaaacttattcttgcatgttgctgtctgggaatagaccacactacagctggtagttctgggggcggtactgccgaaaggcctgaacacatgtattttggctgcaattraggaacttgggatgctgactattaattttgtatttcagcaactgccccttctcctatcccaaagaaccaattactgccctctgcctcagcagtaccagtataagatgacattccaaagactggaggcaactcagcctgagttaattcacaaaattgtgccatgctggggcttgaacttgagcttgggcttaggcttgggctcagcttttgaccctcaggcatctcctttcccttcctgccttcctctcccttctcctctgctgcagcatgattttcttaatcttcagacactcactattttcatgaacarttaccctccggccccacaaccaaagacaactcatggcctcctttggcccttgtgtaacaytgcaaacctgtggctttgcaaaatgyacccaggtcacaaggggatttttttttttagcaatgatatccctttctgggtcactttttaagcttataaccagacttataatcttaaatgtatttttcctttgattaagctgctgcttcctctgtttcactggattgtgctagttatcagtggttcttgggttcaaagtaataagaattccaaaactggaaaaaaaaataaataaataaaaattaatgataaacttccacttcagcaatgaatagaaccttttctcttataagtatgtggtattttatgacatttaaaatatataaactagagtgaagcttaaaaacaacacacaggcaggctgagaaaggtgacaatacatcctcatttgccaggacattcccagtttatgcctgcagtcacagcataattattaatagcttgaactctttaattttcagaagcaaactgctttgggtaataaattatactgtcatttagttcttaactcacaaaatgtattctttaagttgacaggtcttaatttcttttttaacaggcagcaagttttgctaaatcaaacaaccaaatataaattaatcttagacatatacttcaatggtgtggtgcccacagactgagaaaagtataagtatcccacctgcttctaaattcaggtcatgttgctaattctaactttgtactccataacatcacacatacttcattcattcatgcactcattctaaatagttactgagtacctactatgtgctgatctttgtaatagatactggggagaaagtaatagaaaaaccccacatgtcttatggatttcacaattcctcttacttgaaatgtaaagaactttaagactgatgcaaagctttctgcctggctgttctttctcaacactcactttgtctgattccttccaaataggaatctttgtgccaaacagcttagtgatttctgctgtttttgaaattactgaaataatatagtgtgaaacattccaggtttatagcagttgtcctagtataactggaatcagaaggagaagaaaagcaccaagaacagtgagaaaaatgatactactataaccaccaggtggcatgtctcaccacttagctaataaagagggttcttgaaaacaccaggggaaaaacgttttctcagccactgctcggccaacaccctccccgcactggaggcccaacagaaggaatgtgctttattaatcctcccaagaaatgaaaatgatccaatgacgtccatggccagacataataaaagatttaattcaagcttaacaatgtttaagaactgtataaaatatttaaaactcctttaacacaatccttctagaatcaaaggcctaggaaaggattacagaaagtaatcttcctagtttccaaaagcttactttaaaccattctaaatggaatggaaatcggtcctccaggtgcactgtgcctagtgactttcaccacagaaatcccttctaaacatgtactactaacactgttcatctttttatattatttgtaccacttcataataccatatttcatttggtgctattacttctactgttataggtatgaatctaaactcctttactgaactatgagctacctgagggcagaaattatgttttatgcctctttcaaatcatttgctttagaaactagcaggatgttgtatggtgcagctatttatggcccaactctatactgcccactacctgttttggaaagtcactttactgattctcagctttctcatcatcattcattcattcattcaccccattataaattgagcacctcctataagccaggtattgttccagattttataaaccaaacaatcaaaaactcctccctacaaagaatattctagtgaagaagaactcacagaaaattaacaaaatataacacagtaagttagacagtgatagtgctatttttaaaacagcaaagatttacgaggaatgctgaatgatgggggagggggaactaatctgatatttcaaatatggtggcccaggaggcctaaatccaagagatctgagagaagtatgggagaacatcctatagacaatgtgggggaaacgtattcagggagaggaagcagcaggcgcaaagcccaggcactgaagcatgcctggaatgtccgaagaaaaacaaggagggtggtgtggctgcatccggtgaatgaggagaccagtagagaatgagatcagagggaaaatggaaggccagattacatgaggatcggtaactcatcataaggacttttgcctttatttagaatgaaatggcatgctactagatggttctgagccgaagacatgatctatcagacttcatttttaaagtatcactctggacgctgtgttgaaacagaatgagggatgggaagagtgaaagcaggaggccctaaggagatggtggcccgtacctggggaatggcagggatcaagagagaagtgatttaattctgcatatattctgaagacctcacgagatttccttactgtttaaataaacagtggagtgtaagaaaaagagaaaagattgaggaaaattccaaaattttggccaatggagctgctgttaaacaagatggaggagagtgaggaaagagcagatctggagtgctatgcagaagtcaattaggaagaggttaagtttgagatacctgttggtcatctcaccagaggcatgttgagtagttatatagatgtgtgcctgtgtatacacacatatatatgtacatatattctattaaatggctaaaatgaactaatagtgacaacaccaaatgctggcaaagaggcaaaaacaactgaatcactcatatactgctgatatcagtctatgatggagataaaaatttgggagtcctcagtatagacttgatatttaaaactgtaggctggacgtggtggctcacatctgtaatctcagcactttggcaagccaaggcaggtggatcacctgaggtcaggagttcgagaccagcctggccaatatggtgaaaccccatctctactaaaaatacaaaattagctaggcatggtggcacgtacctataatcctaactactggggaggctgagcagaagaatcgcttgaacccgggaggcagaggttgcagtgaggtgagttcacgccattgcactccagcctgggcaacaagagtgaaactccatctcaaaaataaaaaaataaaataacataaaactgtatgttgggtgaaatgaccaagaaaatgagtgcaaaggtaggtccaaagactaaagtttctggaaggccaacattaaaaggtcagggagatgagaaggaacaggaggctgagaataaagagacagtaaggaaagaagaaatccatgagtgtgtgctgtcctatgtgactactaaagaattatttcaagaaaaagtatgaagattttaatagctaccttgttgaaccatgatactaaaatctgacccaaggccagccacatcattggagctcaattcacatggtttgattttccctcaatataaacttgctaactagtatatttaatttatttttggtttgttctgttttaatatctgctccaaccaaactctgtgagataagctaacaaaagatactatttttgagatgcctctcaatttgctatctataagcaagattaatgagcaatgaaattgaactagacaacctaccaaaagaataacaaacaatttctaacacagtttactcacaaaattgtgaaatcctgggctcagaaggcaccattgcctcgctactaccaagaaaacttaaacataagccaactttattcgttcaaaattaatataacaggctagagaacccagaaatagacccacacaaatacacccacatgactttcaacaaaggggcaaacgcaatttaacaggggaaggacagcctattcaacaaaggatctgctgcaatttaatctattgggaaaacaatgaaccttgacttaaacctcacaccttatacaaaatttaactcaaaatggatcacagacttaaaacataaaactgtaacaattttaggaaagaaccacaggagaaaatcttcaggatctagggctaggtgaagagcacaatccataaaagaaaaaatgataaactggatttcactaaaatgttaaatatttactctgtgaaagacacggtaaaaagaatgaaaaggcaagctacaaagtgaaagaaatatttgaaaccacgtatctgaccaaggactcatatctacaatgtattttttaaactcttaaaactcaacagaaaaaaacaagcactccaattatgtaagaaatttcaccagaggcaaattagtatatgaaaagacgttcaccatcattagccatgagagaaatgcaaattaaaagtgagataccactcgacacctatcgaaatggctaaaataaaaaacagttgcaacaacaaacggtggcaaggataactagatcattcacacactgctgacaggaatgtagaatgctacagccactttggaaaacaggtttgtgacaattccttaaaaactaaaaatacactcctggacatttatcccagagaaatgaaaacttttatattttcaggttgtttaaccattcacccattaaagaatctctgaaggccgggcgcagtggctcacgcctgtaatcccagcactttgggaggccgaggcaggtggatcacgaggtcaggagatcgagaccatcctggctaacacggtgaaacgctgcctctactaaaaatacaaaaaattagccgggcacagtggcgggcgcctgtagtctcagctactcgggaggctgaggcaggagaatggcgtgaacccaggaggcggagcttgcagcgagccgagatcgcgccactgcattccagccagggtgacagaaccagactgtctcaaaaaaagaaaaataaataaaaaaaaataaagaacctttgagatatgaacaaatgttcatagcatctttattcataatagtcaaaaactggaaaacaacccaaaagttcttcaacaggtgatcagttaaactgtggtacaaccatactgtggaatactctgtaataataaaaaggaacagaccaccaaaaaaaatagtcatgtggtacttaacggcatttctgtcaatgacagagcacatgtggaacagtggtcccataagattataatggagctgaaaaattcctatcaccaagtgatgtcatagccagcataatgtcttagcacaaggcactgctcacgtttgtggtgatgctgctgtcaataaacctactgcactaccaggcattaaaaagtatagcacatacaattatatacagtatataacttgatgaataataaacaagtatgttactggtttacgtatttacctatacccttttccattattttagagtatactcctcctacgtattcattttttaaagttaactgaaaaacagcctcaggcaggtccttcaggaggtatctaggagaaggcattgttatcacagatgacagctccatgagtgttactgcccctaaagaacttccagtgggataagacgtggaggtggaagacagcaacattgatgatcctgaccctgtgtaggtctagtctgatatgtgtgtattttagtttttaacaaaaaagttttaaaaataaaaataataaaattttaaaataaagccttatggaatgcattaatcaaggaagaaaaaatttttgtacagctgtacaatgtgttcatgttttaatctaagaattattacaagagtccaaagtcaaaaaatgttttaggtttatgaattaaagttacagtaaactgagattaatttattattgaagaaagaaaatttttaaagaaaattttaaaaatttagtgtcgcctaagtgtacaatatgtataaagtctacagtagtgtacagtaatgtcctaggcctttacattcactcgccactccctcactcactcagagcaacttccagtcctacaagctccattcacaggaagcaccctatacaggtataccatcttttatcttttatactgtatttttactgtgccttttctacattagataagtttagatacacaaatacttaccattgtattacaattgcctgcaatattcattacagtaacatctgtacaggtttacagcctaggagcaataggctctatcatatagc

SEQ ID NO: 17878 - DNA, 14341 bp, Homo sapiens
tcaagtgaaataatggttgtgaaacttcccctaagaaggcttgagagcttaatgctctcctcttgcaagtgaaagatacctcagtatttgttaatatatttttacaaaattccaatgtcttattagaggataagtgatgcattgcatatagaaatttatgaaatatttattttctacatcttataatctgtccagactgttttgatgtaaaagcttgcaacattaatatattttcttcaatattaaacttcctacattaataatggtgcttttttattatggggaatttctaaacttctaaaaacataaaaacatataggtaataagtattttttctaacaccactagaaccattagcttatcatattttggtttaaacataaatgtggctctcataggttaagaaattccttttgatagcataatatgagccatagtatcttggtcctttaacaacactacgtaacattcctatcttagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggtaaagaattatatgtctgtcttaggttaccaggtataatttgtattactcatatcacctaaaatgttttcattaggtaagagcattctgcatatctgagaggtaattctcatcaatattcagcagaaaggatgttgaattctttctgagtagtaaatgaagtctcagaaagtccatcaggggttccaaatcaaatggtaggctgctgattaggagagtgagggacccactccattgcttccacctggcaacacatggtccatatattaactctccttacatctgatgtagtatgagttttaataatggccactgtggactttttcatcacattagaattaagacccagatccacgagtcttcttttccttgttcatttctccttcacctccactcttccttacacaccactcccaaactgggatgatgttctccccagaagttttttccccaaatatgtacacacatcttccctcccctccatggcactttcatttccacttgtccagtccatctctcttagagaccaaggtggcatccatccctttgggaaagggaaaaaggtgcttacagccaactccatgtacccccaagccccacccccgcctcagccccctgctgggctgacgggcagacgagtatctcttgacaatcttgaaaaggttagagatcaatcaatagcttgtgaatatgaaggcctcattgacaaggctgtccctgttggggagatagatagatgcatcctgctgttgattctgaaggtcacgaaacatttaaagtacataagcaactccccttattctgaattctaagttcatcgagcaacctcctcattataatcaacttcctttataggtctgcctacagggaaagaatggctagtcatgctgacacgagcattctggccccaaagacatttttggttctcattgtaatgaaaacattggcagaaaggaagccatttcaattcttcttgcccttcttggagccctctgtgacagcaggtgctcactcctatgctttgaaaatattgatgagtttagcaatacctttacccgtaaatgcctacagcccaaaggttggagaagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccatattggatactctattaatgtcttgagatgtctggtgctttgttattttttaacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggycactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttytttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctmttagaatggtttacattatgatgggggatggggagctgggggagggctgtacattcccaaaagaaagtagtgttataggaaatccaaatgcrcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttkcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaamaatacctgtgattaaatttaatttgttagtgtaaataaatttcttgccaatgagtattattgttgttagacaacgaatgcaataaaaagaaatactgaggtctgttgaagcaattttttttccctcttccattttcaccttcaactaaaacaagccttgactgggtaaacctgtatcaattgtcaaagcatatatctgtcaatcaggagcaaagtgcacatttttcatggaaatgaaactaagtcttaactgtggtaaagtgtaaattggcagctagaaattacatttgaaagcacaattatggaactgggcataaagttaaaagagcaaagcctgcactcgaagcttcctcgcccgtcattttgttcccctgtcgctgcttcaccatcaaagtctctgatatctctcagccaggaaaacctctgtgacaaatccattaagtagtcagtctcacatagcgaggggcaagctaaggaagaatcaggaccatcgtagagtatggggttattttaaacaatattctttctaaagccttaaaaataagtgagggctattaatttcattcattcttacacacgcaaactataatttatatgtgactaagcctatgtcagtgcgaaaatttagatctgggaatcacagaatacatgaattaagctgttttcctctttttcacaatgtatgttatgaaatttctaaccaagccatgtccctttttgagtgatcttgagtatgtgctgtgtcaaattggataggcttttgtttcttcagtggaatttgcttatctatcatcaagaacaagaaagaacagaatgtggtcattttattgaagatgttagggagcctaactactcaggaaattctttctttctaaataatgaaatatgttgggggtgttccctaagcatcacactcattgataatttcaagacagtctttcagagaacccagcatcctgggctgtgagcagcatctcagaaaaattgagcccatgtagggcacgggatattatgtcactggaatcatgagtaactccaatcttgctgtgaataaagtggttttttgacccaaacaaaatgttcctgtttattacttcaagtcagtgattcttaaacaactgttggtggttctcaatttattggcaaaacattttcccggaaatgccagactatcatcataacaagtgccttagaaaaacttcgtttctggctgggtgtggtggctcgcacctgtaatcccagcactttggaaggccaaggcgggtggatcacctgaggtcaggtgttcgagaccaggctggccaacatggtgaaaccccgtctctactaaaaatacaaaaattagccgggcatggtggtgtgtgcctgtagtcccagctatccgggaggctgaggcacaagaatctcttgaacctcggaggtagaagttgcagtgagccaagatcgcaccactgcactccagcctgggcaacagagtgagattcggtctcaaaaacaaaacaaaaacaagaaaaaaatttgtttctaaagtcactgccttaacaccctgaagaagtaattcatcatgaaggttataccttcaaatcagaaaaacaaataaatgaaaatgtgtaacctttatatatcagcttctataacaaaatgataaagtcatgttttcttcctagtcatgtctcagtagatagccaaaggggttgttgatcttttctatttatttgtttgtttacctttctattattttttttcttttcagcctccacaacaagaagtttaaatattaaacaaaaacccaccagcactaccaccacctcaacaacagtgtagtctttggggacacttttagcttcgcccatgtcaattatgggattcattctgtatccagtcatcgaagtgaacaaacttcctttaaccaagtcaaagacactcaaatgtacaatttgtgccaagatcatagagactcataattttcaggtgtgacaacactcccaagaattttaagattttcctatgtgtcattgcaacaggagaattgaaaaagcaagagtacaaggggagttggaatagttcaggttaatatttactgagaaaaagtcatatatcgaagggaaaatgggagtaagtaagtctgactgccatagtcagacttactatgtgcatggagtagaggggaacttcataatgcatatgttttctggcctgtgaactggagtccctgggtgagtactggagttctaaagacacgtgagctaaccctgctcccctgtgtcttctgaacaagacatggcaaggcagcgatacacacatgtgctttcaggcaacacatgttttagggtaagtacttttggggtcacacactgttatttaatatctgacaattgacataactgatttatccattttagtgagaaggatttttatggtaaatgaggttttcaagtattccaagactgatttgatagtgtattctcaaaaaaaagccctacacatcatatcactcccagttaaacagtgctttgatgcttcatgatgtccacatttagggtcagcattcattgttcagctaagaacactgggtcctcggaatatggcaagcggttgaaataatggcctcagtttctatggcatgggtgcaaatcggtctgttagagctcacagtaaagagctttgtgaaacactgtgccaatcagcagtttccctttgtacacagaggcaactgtactgccttgcaacactgtgccattttctgcataaacctgtgtcactttaggttcttctgttagaatgttctggattcgaagcacctgtggaagaaataacattgggttaatatttttgttaagtcacttaaaacaaccttatgcataatagggtcatcctccataagaagccatataatcttatacaatgagataaatcctattttgttccaaaattacacttaacacacctgtttcttcatttgggaacaggtgggtactgatctcaagtgatctttagcagaggtggagagtatctagacctacagggatgaggcaggaaatgcaaatgagcagcgcatcctggatgtgggacattagggagcagtggggatttcagtaaatgtggagggaggaagctgttactcagtatgatggttaatactgagagtcaacttgattggattgaaggatgcaaagtattgatcctgggtgtctgtgagcgtgttgccaaaggagattaacatttgagtcagtgggctgcaaaaggcagacccacccttaatctgggtgggcacaatctaatcagctgccagcgaatataaagcaggcagaaaaacatgaagaggagagactggcctaccctcccagcctacatctttctcccgtgctgatgcttcctgccctcaaacatcagactccaaattcttcagttttgagactcagactggctctccttgctcctcaggcttgcagaccgcctactgtgggatcttgtgatcaggtaagttaatacttaataaaccccctttacatatatatatatcctattagttctgtccctctagggaaccttgactaatacactcagcaatagccaaactgttgccatgcagtaattaaggtccgttttcatgtattttcaggtaagccagggaactaactggatgtttacacttaattcctggtttttaaaatgcagacaagaaaaaaaatgtggccctcaaaaaaccatatctgtgtaccatactcatgtgttctgaacttaacctcctgtctctaaatgtataagattttgtaagttcagtttccttcacttaattgaggagaaatgtgattgtatcaataataacagtgtagtatcatgttaagccaaccatatgaaatagccaatatctgatcattctgactgtaaaaaatagcaatagcgtgtgattcaacttagtatgaaaagcactacactgaggtgggagacctgggtcatgtcttggatcttccactcacatttgtttctcatctgtagaatgaaatgggtgggactagattatctctaaattccccttcagctctagctttctattattaagcctttatgataatatataatgacttgaagaaaggatatctacatcacaaatgtggcagacggtgaaggccactgcgtggatataaaagggtctgtgggaacgttcaaaatgacctcttaaaaacagctggcaccaaagacagatgtcttaggaagttgccatagcattaacatgtagtagttacagggaaatagttgatggtacaccttggcttagctaagcttcttgttaataaaactaaatcactcatctaggggcagtgcattggataaggaattgttactactttttgctactcctttgcagatcaatcattagaaatgaagtattttctccagaacaacaaaccaagtccatgctatagcaaatgacccaaggttactaaatgagctaacaagcaagaacaaattagaatctaacattctgctcagttctgagcactgaacactccacagcatacatttcttcaattctattaaacataccattcagcaaccctaatagctaaaaactagcaaaaggcacaaagggttgccattaaacatgatcacaattgtcctgcaaacctagagataaaaggtaagagagccataatgtaaatggaaatacacatttgtttcttttttttttaacccaagagatacgggctttaacacttttttttttcctgttgggcaggtgaaatggactcttaaaactgagctttaacaatacccagcagtagacaaatatgtcaagatgatatcatatatatgatgtaagtaataagtatccttagtagatactgaaaactcagtaaatgtgcaaatacctatattgaagtaggttgcaaattcttacttgtacccaaaatagttcactgaataaagaccgtggacaaaaaatgggacctttgagtactgtaactaaggtggaagatgagatcttctaagccagaataattccagctatttatcttgccacctgcaggaagatctagagaggctggccagtgtgctccaggactggtccattgcatggacctgtgcgtataccgccacacaggaagggggagttgaataggaaggcaggtaatgaatgattaaaccatagcagtatggcatcattatgttctttgaggatcccttaaccagaggccaagttcctgtcaggcaaccctctccacccaccaccgtctacctgttctggcttctggtattcatttcctccctcccttgctagccctggggtactgcattataactctgttgattaccctacactgtgtccacacattttgtgtatagtccgttgattaaactcccctcaaattatccaatttaagtgtgccatgtgtttcttgcctagactctgactaaagcacctccaaaagccttcatttctgatcatttggatcatctatccatgtccccccttttatttgcacatagaattgagaattggccgggcacggtggctcacgcctgtaatcccggcactttgggaggccgaggcgggtggatcacaaggtcagcagatcaagaccatcctggccaacaggatgaaaccctgtctctactaaaaaaaaaaaaaaaatacaaaaaattagccaggcatggtggcatgcgcctgtggtcccaactacttgggaggctgaggcaggagaatggtgtgaacccgggaggcggagcttgcagtgagccaagattgcgccactgcactccagcctgggcgacagagcgatactctgtcacaaaaaaaaaaaaaaaaaaaaaaaaaaaccaagaattgagaattatgttgtcaactgaaaaaacagtagctgggaataaagtcacttatctggttcatttttaaaacttacctctgatgcaggaggattctctgagtcatagaagaagattttcatgccattgggatggcatccaacccaaaggtctcctgtctcaggatccacagatatgttatccacgagggtattaaagtcaagggacttaaaagattaaaaacaagaaaagaacaagacataaagtaaaacacaattgtgatggag

SEQ ID NO: 17879 - DNA, 13243 bp, Homo sapiens
  misc_feature (1)...(13243): n = A,T,C or G, or insertion/deletion polymorphism (see Tables 1-2)
tgacagaagtcctccaagggtgaagccacagtgggaggcagcggcctggagagccaatgttcccagaaatctcaatgcccacgctatttgcagacctaccactgtcaccttaccaggtggtggccagtgccaggggctcactgcctgcacgggtggtgcactctggagggtgggtctgtatcacctgtgccgtccctgcagtgcagggtctgactctgagctgacaaaagggagaaggaatcatcaggcagtttgtttgtttgtttttgttttgttttttgagacggagtctccctctgtcgcccaggctggagtgcagtggcgccatctcggctcactccaacctccacctcccaggttcaagcaattctcctgcctcagcctcccgagtagctgggattacaggcgcccaccaccacgcccggctaattttgtatttttagtagaggcggagtttcaccgtgttggccaggctggtctcgaactcctgacctcaggtgatccacctgcctcagcctcccaaagtgctggggattacaggcgtgagaaactgtgcccggcaggcagctcttaacctagcaagcgggcatgtgagccggcaggccccggagctccccagcgtagccgcggcatctgtggaaagggagcaggccagttcccagggcgaggagtggacgccctgaccctcctccactgaaccctggaccccaatgatctcactagtaattctcggcgaagacccagaagccccttccaaagagccctctcctaacagctcccctgtggggtgactggagaagctggttgtaaaatcaggagcaggtttctgccccaacgcctgccctgagttagttcctgagctcaccgagccggagaaggcccgtgaccagccagaagcacggagcgcagggcaggacagccggcctgaggccggtcaggagaggcggccctggcgctgcgcggtccaggacgagggagaccaggaggtgggggcggaatgagccgcgatggggtggcggcaccacgtggactggccggtcctccgcggggggcgcgttccgagggctgagggcggacggtggcggagagcccggccgtgaccccctccccgcagtgctgcagttcggcttcgtcaccatcttcgtggccgcctgtccgctcgcgccgctcttcgccctgctcaacaactgggtggagatccgcttggacgcgcgcaagttcggggggtcttctagagcgcaccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtgggcaggggctggggggaggttccccgcggtaagggacggagctttgcggggctggagggcaaatcgtggattctaggtgaattgctagttggtcatagtgtagcaggacgagtcgcagacagaactcctcagacaccggattaaagaaggaagaggtttttttattcggccgggggcgtcggcagactcgtgtcttcagagcggagctcgccgaaaaagaaattcttagccctttgaagggcttacaactctaagggtctacgtgaaagagtcataatagatcaagtaagcgtgaggaacgtgactgtgggctacatacatcagctaacggtacaaaaagttttacggtgctttctcatacagcgtctggaattcacacataacaccagtagttttggtcaggggttaatattattgttattttaaccgccagggccaggtggtggcgccaaggtcatctagctatttatcttctgtttctttccagctttttgctttcttccttttctcctgtcttataaactagggaaaaggggaggttggggagaaactgggaaggacaacaggagaagtggtggcctcataccataatagaacctgcagagcaggtagatgtacttcacccgcagttgtggagacttcctttgtgatctggttacaatgaagttttgcatgtgtttcaataaacttgaaaagcatcatagtctcctaatgttggagcaaatctcagcagtaaaattacgaaaccatagggttatcagtcttttcatatcggtctctctcaggttttgcttttgctctatgtattttgagctttttagttgtgtacgaattcatacttgtgatctcttcataatggatacttactttttccttttattctttatcttttttattcctcctctcctgacttctggtggatgggtaaaagtgttctggttgttttttttattattattcttttgcttatttggaaccgatggcatatatttctattattttaggggttactcatatgtttagcatacattcttttcttttttctttttttttagagactgggtcttgctctgtatcccattctagaatgcactgccacaattatagctcactgcaccctagacttcctgggctcaagcaatcctcccacctcagcttcccgagaagccagaactacaggcgtgtgccaccaggcctggctttttttttttttttttttctttaaagagatggggtcttactatgttatgttactcaggctagtctcaaactcctggcctcaagcaatgccctggcctcccaaagcactgggattacaggcacaagccaccacacccggctagcacacgttctaaactatatattatcctaacaaagcctgaatgaactcagttttgtttcctctctctgtgtatgactaggatcttcacatgccttaccacctagtaagcagcaatctctccatcttattattgttacatggagttttagttttactgttaaaaacacacatgaaaaaacattttcagtcatctgttcatcaaatttatttgtgtattttgttaacttctgtggttacagtaatttcttatgtattgccttctccgagtcttttttttcttgctgaagtatatcctttagtaattctttcagtaaaggtatgtggttagtggggtcttcacatgcagaaatgcatacacatatgtatgcatagaaatatgtatcacgcatatgtatgataatattgccatgcatttttgtccttcaaatagcggatataaaagtataggtcgagttattttctctcagttctttggaaatattattcttttgtgacttggcttttctgattggaagcattcatagcatttaagaatttttctggctgggcatggtacctcatgcttataatcccagcactttgggaggccgaggcaggtggatcatttgaggtcaggagttcgagaccagcctgaccaacatggtgaaactccatccctgttaaaaatacaaaaaaaggctgcacacagtggctcatgcctatgttcccagcactttgggaggccaagaccatcctggttaacaccgtgaaaccccatctctactaaaaatacaaaaattagctgggcgtggtgctggacgcctgtagtcccagctactcgggaggctgaggcgggagaatggcgtgaatccaggaggcagagctttcagtgagccgagattgtgccactgcactccagcctgggcaacagagcaaggctccgtctcagaaaaacaagaacaacaaacaaaacctggctgtggcagttcacgcctgtaatctcagctgctctggaggctggggcaggaggatcatttcaactcgggaggcggaggttgcagtgagccgagatggcgccactgggggggagcctgggcaacagaatgagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccccgtcttgactaaaaatacaaaaaattagctgggcattgtggcacgggcctgtagtcccagctactcaggaaggctgaggcaggagaatcgcttgaacccaggaggcggaggttgcagtaagcgaagatcacgccactgcactccagcctgggcaacagagcgagactctgtctcataaataaataaataaataaataaataaataaataaagtgctgggattacaggcatgagccaccgcgcccggctgaaagagttacgtctttgtttagttctggaaatgtctccatcttactccttccagcagtgcttctctgcttgtccattgtcgtctggaactcccactgggctgtggcctgcttccccccaagtgtgctctctgtgttgccgcagggtggtctcgtcgtcactgtctcccagtccccagtctctcttctgctgtgtctggccacttaaaagtttattccattcatttgagggattttttttccaatggctatatttttaacttgcaatatttggttttttgttttttttattttcctacaaagttgaccctggtaatagttttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggacagggacagtctctgagcaggtgaactgctgatctcacagaggtcagcaatcggcggattttcaccgtgtaagtagactgaagtcatccgtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcraaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgasgccccgaccctgtgctttgcctaattcgagcacgtggtgaggggtcggtgccgtcacttcctgctgtgtcatcttggtcaartcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccscagccctctccctatccttgtcagtggctgctctacctccggacactgagtcacatccctcttcctcttgctgcccttttttggggacaggttctttttggaacgaacggaacaaaggatgagcagcccgagggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtattgatgtccttggagttctacaagtggaacttaagtgtcaaaaagaatatgtggtttttagctgagcgtggtggctcacacctgtaatcccaggactttgggaggctgaggcaggaggattacaaggtcaggagttcgggactagcctgtccaacatggtgaaaccctgtctttactaaaaatgcaaaaattattctgggtgtggtggcgggcatctgtaatcccagctatttgggaggctgaggcaggagaatcgtttgaacccgggaggcggaggttgtagtgagctgagatctcaacactgcactacagcctgggcgacagagcaagactccgtctcgggaacacacacacacaaaaagaatatgtggttttaatgtgctttgatgagtactgccaaacttactccacagaaaaggcctctttctgaacatcctcgcctgcgttctatttcacccaccgtgatgcctggcctgagggcggcgtgcttgcttgtagcatttcttgaggatttgctacttgttcacctgcctcttaggagcactgtgccctgcctccatggaagggctcttccggcagggatgcaggctcacagcgccctggggctggacaccaccggccggagcatggcggacagcacacacggcccggggcgggaaccttggaaactttacacagatggggagctcagccattccacgtgtgctttcgctcagcacaatgcttactacaaacccacgtgtacttccttccagctggttgctttttattgttgctgtcttaaactccaaagttttaaggtgaatttattgaaacgtacgaaaatgctcagttcatacaggcttccaggtgaacaaactgttgtaaccagcacgtgggtaaaaggcaagttccacatcacccgacgtggaagctccccgatgcccacgtgcgccctaccctgtgaccctctcccatccagggccctgatgcccacatgcgccctaccctgcctgtgaccctttcccatccagagtagccaccaccttagccaccaagcagagatggaactggggactttgcatttggcgtctgccgtgggacattgcgcgagctccatccatgccgagcatccatctcagcccctcctggctgctgggctgcttcgtgtttggcttagggtcattttgcagttgtgtgctttactgtgggttgcatatttagggcccaacagaactgctgggtcagggataaacatgttcggcatttttttttttttgagatggagtctcgctctgtcacccaggctggagtgcagtggtacgatctcggctcactgcaagctctgcctcccgggttcacgccattctcctgcctcagcctcccgagtagctgggactacaggcgcccgccaccacacccagctaattttttgcatttttaatagagacggggtttcaccgtgttagccaggatggtcttgatctcctgacctcgtgatccgcccacctcggcttcccaaagtgctgggattacaggcgtgagccaccgtacccggccaacatgtttggctttaagaggaactgccatacccgtcttcccaggtggggaccagcccagtcagcagcaggaacacctattccctcttgactcttcccgttatctcctgccactcaggtgactggggtggctcctcccactcaacgcccctccctcctcctcctccagccgaggcctccgcccgcaccccccaccacccaactcagctcgtcataactcacaggccgggtccagggtgccaggaatgccactgaggctggcagagtcctaaaagggagtggcaggtgctgctccacaaggacggttgtccaccctcaatgagggctgcagggcaactgctgactgtctggcagccagaggacagggacaggcagccaccctcttgccatgaccacacctgggtctccctcaatgtggctcccgaggggccgttgaacacagtgttgagaactgctgagaaaatcacaccaaagacgaactacccacagatgccagtcaccactccagggtgacgagaaagagaacacacaggcggcagcgtgacaaaatgagtcccagcatgctacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaaacttggtgagaattaaaattgacctttgggagagggtaggggcaggatgttttatgacactgtagaaaagacaggaggaacccgctgcgatggagattggggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcaccctagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgagtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcgctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccgtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggaggagcggccgcacacacagccaggcgctaggctccctgcgggacctcgggaagggggaagagcgtcaacaatttacggagggtccagccgctgggtcagattgagacaaaccattgtgtggttgggtttgggtcagcaggctggagagggttctgttctttttgatcattatcgtttggggccccaagggagggtcttgggagccacctgagccccaaagctgggaaattcctcagagctgctcatgtcaggagcctgtgcagagagaggacacggcttcaggaggggatgctccccaactcgcaagcagcttccgacgcagttgccaccctcaggacaccaagcccgcctgcccgcccaccctccctgggacccaggagggcagaagcccgcatctgaccttctcactgctgctggcggtccagggtgcgtcccgcaccaca

SEQ ID NO: 17880 - DNA, 47941 bp, Homo sapiens
  misc_feature (1)...(47941): n = A,T,C or G, or insertion/deletion polymorphism (see Tables 1-2)
cagttctcctgcttcagcttcccgagtagctgggatttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaaccgtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaacttgaggaaattaccataaaatgtctactgaatcaatttttcctgcatttagtcttaatgtcaattctgtacatttcctctttcattaagaaaaatagcagtggccaggcatggtggctcacgcctgtaatcctagcactttgggaggccaaggcaggtggattgcttgagcccaggagtttgagactagcctggccaacatgggaaaccctgtctttataaaaaatataaaaattggccaggtgtggtggcacacacctgtggtcccagctacttgggaggctgaggcaggaagatcgcttgagttcaagagtttcaggctgcagtgagccgtaatcctgccattgcactccagcctgtgacagagtgagactttgtctcggggaaaaaaaaaaaaaaaaaggataatggtggccagccatatgacatgtacctgtagtccgagttactagggaggctgaggcagaaggattgcatgagcccaggagttcaaggctgcagtgcattatgattggacttgtgaatagccactgtactccagcttggcaacatagcaagatcctgctctcttaagaaaaaaaaaaaaaaagaaaagaaaaggaaagaataattgtttacttcaaatatttatgaaaaaaactctgaaatttttttaaatcaggaaataaggtaaatgaaatgatttttcaacttttgattatgaaatgtccaaacagaaaacttgcaaaaatgaacacccatatacttataacttatagtcaacatctaattgtaactttttcatgcctggttttagaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgaaatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggkgtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagactttttcatttaaaagcttccagtgtctggttacgtcttgtaacaccatgatgactgtgatggtgcttatgtccctggacctccagggacataagcacaacactgatgggccatgctcctccctccttactgttgctgttcaagttggggacaggagtggtgtgggagctgttgctctcttgttgagctcgcttagcttttccttcagcctaattaccacaagttccttttgatacagactagtaagagaggccagtttgtggagaaattgggataatggtgtattcaaaaagagcgtcaactttttgcttgtttccactatccctcaaaactgatatttctactttcaaatccatcctgaatcctagaaaaagagcaattttaatggtatatcttagcagatggagctctacataagaaattacagattagtccagatttccttccagtttaaaagcattgtctttctgacagtaaaaccagagaaaggacatttcaargaatgactcaaagaattagtaatgaacctcaaacagttcatctttccttgttattatgacyttgcaaatgtgtttatattttcaagaccggtagctaagttctatgaatttacaaggtgcaaaataggactttgttttctttgctccccaaatgcctcctttttataatttccagggcttgctttcatagttttcacattccaggatttggttaacaagcccttatgctatttatttgtatagtcttgtcacccttcatcttttcatgctaattttttgtttttatatagaaattttatgttcccagtattttaattaccttgtagatagatcgaaagaattataagcctcagaaattttctctttacttcaaagtttgcattgtctttttttcaacctggtgattaaatgtattatatattttgatttggctcttgttatgtactattaatgtacctctactgaaagccattagaattttttaaacaaatatttctcagaaggttaaagaccgaggagaatcctttgaaccttagagcagtgctggagacccagaggtacggttggttgagcttatgaaacaaggtgtaacattggcagtttaatttgatctttttccctttttaggtgtggaggtattttaagcagttgttcattatgagcaattcatattagtgaggctttagtaggtcagcagcatgagcaagagtgagtatttattatagcattttagatttggaaagataatttttctttttataattttgtcaaattgaaacatctttttgcaggggaggagctttactaactagccccagtggaccaggctatcatatcatgttgcctttcattactacgttcagatctgtgcaggtgagtgattcctaggggaagcctccataccagatagacaggcatgacaggagttaccacacttgtgggtggagatagatttccttattgcttaagcagatggtggtatttacttaaatgcagaagttaacgttcagagtacagttgttacaacacaagttatgatgttaaaccacctcacttacttgaaatgaattaaaggtatgaaccaggaagcttggaaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttctgcctcatgtttttttgcctggtatattaagcacaattttatgtggaaccttagtgaatgttatattttgatggcatcccgggatatttgaaataagtgtctaatcctcgaaaagtgtcttggccatgggagacaataaaataagtatctttcaatgtaacaagatgacaaaaccaggattaggctgtgaccactttcgcaagcccagtgtgatcataaatctttggattcagaagtttgtctgccatctgctgctaatttttcaggactcaggaaaattctgtgttatttaatcttgtaatcttatgtctaggcttcctgctaagtgagagtttaattataaattcttaaatcccctaggttttcttcctgtccccttttasatggcttagggaaagaattgtgtctactgaagtgaaatgtattcttcccctaatcagactgatttccatatgttgttccatatttattttacccattctttccttagttcatgccatcacttctttatctgccatctcactctccattccttytctcctgtctaaatcttgccaggcttttaaaggctcatcccagattcttcctcttctgatctatagctcttaaagtctatattgtaaattttggccctttgtcttattttctttaatattgttgtcttgcattgtttgctaagtttttttatgtgttttctttccagaaaggctccagttttcttaaaggcaggagttgtaacacatttatatttctggctttctatttatggtggaagttgttaaattgagctgatttctcaggaagcaatgtggtgtaatgaacatggggacccagcgttaccgccagttggtggcatgactttggaaaaattgcttaactgtcatagacttcagttagtcttctgtgaaaggaggaattttaattacataacctcatcaacagccgaaacaatctataataatgttagcaatggcagcattagacccttaaaaatcaagactctaaggcccggcgcagtggctcatgcctgtaatccgagcactttgggaggctgaagcaggtggatcacttgagcctaggagtttgagaccagcctgggcaacatggggaaactccgtctcttaaaaaaaaaaaaaaaaaaaaatcaaggctctaacaaatagatcttgttcaaaaccaggtagatctgtctctgccttcatgcttagtatgttaagtcatactgatgcaaaaatataaataaaggagatatagataatagtaaacagattttggagtttaattgtgtatatatataacaaatatagtgtgtgtatatatttaataataaactatcataagagatgtaaatgaaattagtacagagacttcagtgtaaactaaaatacttcgcatctacaaaaaagttttacatgggctagagccagccagtgtgactaaataggaatgttctttatgtgtaaaacggtaacattctaggaaataattatattaataaaaccatatttaaaaagtgttcttggccgggcgtggcggctcacgcctgtaatcccagcactttgggaggccgaggcaggcagatcacttgaggtcaggagttcaagaccagcctggccaacctggtcaaacgctgtgtctacaaaaatacaaaaattagctgggcgtggttgtgcgtgcctgtaatcccagctatttgggaggctgaggcaggagaatcgcttgaacctgggagaccgaggttgcagtgagccgagatcgtacccttgcactccagcctgggcaacagaggaagactccgtctcaaaaaaaaaaaaaaaaaaagagtgttcttaagagagtaagacataaatttatttttaggaatttttggaacatattagaagacatagtccagataaacaaatggtttaacaaacttggcaattgaaaggaatgtatataaatgtgaaattccatatatgatgtaaaaagaaaaagcaatggagaaattatatgaaaaccttcagccttcataaagtaaccatagattcactttttaaataaattttctgtcatactgggaaagtaatttttaagaggacataaaagaaatataaaagtacataaagatagggtgttaaatggaagatttaacatttgaaccctttcctagttcttctgagtttgaaaattggctagagaatatccttttggtttaaataggaacgtgtatttaaagttggtgtggaatatggaaactgaattaatgttataaaggaaataaatataatttgtctcttcatcaatccccttaacctagaactgccaccaatgtttactgtcattctaatgtctcaacctaagagttattttttattctttcccctcctggaattttatatcaaccaagtatcagatacctcctctattatgtctggattgacagctttcatggcctttactgaattaatctaaataaattaattatttagcctcccagctggttttcttacctccctataagatggagaatgagaactacatcacatgtgagaaaaggaattaagtaaacatatttttgaatggttcgttttgtgactgtatataaggtgaactagagagatcccaaactccccagccagcattcagggccctctgtctagtattaccatggtctcttgtcagaatttcatctttcatccaaattgtcccttstgctccaggcaagcctatctactttcgttcgcctatacacatgttgtcttcaactgtgtgtatttcagtaggatatttattgagcttaagatgttcctctgcctcatctgttcttatttctcccactctagacctggcttataaatccttcacctcagagagcttttcaaactactatttttttcactttctgtaatttaccacttaacagttcagtttataatttgtgtttttggttttgttttgttttgttttgtacctgttgatggattgattgcattgtaacattttgtctcctgtgctggattgtgaactctttggaaacagggactgtgattcctttttcctttgctttgtgcttgataagatgcagtatgtctagaatgtactcattaggtgctgacctatttgaggccttagagtacagcaggaagtcattcattctggatctgaacaaaggtgtgacaagggcaaagcaattaagtaccagattgttggttcaccaggaggaagcagtactggtggtagcacttctattaaaaaggaaactgaataggacatgtgagagatcactaggtattaaactaaaatgttgaccacagctttagagaagaaaggttgctgttggattcaagggcagctttgagtcttagagtacttgtatgcataaaatctcttttatcttcaacataaatagtaatattagcagtggaatcaaagttcagagtgcaagttgtagccagagtatctatgtgagcaagctgtgttgtttacaacccctggccagctccaggcaggtaagggactctggaagagttttctacttattagcagactgaacattgaacctttcccagtgaatcttaattcaaacattcgctgtaggccaggcacagtggctcacgcctgtaatcccagcactttgggaggccaaggtgggtggatcacttgaggccaggagttcaagaccagcctggccaacatggtgaaacctcatctttactaaaaatacaaaaattagctgagcgtagtggtgcatacctgtaatcccagctacttgggaggctggggcacaagaaccgcctgaacccaggaggcagaggttgcagtgagccaagattgcaccactgcattccagcctgggtgacaaagcaagactctgtctccaaaaaaaaaaaaaaattgctgtaaaatattttctgtctcaagtctttcatttctactagaatacaaaaagaaatgactgttctgagagctaatctttgggaactgaaattgtgatggatctctgctgtacttactgtcagcagctttccagagatttgcctctggtaccagtagttttttgacaatgtgtgtcttgagtgttgatgagatatcttttcctccctagacaacactacaaactgatgaagttaaaaatgtgccttgtggaacaaggtaagctttctctttgcctacgagcctccctttagctcagacagagtttctgttcctacagctatgatcacttagacatatctcarataggcatgatagttaacccaaggggacttctgatctgagcattgtttgagcaaaggcctatctccaaataggagcttttccatcttaagaaccattattgttcttatggtattattggaaaaaactggagttttagagcaagtagacctaactgtgyattagcactgctgcatctgctttattgactattttttaaagactttattttttacagcagttttaggttcatagtgaaattsascaaaaagtacagacagtttttatatacctctttccccaacacattcctttattgacactttaaagcttagtttcctcctttataaaggcagtaaaatctaccttgcagagttgttgtaaggattagaattactgtatatgaagtgcctaaccagaacttggcccagaataggtgcttaataaaacatagtttaaaattaatcatcccaccgtcttctcatctgtagtgttaaatgccatctaatttagagtttctgattcaataggtctggggtgaggcccgagaatttgcatttctaacaaaagttcctgggtgatgctgatactgctggtctgaagacctcactttgagaattgctgtcctaaagaggtttagggaaagaaaggcaagcagggcccaaattatttctagggtataatcactgcattgaattgtatcaaaagaagaatgtgaagttcaaggtattttttaaattacttattttaaatgactattwcaagtgtaaaaaagacattgacatctatagagggacagaaatgctatgaaaaaggaagcgaactctttctgtgttttaagtgaatattagtatgtttcattatcagcttctcyccaggtctatctataactgtgttttatggattgcctttagtagttcacactytttttctttgtttttagtggtggggtcatgatctatattgaccgaatagaagtggttaatatgttggctccttatgcaggtatgttacccatctacctgtggtttttatagttatagccagaggatttatagctgagagattctttgaggaatagaagggtactttgaaagttttatgacttcattgatcactgattaataaatttctggggaatagaggcaaaaataggtcagaagttctggacagagttgactttctgcaactgtatgagttactcttctctgagcttagtgtttctaagagcaaaatggtcattggttatttctagaataggaaagtagtattttatccagtcaggatgagagataatttccttgggtgttagaaatctgtaactgatcaattccttggcccacactgatttgccatcaaagagaagtattttctagttgagatttgctataatttgcaaagcagtctgaaagccttcaacgtggggaaagcattttcttgataaaagatgaaaacctacaggtatggggtgggtaggtactgttgtaatcaaaaacttaattagaagccctgaagaaagatataccgtcttatatgcatgcttgttaataaaactggcatgtctagtatgtacagaatattgtgtttggcaagaataatttgaaaagatgaaattacagcctttgccttcaggggttttaattttacttgagaagacataatacagagctaaaaaaggatatattgggatgtaaggtcataataaatttcacataaccggtacaggcacaaatagtgaaaagatttcagagtagagagcaggcgtattactgtcaagggcatttggattatatttttcagagagtaagcattttccttgtctttttttcctctcctttccttgattacaaatcactggaatggattatgattgaaaaagggaagggactgatgattctttaaccagagattaaataggaaactatttagatataattcatttgggaaatgatcaagcaaatgatttagtcattaagtatttattaatggcctgtccattaattttttttcttttttgagatggagtcttgttctgtcacccaggctggagtgcagtggcatgatctcagctcagtgcaacctctgccttttgggttcatgcaattctcctgcctcascctccctagtagctgggactacaggtgtatgcctccacaccaggctaatttttgtatttttagtagagacagtgtttcaccatgttggccaggctggtcttgaactcctgactcaaatgatccacccacctcagcctcccaaagtgctgggattacaggcatgagccaccgcgcccagtcggatttgaaatccagttgcatctaatatcccacatgggaaggccagtggagcaaattcttggatctgaagacagaagtagaaagcagcatgtttttgtagataaagaacaggttctgacgtggtctagtatgtaccttttgggcatttctaaaattctctgtttcttagtttcctaatatgcaaatttaggagaattcagtgctaatttatgtaaattacctgatataaagcccagctcagttaatgttttaacaactttaaaaaattgcctttttaaaaacggtcttttgcaactgctttcttcttttatttctactgttcctcagtttgcctagtctctctttacctcttagctaaacttttgcagtaattgccttatgctttccctgcctctgatctttatgcttctcagttcatcttcacactgctggccaaagcgtaaatctgactgtcatgcccttgcttgaaacctttgatagttccttattacctccaaaataatggatactttagtgtggactttaaagttagcccctgtttgatgggctaaccagcaggtgtttggcattagtattacaaatgcaagggtatttggaaaattgagcacaagcaacacatcaagatttgttagttgtggtttttggtttcactattttgttggcacttttcctcatgtgtaatatatcaccctgacttttaccctggctgaatttgaaggtacctgtgtcattgttgggtaaaacaaacatgggttgtacctctccttcagtgtttgatatcgtgaggaactatactgcagattatgacaagaccttaatcttcaataaaatccaccatgagctgaaccagttctgcagtgcccacacacttcaggaagtttacattgaattgtttggtaagtgtcttaattcttatgtatgtaaatagccaattggaaatctttgttcagcttacttattgaggttatattggtaaaccttagtgctatttaagcatttcttctgaatttatcatagagcaattgtctttaaaatattttttatcttaagtttaaaattttttatataacttgttagagattggaaaaactactcagactgtattctgtttttactgtaataacttagtgaaaattagctttgttgatgttttaatagataatttgaaaaatttagaaacctgtgtcttgaggctcccatttttgatgatttggtaggagactgacaggactcagcacatagttgtgttcacagctaagatttattacagccaaagggtacaaagcaaaatcagcgagaggcaaaggcacaccagcaaaatgcagaggaaagcaggtgcaggcttccaagagtcaaacatgtgcctaattcccacagcaacaagctgtgacaacacatgtgaaatgttgtctactagggaagctcattggagactcattgcccagggttttcactgggggctgattatgtaggcaccctctgcctaccacataaaaattccagactcctggaaggaatgcaggtgtttggcataagccacattgtataaacagttcacagcaagtcaattgtattagctctggggatagtgggacccttctacaaatccaagttcctaggtgccaaccaaggacgagtttacaaaaggcctttctaaggattgcagtatcagccctgctttcttaactcacttctgtacaacttacttttcatttatgatagtggaagttctgaccagggaatgagttgttgctgttggtagctcacttttccctcctgaaatttttagtgaatttctaagatgaaggaataagcaagagtaatcaatttaaaatctaccaattgagtcctctttggtgattgtcaaccactgaagtggcatgtgaggaaactgatgggtcctgctttgtctcaccaccagtcatttaaatagcgaaagtaccattgaggtgaatagaaagtgcatagttacaagcccaagtgttcatgctgtgtatatttcaaatacttttctatgagcttctctctctgtctctctctctctctctctttaaatccaaaataacagtgaggctgagatccatggaaatgaagtttagttatttgggaatttgagtaaagatttactgaacatagaaatttgtttttctttgagaatgaggatacatattgagtaagagccctgaattaagatactagagatccagattctccatttattagatcaacatattttacccagtagttgtttatccagtaaataagtctaataagttacccagtaaaaaagcttatccatagttaagtaatacatttagtgggtaaacttattggataaacagactatctgcttgtcatcttcrttccttaatttctttattagataattccttgcaatttttttcccacacaaaagggaagaaaaggcagtttaagctctgtaaaagaatagtactgtggaaactttaggtctaataatgattagttttgtttcattatgaatacaatgtaaaaaaaattgactatcatgagatctgttgttcttggcttaaaaaacagatcaaatagatgaaaacctgaagcaagctctgcagaaagacttaaacctcatggccccaggtctcactatacaggtaagttcttttcctagggaagttctctggggattttgagagctttgagtttgttcctcctttcattggattgttttattcagcaattatttgagatgctatggtgatttatagaatacctttctcaatttgactttagatctctgccaaaataaaatactcttgtagcttrctatgggtgacatttgtgaactcctagagggaactgataagctgaggctcttacaaggaagtaaaattcatatttctgccatgtatgaagcattaagatacagtaatggttataaatcagtgtaagcataatccctgccctcagtaagattatgaaaagggagttcaagtgtaaaatttgaacaatcctggacaaaatagttatcacaaagtattaattgacagatgaatctattgaatgattattgctgtaagagtaagagaacattggaagacagtgtgtctaggagagggctgtgattgagttgagattttaagtaggtttggaaaaattaattggatttaaatgggggaagaatgagaaaggtatttcaagtgggagggacagccctagtaaaaacaaggtagcaggtgaatttagtggtagtggtgatggtgacgttgggaaatagaatggtgagaggttttacccctgcttttttttgggtcactgtgttttccagattgtgggttgtaaaatcaactttagtgagtcatgaacagcattttaaataaaatggaatagaataggaaaagaaatggyatgtaataagtttaaatattctgtgacacttgtgtttcacagtgtggcggggtaggtgtttatattggacgtcagtgcaaaatgtgtttcttactgtgtccactgtcagtaacattcgaaagccactgctctggatccagatgacctaagaagttatattgaggcttctctagtgtcctttctcaggagctctaggagaccagttgattgttgattgttgtgatgaacattactgcaactaaagcttatcacatgtctctcaattctttacactcagcaccactgctactgagagtgtgcgctcactgtgattgtatgtgttcgtgcttctcaaaaacaagactgaaagataggtggggttttcctcatggcctcattcatgcaatgtcattatctcaggcgcttgagggtgagccaccagagttaaggggtcgtttgaaatgtccagaggtaactttgtaaaatcctctgagttgttcaagtcagttgtagctggagtagctttttagttttaaagatagtgaatgtgaaggtcagctcttagattctgcccagggtgttactcagagatctagctcattcaactgttgtttagaattccttgccttatattacttagccatttttctgttcccagttttttgctattaaacaatagtgtaatgaacattcatgacacatgttcttgtatgtacaaattatctttcaaactgactgtacaaatgtacattcttaacagcaatatgtgcaaataattgtgacccatgaactcaccaacattggaagcaatcagacatactgattgttaccatatggatgggtgggcaattatatctccctttgatttgcattcctttggttgttaatgaggttgaacatcttttgatacatttattggtcatttatactgtcttctgctgattgcctattcatatcttttgcccatttttctgttggattgttttctttcttactgatttgttctgtataaatttggaatttttatacacacacgttatttatgttgtagaaaaaagttagatactaggaaaatgatgaagaataaaatgaaattcaccagtaatcttattatgcagggataacatcatttgttatatctttctcgactattcttaatgtatatgaacaaatgtttgtagatataaatgcatacatgctcaactaaagcagaatcataccatacttgcttttttcactaacattgtctatgaacatctttccaaaacaaaaatataggtttggtaaatcattacttttaatggttatatttagtgaatctctatggtttcaaattttttactactgtatgcatgttggaatgaccaagcttatatattctgtacatctttttaaatccctctcttacaataaattcttgaagtgggattgatgatcaaagtgtatgccctgtttgggggcttattgatacatactaccgaatcaccttttagaaaaattttagcagctccccccctcattagcagtgttggtaagctgtagttcttacacatttgattgcatgattgtacccaaataattagcagatgcaagctttccctttctctcttaatccttttggagaaaattagtctgttattttgtgttaattattgaagttgaataccctaggttattagctgtttttatttcatttataaattgttggttttgctcatttttgtagttaatggtttttctaactgattttaataagctatttttggctgggcatagcggctcacatctgtaatcccaccactttaggaggctgaggtggaaagctcccttgagcccaggagtttgaggtcagcttggacaacatagtgagaccccttctccacaaaaaatttttttaaaaaattaggtaggtgtggtggcatgtgcctgtagtcccagctacttgggaggctgaggtgggaggatgacttgaacacagcaggttgaggctgcagtgaactgtgttcatgctgtactcttgtctgggcaacagagcaaaacccwgtctataaataaataaataaatagcatttgtatatagagaacttgtttttgaaccttaccctttgagaggggtagaattcgtttttaaaaataaactttttcatatgttagttattgtagctcttttttatatttataggaaacattttcttcaaattttttctttgtcatttaactttgttttttccttgctgataactttgaagtgttcatgttttacatagtaatttcagtgattttgtctttatrgtgtgttgctgagctggcatgttttaagagcttttcaccaccttaaaagtatagcaattaaaattagaaattataaaaattgtatctgcttttacagttgtattcttagatttaaatcttttaattcatctgcaacccattttgatctcagttgcaaggtaggccttcagctccatcccctcaaccccaaattgggtaacagcggtaattactgaatagtttatttttccatcttcccccttctttgaaatagtttttatgttacatactgcattccattatatactagagtctttttctgaacttagttctgttccattgatcttcccattcctactctttcattagttattgagtccttggtcttttctcatcaaatcgaattttctcctgtgtttttcatcttgtcagttaatggtaactctttcccctcaagccaatctagaagtgtaggaggcatctttgacaatcgcctcaccctcagcatctaatcagtccctatgtcctgcagattccaccaccaaaatccaygtattaataaaactgaccacacctccatcttcactgtcatctcaagccaagctaccaactctaaccttgacatgtgcagtagcagtagccgcctgtcttctttccccactttcacttttacctttgtctacttcattttctgcacaacagccagaaggatcttttgaatttacttatatttatttgctgtttttataaaaagttattgattgaaaaaatgtagttttgttatacgttcttaaagtggtagagatctccattgttttagggtttaaaaaaattttaaaataatttttatattttgcaataacttaagcataccctgagaagagaagagctcctttgctttggttgcttttgtcttgttataaaattttttttacaatagttggaatgcattttaagaatttcaaggctgtttttgagctttgttatttttaacacattaccatatggttgtgataattcaactttttattttaaaatctggcaagagacatcatcttttaaaaaataatggcctttgctgtttctgccagcttaatcttccagatgagttttcattatcgatattttcaagctatatcaggcacctaagtggtcatatacatgttgttttgttttgttttgttttgagacagggtctccctctgttgcccaggctggagtgcagtggcatgatcataggtcactgcagccttgaactcctgggctcaagtgattctcctgccttagcctcccaagtagctaggagtacaggtacacacccccacatctggctaatttttttattttttgtagagatgggcctttgccgtgttgcccaggctggtctcaaactcctggcctcatgcaatcctccaatataagttaaaaatagaaacatagtttatggctttactttatcatatcagcctttttggtttttagaatttctgatttaggggagaaactcatatcctaagttaaattaataccaatggatttaatgaattttaatgctgttcaatatgtagtcttttttttttttaatcattgaggaatgtgattgattcttggtagatttatcttatatctacaacttgaattcactgccttctagtaatttttgggttactatttttacagtcactattatatttttttcctttccatatatttatataccatttttcttcttgaaaaactactctggcaaattagaatgatgaaaatggtcatctttgattttttttttcctatgttatttaagggagtgactatattatagactggcttttgatatataatatatgcttaaaacccaggggtcagtttcaatacatatattcctttcattagccatttttttcctccattcactctatgtatgtgagtgggatgggggcattattttattatttgaggttaagagcagaggtttaataggcaaaagaaacagaaaggagaatagctctctctcctgtgagggagaggggtgcctgagtgggacttcccacttttacttttaaaatctcttttgatgcaacttactcatggtatctgtacagtaagtgtttatgttttcacatatttgaaaatctgtgagatttcccaagattggcaagcacaatgtagtatgttcttcagcctcattcagcaaaataggagtcttcaaaagacagtcctggccgagtgtggtggctcacgcctgtaatcccagcactttgggaggccgaggtggttggatcacctgagttcaggagttcgagaccagcttgaccaacacagtgaaaccctgtctctactaaaaaacaatacaaaaattagtcgggcttggtggcgcatgcctgtaatcccagcaactaaggaggctgaggcagaagaatcgcttgaacctgggaggcggaggttgcagtgaactgagattgcaccaccgcactccagcctgggtaacaagagcaaaactccatctcaaaaaaaaaaaaaaaagtcctactttacgcttcttttaataaggctaaaaagatatgtggccagtctcttaattaaatgcagtatgacagtgcttccttgaatcatattaatccatattggaagtaatcttatgtctgctagtcacatggtgaaatctgacatctcacaaaatctggtcctgaatttttatttgtcttctgcatgtctccactgagttgtgaggcctcacatgtgtcactgccagtgtgttgtgagttttttccacacagccttcagctgcttattccattccactgtaatccttatatttagttatgattgtcctcaaaattacctacaaatttgactcatctatttcatataggaaatgctatatcgcttaaaagttttaaaagcctttaaagaagactaagtgcttaaaggctttgttattcttaaaaggttagccagttttcagaaggaaaacttcttcagaccagcaaagtgttttttgtgtgtgtttgcagtataggtggggcggcggggtatcgtatgtttagtaaaatcaaaagcttttgagagatcaagtccttgatgtagaaaagtcagccttcaaaaaacagtactgtccaggtagataatcttaattgtgtcaaagaacactatgattagggaaacaaagtgtctggtaaacagcctctacaaagacagactttgttctaagtgagagttaaggaagaaagaatataagcttttaattgatatttgttttccttcagccagtgggctgtttacttacagcaaataccaagtgattgcaggggttggaagtgatagattaatttactcactactcactgtattaaattgtatacaccaacctgggtttttttgtttgtttttgtatttgactaattgtttctgactttacaatttcagtcttggaactttgccttcccggcttctttggtttacagggttgaaaaagaaagcaaaagtatctaacgacctttgtaaaacatcttttaagtgagaacctttttcataaggcagttgtttcctcagtgggtagatggtttttcctgtaatctggcattgtgtaaggaaataagaagcagcttgtctttgattcttggtgtgatggcatgaaaagtaaatgttctggtgggatccccaaacgtgttagtaggccgctatattatagctgttgtttattagattagtatcatttgaggggcttttctgtagaagatttaatttgaagatttatctttcaaatatactttggctttttcacttttattttttaggctgtgcgtgttacaaaacccaaaatcccagaagccataagaagaaattttgagttaatgtgagtaatatgcatgggatcccaatatttctgtttagggctgtctgcatattaataytccagtctagaggaaacatgtgagacaatacactctggggtggagtatgtgtcttatcttctttactcttactctagtaatattgcctattcttgtgtcttaattcccactagactcttactagtgttctctttatgtatggacatttcaggagcagtttcagtggctaaagatgcagtttgctgtaaaactattgctggaagcttaagsagctataattttatatgaatagtaccttgaattaaatatttaatagaggaaagagtcctgaagccgttagggttgaagagagtgctcatattttgtttctgtgttgtaatggtaggaatagataccttgttggtataaagtttggttttccattgtatgtgattgtatatctaaaattagacctggttctttataatgtgcctctagggaagccttgcttctgttgactcctggtagtcttctcttttatgtatccagggctgactgggaatgagaagacatgaaattagtttctgacaggatcccttttaggggaatacttactgtgtttgaaatggcaatattgttttcgtatgactggtactgaaaagaagaaataaaagtctttaggaaatttggctgatgtgttaaaagggaaagtataagacgctggaaaaataaatttgcacaagtcaaggataccacagatgtataaatactggaagtccaaggagcagtaatactactttatgaggttgtttacttctgagtcctttttgttaccatgcagatttttattgtttttttcttcttttatattttccttttccctcataccttctctgagctcatacagagttttatttctctttttcttaatttttttttttttgagacaaggtcttgctctgttgcccagactgcagtgcagtggcacaatcacggctcactgcagtctcaacctcccaggctcaagtgattaagcgatcctcccacctcagcctcctgagtagttgggactaccagtgcatgccaccacacctagctaaattttgtatttttcatagagacggagttttgccctgttgcccagcctggtctcaaactcctgggctcaagcagtcctcctgccttggcctcccaaagtactgggattacaggcttgagtcaccacacccagcctgttttctctttttcattgtagacaaagaactcttcttttaaaagtataaaatgtagactgccaggctgggtagattatggatgtgatccacttattgaaaaaatatttataggcgggctgtggtggcttatgcctataatcatagcacttcaggaggctgaggccggcggatcacctgagttcaagagtttgagaccagcctggccaacatggtgaaaccctgtctccagtaaaaatagaaaaattagctggacatggtggcaggcacctataatcccagctactggggaggctgaggtaggagagtcgcttcaaccggggaggtagaggttgcagtgagccgagaccacgccattgcactccaacctgggcaaaagaacgaaactctgtctcaaaaagaaaattttattaaactgtcagcatgtcttaggctttaaatatgattgcttaggctgggtgcggtggctcatgcctgtaatcccagcacttttgggaggccaaggtgggcggatcacgaggtcaggagatcgagaccatcctagctaacacaatgaaaccccgtctctactaaaaatacaaaaaattagccaggcatggtggtgggcgcctgtagtcccagctactcgggaggctgaggcaggagaatggcgtgaactcaggaggcraagcttgcagtgagtcgagatagtgccactgcactccagcctgggtgacagagtgagactccatctcaaaaaaaaaaaaaaaaaaagattgcttctggtgacggaaaaatgaatattgtgtgttttctgctctcaaataaatcatagtattcagactgtcatttgatgtctttatcaatgttatcagaggaaaggggaaactttgaggggaagtgttttggggaaactattggagttacttttcagatgattctggatctttcttaattttatggactattggaattccagaattaaaagctaccttgggatgatccagtataaccttgcacctgatagtagtgttttcttataccatttctgccacgtggttacccagtagctacttgtacatgcttagtaatatgccagccatttccattacaggtttagtaccccttatccgaaatgcttgggaccagaagtattttaaattttggatttgtaaagattctggaatatttgcatagacataatgagatatctcagggatgggacccaggtctaaatataaaatttatttatgttcttccttgttggtatagtggttagttttttttttttaaggtattttatttatgtcccatatacacctatagcctgaaggtaactttataaaatattttaaataattttgtgcatgaaacaaagtttaccttaagtgcttatgtgtggaattttccacttgtgtcataatgtgggctctcaaaaagtttcagattttggagcattttggatttcaaattttcagatcagaaatgctcaacctgtrttagacactggaagccttagaaaattctccttactgtaagccccagtttactacctaataactaccacctagttatatcttctgtgcaacaaatayggtcactgcrcatgggtgcccacctgaggagggcaggggctgaaacccagcttcattctgcatgtcaaaccatgcacctgcaggactgtagaaacggctggtgccgttttctaattggcacagagctgctgtatggactagctggaggtctaacagcaaaggaagtattgatatattcccttccaaatcacaggctttacacaatacaactaggagaagaaagccaaactaaaattcaaatgtactaartttttttcctatctctgggtgactttgggcaaatcattgaatctttcaacctcagatttattataagtaaaataaagtaacacctctcttaacctaccttaatgggtccaaaagctcatgttgacaaaacggttctctgactcactgtagggtcagaattactggctgtgactgcacataggagaatcatttctaatttttataacattttgcttcacagggaggctgagaagacaaaactccttatagctgcacagaaacaaaaggttgtggaaaaagaagctgagacagagaggaaaaaggcagttataggtacttggatttctctgaaatgattgtctctaagtacatttgtttgtcctgttctttgtcagtctcattttgggtatcatgggactcagtaagattgcatcataggtagtggggaattctggaatctccactgtacattcagatgttctaaagcctttaaaagtaggtgagaccagtacttaatgatgtgctgtggctgtccatcatgttgttagatgctactgttgtctctttcaagaacagggagaatggatagggtttataggcagcttgagtctgtggatagcattttcatttgtacagattaagaatagggaagttttttgaccaaagtttcagrttgtagtatgcatccttgttgttgacatgcacttagttttacctggataggtagtgccgtttatgaaagcatggcaggattgtttacagttcatttcagattacagtggcttcccttatactccaggtcactgtgtattagattgccctctttggccctcggttgatgctgaaagtttaatacrtctttaattaaataattcaattatagaggaatgtacagagaacaatataatgaaagcttaagattttgccttattcccttcagatcttttttttttttttttaagaaaaaaattaaatatctgtttgaagcctcctttgtatgttcactggtcctactctttgacttttcttctcagattaacttctattctgaagttgatgtatatcctttctgtccatatttttatacttttactgtaagtgtgtaagagtttataaaattgttttacctgtttgaaactacaaaaatgttaccaaactcttattttacaacttgccttattttcactaacattgagttttattcatattgatacatgtagatctagggattttttctttttttggcattttatccttattctctgtgagatggtagatcgtttatgtttagctgctacatttttcgttctatgagcgggcctagttttattgtaatgaattaccaatgaggagttaggtagtttctagtttttccttattacaaacactgccacaataacattcttatccagtgcctcctggatacagtgtacatgtgcaggtttccatagagtagcattactcagtgtatggtgtgggccagtgccctatcaccagctttttgtttctgagcctcaatgagatgagtatagaaattgagaatgagtgtttagaagtttttatagcattttaatacagcagttttatgtctgttgaatcaaaaataaaaaatcagagcttatatatttatgtttttgttttttaatttcttttttctagtactgtaatttgtttttgttatagtttacaatttattggttcctcataaattgaaatacacacacaaaaaggtaaggtayttttccacaggtrgtttgagaagcactgctctagaatagctatctcaaagtagaattgatgggtcatagggtagcatgtcttcacattcaacatattgacaaattgctctctcaagtacttctttgattttaccatctcttcaacaatatttgatatccagtttctatgctgccatatttgaattcccatttccacacatccttcttggtccttggagttatcagacttaaaactttatgtctgtttaatggaagacatggtatcacataatttcaatttgaatttccctgattgttagtaaagttgaatattgcttattggtcattcaagtttccttttttgttgttgttatatgaattgcctgttaatgtccttagcccattatttgattgcttttttgagttgatttgtaagagtcctttctgtctcctggatactgatcctttttcagatttatgcatttccaacatctttcaatttgtggcttgtctttgaactttacaatgtcttcgatatacatatatgtgtagtttttgtgtagacaaattcattagtcttttcctttatgttttgtgcttttcctatcttaagaattctttccctagtccaaagtaagacttttattctaaaagttttaaagttttgcttttcatatttaagtctttagcccatctagaatttattttggtgttgagtatgacatagggattcagtttaattttttcaagtggcaagccaattgtctcagactgtttattgaatagtttattatttcctctacttatttctaatgccatatccatcatataataagatactatacataatttattctgatgccataatctattattttccaattttttggtctctccttcctcaatattaatttgttttaattattgtagcttttatgttaagtcttgcgatgtggagagtgagttgtgtaactatttctcttacctgttaactattcctaactatatttaaaattatcctggactattctaggccctttattcatccacatgaattttagaaccagctccttaagttttgtgaaatattgtgttgggattttgattggaattgcattgaatgtatgcatcaatttggagaaaattatgatattgagtcttataaatctgtttctccatttaggagagttgtcttttaaaaagtgtcataattttcttctaaagttcttgcacatttattaaagatttgttcttatatacctttatttttttattgacttttttaaaggcacattttctaatgggttttgtataagtatgctgttgatttttttatttagcaatattgctgaagatgctcttatttctaatagtcgcttagatttcccatgaacaatcatatggtcttcagacaataggtccttatcttcacataaggacaattttatttttcttctaagtcacatactttttatttcttcctgtcttactgctttaggctatgacttctaagtacagtgtagaaaagaaagtgacaagtattcttgtccttaactttaaatagtcccagtgacatttgctgtacttaacactggttaataaagtttcaatctgtactttgcttgctgagagctttcattttgaatggctgttaaaactttcagaatttttttgagacagggtctcgctttgccacccaggctggagtacagtggtgtaatcacagttcactgcagcctcagcctcctaggcttaagttattttcccacctcagcctctcgagtagctgagactacaagtgcacgccaccacacccaggtaatttttgtattttctgtagagacagggtttcaccatgttgcccaggctggtcttgaattcctgagttcaagtgatccacctgcctcagtcttccaaagtgctaggattacaggtgtgagccactgtgcccagtctgaaaattttttctacatatattgagatgtttttaaagctgttaatatggtaaattatattaacagatttatctttgtgtttctgggacaaacaatccacttggtcattatataggtcattatatacatttttatatagtttgctgataatttctttagaatttttacctttattttcataaatgagatcagcttataattttcttatacttttagtgttaggtttttttgtatcatggttatactatccccaagatgagttgaagagcatggcttccttttctgtgttctattgtatatcacatcattatgtatcagatctgtataatttcatctttgtaggtctggtggaactcgtaaaagccatcttagtcttgtgaggtttctgctttttttcatttgctttttgtggtaacagttaatctattgatttaattcctgtattgagtataggtatattcagatacatgttttctttttaagccagttttggtaattatattttcatagaaaattgttcatttcatctgatatttcaaattttggggcataaatttgttcgtagaattctctcatgatttttaaaacctctaccaaatctgtgtgccccttttcattgctaatactgttttcttgtgccttttcttttgctgtatcaattttgccagaggtctgttttattttatttatcttttcagagaattggcttttgttttggttttgttgattgttactttgtttaaattatattatttacactttttaaaaaatatttccttccatcttttttttttttttagttcatttgttcttttttaacttcttgagttggatagttaagtttaagtcttttctagtggaaacatggaagattataaattttcttctaaggattgctttagctatgtttcacaggttttgaaatgtactttgtatattggtgttcagttttaattctwaaccttttccttctaatttcttctttggctcatgaattattaaaagtatatgcttcaatttctggtttagtgggttttgaggggctacctttttattgttgatttccagtgttactacattgtagtcagaaaataagacctgttatatggattcttaaatatttattgaaaattgctttgtggcctacctgtacacggtccttttttgtaaatgtctgtgtgcttgaaaagattgaatctgtgttctctggttgttggatgcaggtttctttatatactcatttggtcaggcttatgaattgtgttgttcacatcttctgtattcttctaatttttgccttcttgacctatcaattactgagaaggatgtgttaaaatttcccactatgaccatgggtttgttgacttgtaatttttttctttatatattttgggactatatcattaagaacattcaggttcaggattgttatatctccctggagaattgcttctgttttgtaataatctttatccctagatatgtttttaacttaagagctattttgcctgataatatagctataccagatttttcttggttagttattttcttggtgtaccttttcccattcttttactttcaacttttctatgtcattatgttttaggtgtgtctcttgtaaacagcatatagctggattttgtaatcttatccaatgtgagaatctgtcttttaactggtgagtttagtctttttatatttattgtggttactgctatatttggatgtgtttgtatcatttgattatgtgctatttaccatgcatttttctctgcttctttttcccttttctgattggtattgaattgattgaattttcttttcttttcttccttttacttgattggaagttttacattccattgctggaatgtataactagttgttaatcattctatcctcttcttgaacagtaccttagaatgctttaactcttatcactgtcctccagtcttacattttattattgcgtagtattttagtttcatgttgtctttatcctcccatcaattatgatcattatgattaatccttacagtaaacacttattttgattgacatgtgttgagtaatgttttttcctctccattgtttctggtgattttttttttctagtaatttttttttcagtgaagactaaggagtgaaagttatcttcggtcctccttggtctgaaaatgcttttattttatccttgaatggtaatttagcctacaattctaaaccaagctaatttttccttatcaatatggcagtattatttcaattttgtttggctgcttgcacctatttacaagtatgttgttagtccagttgttccttttgagtaatcagcctttcttctctttttgcttttaacatgtttctgtctgtatttgggtgttcttcagtttcactgtgatgtggctaggtagagaagaggttacttcttaactgggctggttggtagagtgttttagttcccctttcattagagttgcagccctctagaggtctcagttttatgcaagggtcttagtcctaatatcacaaggcctcatctcctggtcttgcatgggtaaaaacccaggtcccactcccttcttgtctaataaccaccccagggacaccaccatacaggctctcggctcccccttggcttaagttacttgaggatctctcattctttcttacaactcagccatgcattaaaaaacaaatttgctatatttcatctagcattttaagaggttgttagctaaagggttttctctctggccttttggccttttgcaccatttttctagaagtctggtcgtgctttttattgatttattcccacatgacagagctttgttgaatgagattaccacaacagtccccctatgttgaggtaacatcctttgggttctagctgcaggcttcagatccctcaccttttattcatgttttatcttgagtttctgcttacagttcaatttctagccccattgaacatagtagtttagtttttggatggtgtaatatagattgattttacattggtggagaaagagggaattatctcctggagyagttcgtaaagcatactgttttatggaaagaaaaaaatcacttggaagttttctttccattatgtactttttctaggggtcagagataagatgtcctaaaatacccatcttctttgactgaaaaggagaattgagaatgttctttaagaatagcagtgattgaatgtaaagtgtaattcaagtctttcttccttgtcctgggtcatttgggtaggccagaggtttattaagggtgttgagtttcctctgcatgtacttgcttgccacaccaacatgttcactcccaatgcttgttttcaccttctcaaatgaatcaccctgctttctgctttatttccctacagcagttggaatactcctcttctgataccattttcatcctgtcatttccctaatggtaacttaacagtagatcctgagtatagtaaaactaagctccttagcctgtcactcaagacagaggtctcctagccctctttctcttcttattttwtgttgtcttcgcttgttggctggttccatatcacctctccattgtgacttgttcatttgtgccttcttgtctttcttttttttgtttttgtttttgtttttgaggcagggcctcactctgtcacgctggctggagtgcagtggcatgatcatggctcactgtagccttgacctcccaggctcaagagatcctcttgcctcagcctcctgtgtagctgggactataggcacgcaccatcatgcttggctaattttataaattttttctagagatggaggtctcactgtgttgcttaagctggtcttgaactcttgggcttaagagatcctcctgcctcagcctcccaaagtgctggggttacaggcgtgaatcaccatgactggcccttcttgtctttctctgtgcttcctggcatgtcttcttaggtcatatccattatttcctttaagattacttccagaaggtcttccttggtttaacttatgtcactcattctttctttctcctgccacattaattgtcctgtgttgccatgcatttatgttgctctgtttttgttctgtggtactttcataaagtatctttttttcccattagcttgtggaccgttgctacagagttgcatgaaggactggcactttaacctttttttactccttcttcccacaaaactagcactgtcaaaatagaacagtaaattaggaaataaattcccttttttcctttgagtagtttacagtctgactagataaaacttagtgaaacaattagcacataaaactttctgtaattaaatgttagactgtgtgctgctggttcgaagtgcctcaggtactgtagaaatggttttgaatgtgtcttcttatgttgtatgattatagaagcagagaagattgcacaagtggcaaaaattcggtttcagcagaaagtgatggaaaaagaaactgaaaagcgcatttctgaaatcgaaggtacattgtggggagaggatgaagctctgcctgtcccgaactgcctcctctctgctccagggttcaggcctttgattgtggtgggtgagaaggccatagacagaataatctggtctggaggaaatagctggcctgatagtctaaataaatttttttaaattgctatcacatttccagcttttgggtttgtttgtgactgtgggtagctcagctttccttttcttccttaaattggggcttattagctaccactttattttcaggcagacaagrtatgaaaattacccataatcaatagtaaagaatatacaagataataaaccccatctctggccgggcgccgtggctcacgcctgtaatcccagcactttgggaggccgaggcgggcggatcacaaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaaccygggaggcggagcttgcagtgagccgagatcccgccactgcactccagcctgggcgacagagcgagactccgtctcaaaaaataaaaaaaaaattaaaaawaaataaaccccatcacgaccagtttcttttccacctgtccaaaaaaaaaacaaaattaattggggggaaaaacagttttcatggagggcctcacactacttgatttcacatagtgagatgttgatgttcttagctcggtcttgaagtcacttgttatatattgctgcttcctgtctgtctctgttgactgattctggatgaaatttgkgggggggctggagacaatgcagtaaatagagcttttatgtctggacttattttacttgaagcttagtacctgggtggaatgtaaggctctgggtgataggaggtgggagagtgggtggaggagagaaggaacaacttagagtagaaaacaagtaggctcagatgagctgagagttatttgrcagtgaaaagagtattcctcgtagagaagttgctstttggggactgggacttgaaaactgctaataggtttttaaaactttcaatgtgaaataagcagtcacaatattaagcagtggggaaagggactcttaactagctgagggaatggattgacacctttcctttgtttatttgctagatgctgcattcctggcccgagagaaagcgaaagcagatgctgaatattatgctgcacacaaatatgccacctcaaacaaggtgactggctccctggccactttcctaatgatgcatttcggggttttgctttctcttttcaggagctctgatatgatagaagtgattttatccattgtcaagaaagtgtagtgaccaagacatcctccagaattagtcagttagcaagaaatatttcacattgattgggtagggacacaggccaaatgccgtaattccattcatttgtactgctatataaggctgaataattaattaagttgaaggtcttctgaaataagagtgacagaagagtaaagtctatttagaattgctttccaaataaggtagtttttttggtagatacttagcttgattagagcagtatttctcatcaaaggcattcctggcatttggggttgagatactttttcattgttgaagaccatctcatgcattgtaggatattttgtatccctggcccttgtctactgaatgtcagtagtggtcaccagttgttttaactgccacacacacatgcatgtatttccatatgccccttgttgagtactccttgtttattggatttaaaaaactattccagtcatgaggaatttcatgtgggataacttgagaaggcaggttgggtgatatataggtgataatttggtgtaaggactggggtaagctggctagacggtacagggctagtgagcaggggctatttaagaggcagctagaactccgatagtattctgagaagggaagggtatgtccaagatttataaggttatcgtggagcagattggaacagataaagggttgagaaagagattactaaagtggatgatgcagtttgaaggattagagtcaagttttaagatatagacagggcttttaatttagaaaggaacaacataatccgtatttagaagaaatgataagatgatagaatgagagttgtcagtactttgaaaaccaatataaattttaaaatgaacataacattgaaagacacagttctatagacacagaatggaatttggccaaaagaaaggcatgacaggaaactccagttgaggaaactaggagtccaaatctaatgggagaagctcgtcaggcacaagtttcaagaccttgccattgaggtctaccttattcagaaaggggcagtagttttatgccattttgaaaaatgtgactcagatactaacctatattaaaaaggcttgaggaagaaatgtggttgtgcactatgaccagatttgattggagtgtttcgacagaggatatgaatcacctggagaagatagagatccaaagagtgaaagatgtcaaagtgtagaaaataaatgctgtaggactgtgaaggacaagatggacttttgcctgggggacaggccaggactcaagataaggagaggatcacagagcagggtctgaggggctttgaaaggcatatgttacagggaacagtggaaatgggttttaatcaaatccagatagattctggttagatacatcttggcatcctgatttagacaaaacaaaacagtgtgacagagggagatctggtggtcgacgagttttaatcaaacccagataggttctggttagatacatcttggcatcctgatttaaacaaaacactgtcacatagatctggtggtcgacaaacatctgtctgtcacaagcagcttaaacatccagcttctggggaaaggcagaaggccagatcaggtgacaacttgagattttattctagttctagaatttgttcaagaaaagcagaatcacagctaatgataagataatgagcaccagcccttcctttgaagttctgctctcatccactgacctgtgtatctctctcaagagaatcaacagagaaccaggcatgatggctcattcctgtagcctccctggaggctaagatgagagtatctcttgagcccagaagtttgaggctgcagcagcgagctataattgaaccactgtattccagcctgggcaacagagtgagatctcatctccagaaaaaaaaaaggctgggtgcagtggctcacatctttgattccgacactttgggaggccaaggtaggaggattgcttgaggccaggagtttgagaccagcctggcaacatagaccccatctctacaaaaataaaaataatttttttagaaaagagaatcaacagaaactccagaccaattccaggttgaattcaactagatgaaatgaaagtcactttagaaatattagttattatcattagttatcacaaattgttttccaactcccccatccttttattaaaaagtgaacagcttctcttgcattaagtcaggagcttaatgaaggaattttaagtcaggaacgcagctgttaatgtgatagccactctccaaagtgagagagggtcattggcagttattcagacttgactcatgatactcaggagancaataggtgaaatgtatatagggagagagaagactgttgcaccagagtattctgatgcctttgctcttgtttgctcccacacagcacaagttgaccccggaatatctggagctcaaaaagtaccaggccrttgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctrtatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtmtgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccytgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgatttgtgtttttttttcccacgtcttcatttttctgtcatcttaacatgctcctaaggctgtcttgcacatttcaactagggagccagtttatttgcgggtttaacttaactgtagaggcttttgttatactcttgccagaatactgcctacctggtataagaatgtttaaaacaaggtgtccactctttgctgactcctggaatttaacaaggggtgttcttctaatcctttgtgggacagggcctgtggcagaggggcaaggagggaggatggagcatcaggccactgggatccgtccctgagagcaaaagtacttctgcactgaggaggggaggagacagaccaagccagagaaggacaatttgtgtaaattataactggtaatgtaatggcacaatataaccaacttgactattaagatgttagcggcccaagagccagagttggacctgctcttcccaaacgttctgtatttcctcctgggatcaatttcctggtgatcttgggccagcagggagtggtaatgggagttgtggggaaagcagctctttcctcctgttcttatgggatcaaccccatagtatcctaggtcagttgctgtggacctgagaataatttgaactgaccatcctataggttattggtaggtattaaaatgaagtgatttctgcctcttctgtggcaaaagaatttgtgaattagaagccgtggcttctaatcgctttaggattaagtctcaaatgtgtacacacgaagttcgtgatctggcccctgctgtcctctccagccacccttctctaaggtccctgaatgcaccttctgtctgtcccttctcatacgttgttccatctgcctggttcactttccttccctcgtagtgctgactttcctcagccaactcctgagtcttcatcacttcttcagatgtaaaagcttcagttcactttgaactgcttggcctgggttagcatcctgtatttcccccccgtcacacatcatgcacacttcatgtctcattatgtgctcaatgtctgttttcacaaatgctaatctctctgagggcgggggcgggggctgtggctgtgctgttccctggggattgtttctgttgctaatgcctaagatggcatctggcccatatgagatggctttgttgcatgaaagaacaaaaagttgaatatgacatgcaggtaaatcaggcaagtgagtcatggaaaaaacttagaagtgagcctacagtgtccatgtcaggactttatgtgtaaccatgggaagttacctaacatctctgaacctgattactcatccttgcagggtgactcttcagtggattcaggaggatatgttgttgcatctagtgtagagattcgcacgtggtaattgctgggatgcattagttcaccttgtctacaggagtcagttgtctacaggagtcaatatatgtgtctgtctctgagtagctataagttcccatagtggagagagtgagcacagtgcctgctacctgcaattgcataatagaacacgtagattaatgtcttcaccagctatgagctaagctagctggatgttaaaccccaaccacagccctccaggagcatcccaacaagctgggccagcttctcatctttctcctggtctctgccctggtatgagcacttaaaatgaatttactgggccgggtgcagtggttcatgcctgtaatcccagcactttgggaggctgaggcggtcagatcatgaggtcaggagctcaagaccagcctgatcaacatggtgaaacctcatctctactaaaaatacaaaaattagctgggtgtggtggcacgtgcctataatccccagctactcaggaggctgaggcaggagaatcacttgaacctgggaggtggaggttgtagtgagctgagatcgagccactgcactccaggctgggcgacagagcaagactctgtctcaaaacaaacaaacaaaaaaaaacaaaaaatttactgttaattcattgctcactcctagtgtctattttgacatagactgtaatgcagaatgacgttttacttgtttcccttaccatatttcttctgaattagtacctgtctttccaatttttcttatttctttcaatcaatttttctactttttttttttttaattttaaaaaatgtcttcttccagtggggctcggtggctcacacctgtaatcccagcattttggaaggctaaggcgggcagatcaactgaggtcaggagtttgagaccagcctggctaacatggtgaaactctgtttctactaaaaatacacacaaaaaatagtctcctttctttcttcctataaatatttattgagtatctactgtaggctagttgctgaggcaacaaaaagccatatagccttgtgtgtgtgtgtaggatggggcaatacagcaagtaagtaggcaagtgtgatagtgtggtaagtaagcagggtgttcactgggtgctgtggggcaccagtaaagatcagcccagccttttggtttctaggaagcaatgtctgatctgagccaaatttttaaggatggacaggaggcagacagccagctgaagagagcagtggtgatggtggagtgtgttccaggcagtgggagaagcacttgctattgcatttcaaaatgcagtgccaggaggcatgagaggctgtccactgcaaaccttatgaggctctactattacttcatttcatagctgagatctagagagattacattactcaagatcccatgaatatgagtggcaaagtaaggatttgaacctgtcatattccagatccaagtttaccacagccctttatatttgcctttgaagccattaggtttagggtgatgaaagctctaaattgaggggagattttagaggatgtttatagagatttgtaagccctgcagtcgaggtcaggaaaagggataatgagatggttcatgtgtgaagtggtgacttatgggtgacttctctgccctctgcaggacttggcagaggtgctcttagtaagctgagcggtatgacagctgattccagaaagatcagccctttggagcctgggggagcagctccccttatttgggttacaaagcaagtggaggtgaacagtgcagggctgatggcacaacacccagatcctgtttgcagatgttaatcactcattctcctggttgctgggagtgttcatggtgacagcttttagcagagtcgctctgcagaaattttcctcggctaaagacccctgccccgggccaagatcacatccccttcctggggacagcacattccataagtggttgatgcaggggtagaaaggcaatttgttcaaaacaaaattgcattggttttctccatatgcaagtctgtcagggtgtgcatcctaataggcacaataactgtaactggatttcagacacctaaggcaggttctgacaaactgggtgtgtctgatgcctctggcgccctatcgcaattccactccaccccacctctaactccagctgtggccatggtagacagttccatgaggcatcaattcactttcctctgactgcatctcacctcacacatgagctgcacttactgcttttcaccctagggatcctccaacgctatggaggctgcagtcagtccaaacatatgctcaactcgagcacaagaattaatagcctctgggacaacccccaactggtaggagacaggaccacaaatggttagagaggaggtgacccaaaaaaaccttttcaatggagacagcaaccctcctgacacaagagaaactgtgaaaatcacattaaatacaattcgacagatgtttgttgagtacctgatatgtgccaggaaacctaaaatgtataaagtaatgggccagtaatgaacaacagtgagtcagacagacatagtctctgctctcttagaatcaacagtcttgggctgggcgtggtggctcacgcctgtaatcccagcactttcggaggcagaggcaggcggatcacaaggtcaggagttcgagaccagcctggccaatatggtgaaaccccatctctactaaaaatacaaaaattagccgggtgtggtggcatgtgcctgtagtcccagctacttggtaggctgaggcaggagaatcacttgaagccaggaggcagaggttgcagtgagctgagatcacgccactgcactccagcctgggggacagagtgagactccgtctcaaaaaaaaaaagaacagtctggtgggaaagtagaccgtaaccaaagcacttgagagacttatcaaagtgggaggaatgcagtgctaggagggtctcaaaaaagagggagaagataaagaatgaaaaagagcatccgccagttaaagatcggggaataacaactcaataaaaagacaacccaattttaaaatgggcaaaggatctcaacagacatttcttcagacaaggtatacaaatggccaataaaaacatgaaaaagggccgggcgcagtggctcaagcctgtaatcccagcactttgggaggccgaggctggcggatcacgaggtcagaagatcgaggccatcctggctaacacggtgaaaccccgtctctactaaaaatacaaaaaattagcccggcgtggtggcgggcacctgtagtcccagctacttgggaggctgaggcaggagaatggcgtgaacccaggaggcggagcttgcagtgagccgagatcgcgccaccgcactccagcctgggcgacagagcaagactccgtctcaaaaaaaaaaaaaaaaatgagaaagatggtcgacatctttagtcattagaggaatgcaacaagatagccacttcacacccactaggatggctataataagaaaggcagtaactagtgtgggcaaggaagtgaagcaattggaatctgcataatttgctggtaggaatgtaaaatgagggcactgccttagaaaacattttacagtttctcaaaatgttaaacagagttaacatacgatccagcaatctcacttctgggtatctacccaaaagaatgggaacatgtccacacgaagacttgcgctctatagcagcattatgcatagtagccagaaggtggacacaaccccagagtgtccatcacctgatgaatggataaatcagatgtggtctatccatgcaatggaatattctataaaaaaggaatgaagtactgatgcatgctacaacacgaataagccttgaaaacattaggctaagaggaagaagccaggttctagttacattaaatgttcatcatagacacatccctatggacgaaaagactggtggttgcctgaggctgggaggagagggaattgagtagctgctaatgggcacggcgtttcttcttggggtaatgaagagattttaaaatttgattttggtggtagttgcataattctgcatatactaaaaactattgaggctgggcacggtggctcacgcctgttatcccagcactttgggaggccgaggtgggcagatcatttgaggtcaggagtttgagactagcccagccaacatggtgaaatcctgtctctactaaaaatacaaaaaaaagtagctgggcctggtggcctccgcctgtaatcccagctactggaggaggctgaggcaggagaatcacttgaacccaggagacggaggttgcagtgagccaagatcgcacgtgccactgcactccagcctgggtgagagagcaagactccatctcaaaaaataaaaatttaaaaaataaaaaataaaaactactgaactgtatactttaaattataaattacatggcatatgaattatatctcaagctgtttttttttaaaggattgagtaatagtgtgaagacctcagttcaagaaccttccagaaatggtaaaaaaatattcaatataggtgcaacattattagtgagaatgagagcaccaaaacaggaggctgaagaggtgggtgtgagaagaggggaagggc

SEQ ID NO: 17881 - DNA, 45664 bp, Homo sapiens
tatctattatctatcatctatcacctatcgtctattgtctatcatctatcaataatctgtcgtctctttagctgctacctactacctttttttctgagccaatgagtgaatggggcatctgagtggggagtggggggtggggcctgaggaggggtgagctctgccccagggacgggcatctcccattcccctggagccagatgggagatgagaagggcccaggggctcctggagctgccgtaagtcccaccctccccacccggcctggcaactccttgcattcagaggaagtgacctctttatccgtatatacttgagtgtggattccctgcaaacaagggcgtcttcttacggaaccttcatgcaatgatcaaaatcaggaatttaggtttccagatccacacagcccacgtgagagccaacaggatgggggtggaagggcctctggcttccctgtgtgcgagcatggacgcacgtacagagaggagggggcatggattgtgtgtgtgagagtgcgtgtgttagtgtgagtgtgtgagggtatgagcacagacgtactgagaggagggagtgtggatgacgtgtgtgagcgtgtgaacacggacacacagacaggagggggtgtgcattgtgtgttagcatgtgttagtgtgagcatgtgagtatgtgagcacggacgcacagagaggagggggtgtggattgtgtgtgtgtgagcgtatgagtgtgtgagtgtgagcacagatgcatatacaaagagaaggggtgtggattgtgtgtgtgttagtgtgagcgtatggacgcacatagaggaggtgcatggattgtgtgtgtgagcgtgtgagtgtgagcacagatgcacagagaggaggggcgtggattgtgtgagtgtgagcgtgtgtgagcagggacgcacatacagagaggagggggagtggatcatctgagtgtgcacgtgtatgagcatgagaggcagagaggggcaagggggacagtaggagtcaaggaatgtgtccaccgtgttcccagcactgggcttcaaatctggctaattcttggagctcacccgtcacctgctcatctacagatgggtaaactgaggcccgcggcagaggccttaccttcgcgcagggtggctggaaccgggaggatctctggggacccctgccctgctcccacacctcctcccacaggctcccagccgcctgcccctggcaatgcgaggcctggatgctgggccaggaccaccacaaccgccgactctgcaccgctccgcgcggggccgcccacatcctccaagcgcgtccctccacagtgtccgaactgacacccagcggagaagggtgctgacgcctccaggaggtggcgctgcagccagacacgccgacctgggccgcggggaaaggggaggacggcggtcggtcgcctgaggtcttcatctccgcacgcccgggggtatcgaccggctgccagtggagcagacacaggcacagcccgtccgtgtgaggagcgggcgaaggggccagaggatgaagggaccggggttggcggccccggcctccgtgtttcctgtgaaggaggacggagaccggcactggcacccacggctgcacttcagctcggagtcgtccatgcacagctgggccctggcctctccacctgtgcgtgttcccggggatgcggccatctttccatctctgcgtccggggggaggggggtggggggtgtggtctttccatctctgtgtctggggggcaggtgtagtctttccatctctgtgtctcggggggggggggtgggtctttccatctctgtgtctggggggggtggggtctttccatctctgtgtctggggggggggggggtggtctttccatctctgtgtctgggggggaggtgtggtctttccatctctgtgtctggggggggtgtgtggtctttccatctctgtgtctggggggggtgtggtctttccatctctgtgtgtgtggggggtgtggtctttccatctctgtgtcctgggggatgggggttgtggtctttccatctctgtgtcctgggggagggggtgtgtggtctttccatctctgtgtcctgggggggtgtggtctttccatctctgtgtcctgggggagggggggtgtggtctttccatctctgtgtcctgggcgggtgaggcctttccatctgtgtgtctgggggggggtgtggtcttcccatctctgtgtcctgggggcggtgcggcctttccatctctgtgtcctgggggagggagggtgtggtctttccatctctgtgtcctgggggggtgaggcctttccatctgtgtgtctggggtggggtgcggtctttccatctctgtgtccttgggaagggggggtgcagtctttccatctctgtgtgtggcggggtgcggtttttccatctctgcgtctggggggggtgtggtctttccatctctgcgtctggagggggtgtggtctttccatctctgtgtcctgggggagggggggtgcggtctttccatctctgtgtttggggatacagtctttccatctctgtgttggtggggggtgcagtctttccatctctttgtctggggtgggtgtggtctttccatctctgtgtcctgttgtggggggtgtggtctttccatctctctgtctgggggggtgcggtctttccatctctgtgtcttgcgggggtggtctttccatctctgtgtctggggggtgggtgtggtctttccatctctgtgtcctgtggcagggtgcagtctttccatctgtttgtgtgtgtgtgtgtgtgtggggggggggggggggggggtggtctttccatcgctgtgtcctgggggggtatggtctttccatctctgtgtcttggggagtgtggtctttccatctctgtgtccaggtcggggggaggggtggtgcggccttcctatctctgtgtcctaagcgggggtgtggctgttccattctgtgtttggtaggggggtgcgacctttccatctctgtgtccagggaggggggtgtggcctttccatctctatgtcttcggggtgtgtggcctttccatctctatgtcttgggggtgtgtggcctttccgtctctgtgtctggggagtgcagttgttccatcctgtgccttgtctgagtcctcttgacagctgcaacctggaagccacttccaggtgtgtcgggagttggttccttccagtgggttcgtggtcttgctgacttcaagaatggaactgcggatcttcgtggtgagtgttacagctcttaaagatggcatggacccaaagagtgagcagcagcaaaagttattgtgaacagcagagggtcaccactgctggctgggtggcggagggggttgtgtgtgtgtgttggaaggggcagcttttattcccttatttgtccctgcccatgtcccgctgactggtccattttacagggtgttgattggtccattttacagtgtgctgattggcccattttaaacacttctagctagctacagagcattgattggtgcatttttacagagccctgattggtgcattttacaaacctctagctagctacacaaaagttctccaagtccccactcgacccaggaagtccagctggcttcagctctcacaggtcttgcagctgaaacacgagcatctctgccgggcgtggtggctcatgactgtaatcccagcactttgggaggctgaggcaggcagatcacctgaggtcaggagttcgagaccagcctggccaacatagtgaaaccctgtatctactaaaaatacaaaaagtagctgggtacgatgttgtgtgtctgtaattccagctactcaggaggctgaggcaggagaatcgcttgaactcagggggcagaggttgcagtgagccaggatgatgccactgcactccagcctgggcaagaagagcgagcctgcctcaaaaaaaaaaaaaaaaaaaaaaaaaaaaaggaagaaagaaagaaagaaaagaaacatgagtatcttcttagaaacggatgcagcccacgtacagttatgatgctggctttgaaacaaaacagtaacattcttcataccgaagttttacactccccacttgtcagaagaaaaactgagacagaataaacaaatcgcttccaggcagagatgaagctaggattggaagccaggaccaacagtccccgaagggtatagaacagtcctgctgtgaacaaaagagttttagcagaatctgctgttgtggaaagggctaatacatcctcgtggagcgctgccgccagggctgtgctgctggccttgtgcagggagctcacgcaagagccagaggattcaacgggctggggcaggatcttctcagggagatggagaaccagcagtaaatctgcgtgtttgcatttttcttgtgttgtgctttctcaagcagccgacaggccccgggcggccccaccacagccaccctcggccagtgctcatctcccaccccacacatgtgcgtgtgaaacctctcttcactgatgcacccaggcctgggcttcaggctttagtgtcttcccttgagtgcttgggaacctgccttcagttttcagagcacgaagcactgtgccatgtcagctctgaacctgaggcccttgagattccttgactccaggttgctggagagctctcagcatcatcctgtggagctgggcagcagctgcagatgaccacccactgcctccagccagacccagagccccaaaaggagtgggctgtgaggcaatgccaggggcagggggccaggagcacaccagtcacatgaagggaccagccccacagggtctgtgtgtttttctccccgtgtgcagagacaagagatcgtagaaataaagacgcaagacaaagagataaaagacagctgggcccgggggaccactaccaccaagacgcggagaccggtagcggcccagaatgccaggctgcacttttattggatagaagacaagggggcagggtaaagagtgtgagtcatctccaatgataggtaaggtcacgtgtgtcacgtgtccactggacagggggcccttcgtcatttggcagccaaggcagagaggcagagagagagaggcagcttacgccattacttctgcatatcagagacttttagtactttcactaattttgctactgctatctaaagtgcagagccaggtgtacagaatggaacatgaaagcggactaggagtgtgaccactgaagcacagcatcacagggagacggttaggcctccagatggctgcgggcgggcctgactgatatcaggccttccacaagaggtggaggagtagagtcttctctaaactcccccagggaaagggagactccctctcccagtctgctaagtagcaggtgcttttcctttgcactgacgttaccactagactacggtccgcttggcgacgggcatcttcccagacgctggcgtcaccgctagaccaaggagccctctggtggccctgtccgggcatgacagaaggctcacactcttgtcttctggtcacttctcactatgtcccctcagctcctatttccgtatggcctggtttttcctaggttatgattgtagagtgaggattattataatattggaataaagaataattactacaaactaatgattagtgatacatatataatcatatctatgacatatatctagtataactcctgttattttatatatttgttatactggaacagctcgtgccctcgttctcttgccttggcacctgggtggcttgccgcctatatcacatgctgtgggaacagggccgctggaggaagacgtggtcgggagtctctgagcgccctaattttatcaaaacagagtgatttctccaggacacactgcccccagtgtatctctgcaatccaatgccagccccaatctcctggcctgcatttcctgatgcaggctctgtggtccccgctggcactagtgatggatcctgcaccctctggggcagcaccccccactcccccagcatcccacacacccccaagcaccccatgcccccagagccagtgcccctccctgtgggcatcagatcctacccccaccaggtctactcctaagtggtgtggcaaggacaactgggtgtggctcccaaagccaggaggtccgggacgaggtggagtgctgtatcctaccccatcacccacctctgaggggtgccaggactttataaatcttcctgaaaactgagggtggaaaacagaatacccatgggtaacaataaccactccgcacctgactcaacacagaaatgaagactcaagaccatcagtgaaaaatacttatttcatgtgtttaaaaatacattcttagggtgggccctgcaggaggagacaggccgtccacatctccttcccaatagtgtgtccaggtcgtttccaaaatctgtgggtccctcacagcttctgatgacagctgctaatgccatttgctgaggaacaaggatggggaggatggcgagggcctggcccccagggcggccacaccaraaggtcggagaaaggcccaaggcggatgccacgcccagcagtggtgactgccccccactccttttctgagtctatcagcattgtttggttttcttcttgttgcttttaaatcctcgagcggcaccctgaccaaagcagatggtagagggtattctgggatggaagaaagtttctattagatgctgtatttgccaaccaacaacccaggtcataacagcacttgtgtgtctccttctcattctctttcactctggsaacatgcggaatgcagagccggccctcctgggccctggggcagctccctttccacagcctgagacctagttcctgtggggggtccccgccagccaccaacgcacaccygctgggaagaactccgcagagagggcggctcctgccaagccctctggggctgagacttcctgctaccccatgtccattccatgaaaacccctactgtcccagccccccggggctcattcacaggccaaagtccaggcatctgtaaggagggtgcagggaacattaagttcatcgttccacctgtttggagtctttggtgatgtttttccccacttgttcaccgtttttcccaaattaatttaaaatcaactttaactagaaaggcagacggcacaggtgacgctagaaaggcagacagtacaggtcatgctagaaaggcagacggcacaggtcatgctaggaaggcagacggcacaggtgacgctagaaacgcagacggcacaggtgacgctagaaacgcagacggcacaggtgatgctattaaggcagacgcctgggttgtgactgaagcaactgcaagtgagactctttccatcccactcagacaatgaggaaaagtgagtggtgcttggcattcctgcgcttcaatggctcaaaaacagagtatgcgagagaaactaagttattcacaggacctgagatatctggactttcttctctggcggaagccgattttcttacccagcgttacctttctgaattcagtatgagaagagctgcggcccaggtgcagcccagaatcctcagcaccgaacacatgttgagaacrggtttcagaaagagctcagacactgacctatgtctgtagatccgcctctcacctgccggtgcaggggaggctgccacaggctcagagcagatttccatggcctccccttctgaccgctctccactgtcccctggggcttctgctgaggctgggctgcggggagagagcagtgagtaactgccctgcacggctcccacagcccctgtgttccccagaaatgaacatgcaagaaagaaactggatttccctgtaagtagcatattttcttactattttggcatagtctgattttatagtgtggtttaagatactgggaaaaggagaatgattacagcaaggccattgtttatataatagagtctgcatcttataaacttaactgtaacaatcatacttttttttgaaaatagtatttttatggtgccaacggtgccacgggtctttttatgagtgtgagaaatttgctaaagttaaccagagactataaactagtctcttccataatacgaatgtcttaatccagcattgcacggtttttctccttaaaatgatccctcggaaaggagacaattactttacacgtaagtctttgtaaagcctcccacattgcagtgggttctcccagttcttttattttaaagagcaaattactacttgagaaaatgtagagtctgaaaaactctgatcaataaaattgtagatgattatgaaagttcacctcatcagttaaaaaaagaagaaatataacacaatttaaaaattgttccggctggacatggtagctcatacctacaatctcagcactttgggaggctgaggcagatggacggcttgagcccaggagttcacgaccagactgggcaacatagcaagaccctgtctctacaaaaaatagaaaattttgccgagtgcggcgatgcgtgttggtagtcctagcactttaggaggctgaagtgggagaatcgcttgagcctgagaagtggaggttgcagtgaacctacatcacaccactacactccagcctgggtgtcagagcaagaccctgtctcaaaaaaaaaaaaagattgttcctggaagtatttcccagagtgcactctaggcaggaacatgttaatcaacagctttgtcatcaagttcatatgcgcacaaccaaccaggacaaaaggaaagccagggctgcatgatgtgtgagcacggccgacggctgcaggaggtacagrcacggccccgaggggtgtgagtgcggatgaccacggccgactgctgcaggaggtacaggcatggcccagaggggtgtgagtgcggaggcgctgcgcccgctcattcccacaccccctctgctgcctccaccggcacagagctgggcagccaggggctcccctccagcctcccttcggcagggtggccgctggcacaaccacctgtagctgtgttgccagggcttcaggtacctgcaggtgaacaccccattaggtgacacacaagtgcttaataagtctgaccgtctatgcattccggctagttggaaaccttttcctaaaatcaaaagcagacacgtgctgagcctggcggctccctaccttctgcttttctttggcttatcaaaccggaagtccgcggggtacaggtgcatcctcaccatgtgatccttccggtctctgctggtcttgaacttctctgtgcagccttctaccaagcactgatactgaaatggagaccgtgtcacctccctctgacccctggccctcccccaccgccatgcccccgtagcagagctgccaagggcggaaaggtgtccccggccttgcccgagcacccgagagctgggggcagcactctgagcccatcaccaatggggggtggcctcggcggctgtgcagttgtcacccaccatgtcctgcctctcagacaggatctggaagagcgaatcgtgccactccaggatgtgggcgtccagcaggtgtccggaagggaaggcccgcttgcaaaaggagcaaacatttccgtgcagcgtgtggtagtggtgctcgtagtcgtccagggcatcgaacacctggcagcagccggccacctggcaggcaaacgcgggcaccctgccaaggagacgtgcttcaggagcccttcctccggtgcgaggaaccaagctggactttctgcacagtttccctttgagacgtccaataaagcccctatgcatcttttgcaatcccaaaccctctttttatgaattaagtttcacaaacaggctaggtggtggaagagtcggccacgccaaagctggacaggcacagcgcctcggtggggcggccgcacatggaagagcggcagcacagccccagggaccaggcaccggtcagggaggcggcgcaggagtagcactggctaggcactgcccattcgcttacctgggcttctcaggcacgtcggccacctgcatgatcacgtcctggaggtagaggtggcgctgcacgtccccatcctgcaggaaaagtgcgccgtgggcggggccaggtgactcgcggcacgcccaccgcgtcaggcctcgcccacacccgtggccccagtcatcccgcgctccggtcccgccccacagcctcaggccccgcccactccacgttccggccccgcctgtcccaggctccggccccgccccgcagtcgtaggcccctcccactccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagyggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggtgagtcctggccgaacgcgggcgcgggcgtgatgagggggttgggggactgccaggcccgggggggcccacgaggcgacggggctggcsggacgsggctcttcccgcgcgctccctctggctgtgcagcggtccccgaactctggggccgaagcccttcgggcctgcaccggccaggccagcgtcttgccccgcggcccgacactcagccggggcggggcggagcgggcctccgggtcgtcccgggtgtcccctcccagccctgggaagccgggtcgcaggtccccctctcgcacgccctctcccgtccgccttgccccgcctgtcgtctcccgctgcagtccctggatcttgttccctctaaaccagtcgcgaactggagccaaagtgactccagttttattgtaaccgtttttaatttaaagcccttgggtgacttcccgttactttagttcaaaggccctttcctggtttgtcggggtcctgtcgacctctccagtccccgcagctcccgtgaaacacaggacctgtgctaggtgctcagggcgtgtgggggaaggcatcacaggagggcgcggcagccttgtaggagagrcagacgtcagagtaaagagtcacctaattaaaatggtgaatgacaacacacgcgggaagcagtggacgcttcagatctactgcagagaatgggcccagtggcggatagaggctttagctttctcgtctgtcacccaggctggagtgcaatggtgcgatcatagctgatagatcgctgcggcctcaaattcttgggctcaagtggtcctgctgcctcagcgttccaaagagctgkaactgcaggcgtgagccaccatgcctgcccctgtactttttccatgtttagatacacaaatatctstgtgttacagttgtctagtgttcagcaccgccacctgctgggcaggtttgtagcccacgagcaagaggctcctctaggtggtttaggtgcattgtaggccgtacaccatccaggtctgcgagtgactctgatgatcgcacagaaggaaatcatgtaaccatacgtttctctttttttcttttggagatagtgtctctctctgtcgctcaggctggagtgcagtggcgcgatctgggctcactgcaacctctgcctgctgggttcaagcgattctcgtgcctcagcttcccaagtagctgggattacaagtgtgcgccaccagscttggccaatttttgtatttttggtagagactggttttcaccatgttggccaggcatttctcagaatgttgagtgatgcatgactgtactttctgtctctgtaaaagcctttgggctcttgacattttccacaagttgtaaaataacatttttcaaaccaatttgtacagttagctttgagctctcaacagagactctttttcacgtccctctgtgttttaatcacttggagtgtgtgctcactaggagtgtgtgccccgcttgtccgtggtggagtgtgacatgcgtgcattgcttccctcagcacgcgtccctgcggtagctcacagcctctgtgaggaggacgtcagtccctcccagtcacagttgctgggcctgtcagtttgtgtgattaatagtaagaattcaggagcatcaagaaggccaagtcagcggccatggctagacgttcctccaagaagcrgccacggctagatgttcctcagagctgtgttttcagtgggacgctgtgcatttctggcgggacagctctgttgatgattagcrtcccccgcccttgccctctaagtagcgagagcacccttccatgaccgtgacaccccagagttgccctaggacttttccaaaggtcttctggggggagggactctgtgcgagtacgggctgccctcttggaggcccggtccccacattcagggagagcagcaggctcctcatgggatgaacactcatgacgtgcgggcatctgtgcttctatttctagaagagatacgaagtttcctgaaggtagtttttattttttttattattattttttgagacagagtctcgctctgttgcccaggctggaatgcagtggtgtgatcttggctcactgcaagctccgcctctcgggttcatgccattctcctgccccagcctctggagtatctgcgactacaagcgcccgccaccacccccggctaatttttttgtatttttagtagagatggggtttcaccatgttagccaggatggtctcgatctcctgacctcatgatccgcccaccttggcttcccaaagtgctgagattacagscgtgagccaccgtgcccagcatgtagtttttaaataaatactcagatgatttttcttcataggtagctttctctcctgacttgtgtctggtgggggagtgctttgttttggtggcaaatggttttcttgccacctagcatgaccaaagtgtttctcagaccagcagttataggacaacctgcagtcctcggggagccgagtagaatgtgggtgaaacaggccacccttggatttgaaggggccgctggccggaaagtttgggctgtcttttctgcttcacaagtagtttgcagggcctcgtccagggctcccatgactgttaaaaaagcatctggtagtttaagatgttgtcagtgattgggacccaattttccttttgtaaacctaaccatttcccagataacagagttaacacctccagggagcaatggtgccgcatgtttgtttctgctttcctggtaacaacagtgtaagaacttaccacgtatgggcccttctgtgctttctcagggtgatttcacttctctctaccacagctctacgcaggacctagggcttccccttttcagaagaagcttggagaggacgtgtccttgttcagggtcccacagcctagaagtagccacgtcagtgtccagactgcatggggctccatggcgcgtgccctgctggccttgtgcttgaactgtagttaccgtgagcacctcctgggtcaaaagcatgtgtgtgagcaactcagcaccatgccttcttatcgctctccttccattttcggagataccctgcctgtgaccagtatttgatgttcatctacagataaactgtcttccatcacacaggattagaatctcggtgtcgagtcccgtgctaataatcgttagtgaattagcatattgtgggagtatgtgctgagtcttctgtactctattgtagggaccagccccacagggtcggtgggtttttctcctcgtgtgcggagatgagagattgtaaaaataaagacgcaagacaaagagataaaagaaaagacagcgggcccggggaaccactaccaccaagacgcagagaccggtagtggccccgaatgcctggctgcgctgttatttattggatacaaagcaaaaggggcagggtaaagagtgtgagtcatctccaatgattgataaggtcatgtgcgtcatgtgtccaccagacatggggcccttccctgttacgtagccgaggcggagagagagaggacagcttatgtcattatttcttctatgttcttttcagaaagatcaaagactttaatactttcactaattttgctactgctatctagagggcggagccaggtgtacgggatggaacatgagagcagaccaggagtgtgaccgctgaagcacagcatcacagggagacagtcaggcctccggataactgcgggcgggcctgactgatgtcaggccctccacaagagttggaggcgtagagtcttctctaaactctccggggaaagggagactccctttcccggtctgctaagtagcgggtgtttttccttgacactgacactaccgctagaccaaggtccgcttggcaaggggcatcttcccagacgctggcatcaccgctagaccaaggagccctctggtggccctgtccgggcatgacagaaggctcacattcttgtcttctggtcacttctcactatgtcccctcagctcctatctctgtatggcctggtttttcctaggttatgattgtagagcaaggattattataatattggaataaagagtaattgctacaaactgatgattaatgatattcatatataatcatatctatgatctagatctagcataactcttgttgttttatatattttgttacactggaacagctcgtgccctcggtctcttgcctcggcacctgggtggcttgccgcccacactcgatgttttgttgagctcatccttgtctccctgaagctgtcagcagagtggttgtttaccttttttgggtcatagagcctttgagaatttgttgaagggtcatctcctcagaaaataaaaagttattttgcccataactttcaagggctcatctgttactgattactcatggataccggcttaagaacccttgtgtagatgaaatgtttgtgaagcatgtaaagtttgcttatatttgttttgtaatctatagccagttgccttgcctgtgttttttgttttgttttgttttttgttgagacagggtctccctctgtcgcccaggctggagtggctcaagcgatcctcccacctcagcctcccgagtagctaagactacaggcatatgctaccatgcccagttaatttttgtattttttgtagagacagagtctcactgtgttgcccaggctgtcttgactcctggcctcgagtgactcacctgactcagcctcccaaaatgctgggattccaggcgagagccactgcacacagccatgtgtttgtcttaatggccttgtatcggaactcttggtgacagaggctaatgagcagccactggtgggagagtaggggcggcgctcaccctgccccctgacccaggggtgggctcaccctacaccctgaccccacgcagtgttctgctgcccacttgggtgtctgtgacgccttcgatctcatatgtgttatatgtctcctggtgagcccctggggcagctggagctgcagtggaacttcacctagctcaaacgtgtagggaacgtgtagaagtcctaccagaagcgtctctgtcggtagccacgcttgggcaagaaaaggagatgtcacgggtaccagagtgaaaaagtaacgcagagccggccaagtgaatggagctgcggctgagcaccgcgggctctgagaaccagtgtgggcctctccggtrgaagctgggatgttactgtgtgtgccggtagctggcacagtgtcaatggcttgggcctgcacagagctccctgtgtagaccccacaggcctcacgtctgggaccagaaagctctgtccccaagccgaggcgagcagcagagcattccctgctggcccagacccatgtgtggagggaggtgcaggggaaagggaacctgggtctcaggccccattcatgctgcccacggggctggctcccggagctgcggaggccgcctggaagctggaggcaggtgaatcccaggcccayscagaggaccctctgagaggctgctggggtgtcggggaggggccctaatcccagkcccatgcagaggaccctctgagaggctgctggagttyagggaggggccctaatcccagtcccgtscagaggaccctctgagaggctgctggggtgttgggcaggggccctaatcccaggcccatgcagaggaccctctgagaggctgctgggctgttgggggaggggccctaggccaggcaggccaggtgataacttggtttgtcaaagcctgacattggccagtcttgagtgtttaaaaaaatgttttttatttctacagtttgaattttatgaatagctgtcttcttacctataggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgcccctggtgcagggctgtgtaccgtgcaagatgcagggtgagtgcccgttcctgggtggcctcaatggtaccggcaacgatggcagacagcacttggtctgtgtgtgtgttcagctctgattctcctgactccccccagcagctcctgtgattcaccccactgtgcagatgagtaaatggaggcctatggagaaagctgggcctagaaccctccctcttccccactctgtcccctgcagccatgaggtgggagagtcctgacatgtgcattcctgtggataaaaagggagggactgggccaggcgcggtggctcacacctgtaatcccagcactttgggaggctgaggcaggtggatcacaaggtcaggagatcaagaccaccctggctaacacggtgaaaccccgtctctactaaaaatacaaaaaattagctgggtgtggtggcgggcacctgtaatcccagctactcggggggctgaggcaggagagtggcgtgaacccgggaggtggagcttgcagtgagccgagatatcgtgccactgcattccagcctgggcgtcagagtgagactctgtctcaaaaaaaaaaaaaaaaaaaaaaaaaaagggagggactggtattaaccatgttgaaatgcctttaaggtattatttctttattcagataatatgtaattcagaagtatagattttcagtaaaaatgattttgaatttgaagtctattttaaaaaatacattatgaagcttcagttatttaaacaggttaacaatggcacaaggataattaggcaaattagccgagtggaatagagacttggggacacccatgtttagttcattctgaaggaagcattgtaaatcactgagtaaaacataacccctgctgggcacggtcgctcacacctgtaatcccagccctttgggaggccgaggcgggtggatcacctaaggttgggagttcgagaccagcctggccaacatggagaaaccccatcgctactaaaaatacaaaaattagggcgtggtggtgcgtgccagtaatgcagctactcrggaggctgaggcaggagaattacttgaaccagggaggtggaggttgcggtgagcctagatcacgccattgcactccagcctgggcaacaagagcgaaactccgtccaaaagaaaaagcataacccctagggttgcacataataacaaattccagagggaacatagtgaggtgtatacaatgaacgcataaactactgsggggaatacagtgagatgcagacaatgaacgcataaactactggggggaaaaggtaagtcgctactctccagtacaaacctgaagaagcataaaagggaacacagtgagatgcatacaatgaacgcataaactactggggggaaatgcaagttgctactctccagtacaaacctgaagcagcataaaagggaatacagtgaaatgtatacaatgaacgcataaactactggggggaagtgtaagtcgctactctccagtacaaacctgaagaagcataaaagggcgggcgcaggggctcacacctgtaacgccagcactttgggacgaggcaggtggatggcttgagcctgggagtttgagagcagtctgggcaacatggtgaaatcctgtctctagaaaaaattaaaataatacgaagaagcacaaaaggaaaggaaccataatgggaaatacggataaggtttgttttgttttgttttgagacagagtcttactctgtcacccaggctggaatgcatgtggcacgatcttgtcttactgcagtctcaacctcccaggctgatgtgatcctcccatctcagcttcccaagtagtgaccacaggcaagtgccaccacgcctcgctaatttttgaatctttttgtagaaatggggttttgttattttggccaggctggtcttgaactcctggactcaagcagtctaccagcctcggcctcccaaagtgctgggattacagkcatgagccactgcctagctcaaaacatggataagtttaacacaatatggagatgagttttgttagtttatttcagagggataattatttaacctacccaatttaattccattggcttattgtgttcaattttcgtaaaggtttttttttacagtgctttattaattaccgtcattaaatcactcatgtttgtgcttttgaggttaaaattgcagagttttctcgtactccagaagactttctaaagaaatatgatgaactgaaatctaaaaatacaaggaaccttgacccgctggtgtacctgttgtcaaagctcacggaagacaaagaggtaggtgcccatgccacgtgccacactgcgcccgtacggcccatgttgggagtggggtcgcgtctcctgctcactccacgccatcttcctgtcagctcttcctcgctcacaccagtaacgcttctaggccatgtaggaaatttttggtgaatcagaatgaaagataacccatgttgggtgtaaacatgagaagcagcctctggggcactttgagcttcccgcatgtgtcacgctcagttcctgcctgtcgcacgcgtcgctttgctattaatgggtgcctgtcagggttggggagccgtcctggtggtgtygtccctactctccccctatggccaaagaggtgctggcccagtgtgaacacacagttttacatgttttcagactctgcagtacttacaacagaatgcaaaagaragagctgagcttgcagccrctgctgtgggcagcagtaccaccagcatcaacgtccctgccgcggcctccaagatctccatgcaggagcttgaggaactgaggaagcagcttggcagcgtggccacaggctccacrctgcagcaggtactgcgtccatggctgtccacaggctccatgctgcagcaggtcctgtgtccgtggcgtccacaggcacccacactcagtgctgtgccgggcccctgctggaaggacatgtctctctgtcatttattgaaaatgaatcccttagagaggccaaggcttaatgcttgatcatgacctagctctatatgtttagttttttttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctygaaaatacagtaatttttattattccttctgtatttgctacttgctcttggttttgattttatgccctaccctggtcttttgacgtaagtcatctcccagtctctctcattagagctgmcacgttcctgcctttgtgacctttaaactccctttggagctgtgtccctgaggcgtcctakcctcctgggtgcgtgttgagtgcagcggctcccaaggacccagccggttcttgctgggcacgttctgtgctggacatggtgctaggcctctgtccacgtctccctcagccstggcagaagactgggtcttactgccacgtgcagagacagtttgcatctgcccgtgtccctgaccagccctgagtgggagtcagtgcttccgaaagctgggccagcccaggccgaccccatcagcctctggcggccactggcgcaggagggcaggctctctgaccacatgtcaggagccatcctgtcacgctggggcccttctccggcagggtaaggatgcatgtctgttgctgaagcctgtcttcacccatcaagtggtgttcagacctagtcactgccagaaagaagcaattcagcttgttcacagggcgccctcctttgaaacagcggctctgtgcctaggtgcaccctctcccgtggttcccactgctggtgctcatgttttcccaggggggcccttgcaggacctgcactcctgagaagaggggctagggctccccatctgccctgttgtccccagcccctcacgttgtggcaggcagggatgtcgaggcgcatttcatttctatgtggttgaccctttgtgggtgttgaattgagtaatcatctttgccgtagatgctagcttctatgcatgtctttagttgagtgtttsygctaaagtgtatctttctggttttgttttttaaaatgtccttgctagtctctggaacttaaaagaaaratgcttcgagacaagcagaacaaaaaaaattcaggccagcacctccccatcttcccagcatgggtgtatgagagacctgccctgatcggggatttcctgattggtgctggcatcagcacagacaccgctttgccgataggtacgtgatgcgttgatttccgggctctgccgataggtacgtgatgcgttgatttccgggctctgccgataggtatgtcatgtgtttatttctggcctctgggcaggacactttgcaggcccagccctcccccgggcctgcctttcctcaggttgtgaggctcaatgctgactggctgccgcctccatattcccatcccaggatggcagcagagaacggctcacccgggtccttgagggttcttctcctgtcccttctgccagagctgtggggcagcctgcagcaggcccctccccagccggcatcctggtgccctggtgcagacctgcaggcatcagaattgtgtgcagcacttatttctgaacagcgattcatgactcccatagattctgttacagcagtattctcagaggcctcttaagtagtgttcgtgtaaacaagatgcgggtgagaccacacagtcatttcaagacgttgttattggggacctgggatgtgttcatctgtcacaattcatgggtacatttttatttttatttatttttagttcttttgagatggaatctcgctctgtcgcccaggctgaagtgcagtggcgtgatctcggcacactgcaacctccacctcccaggttgaagcgattctcctgcctcagcctcccaagtagctgggactgcaggcgccaccacgcctggctaatttttatatttttagtagagacggggttttgccgtgttggccagactggtctcgaactcctgacctctggtgatctgcccaccttggcctcacaaagtgctgggattacaggcatgagccaccacgcctagtcaagtacatttttagattgaaaaatgagatttcacaaactaaggacagagcatacctgcttatcttgccccatccccgttagtccaaactcaagaggcagcatggagcgtggtctgcttccccactactcacggctctgcaatgtgggcaccaagrggccaacccttgcctttgccggaaaccctggagaacggtgacgtgaaatccacctgttttcctcatccccaagcaaacagaaccctgctgtaagttaatgaaaagtatagaaaaaccctgctgtaagttatgagaagtatagaaaaccatgctgtaagttaatgaaaagtatggaaaacagtctacttcggccaggcatggtggctcacacctgtaatcccagcacttagggaggtgaggtgcgtggattccttgagcccaggaattcgagaccagcctgggcgacaggacgagactagtctctacaaaaaatgtgaaaattagccgagtgtggtagcgtgcacctgtagtcccagctactcaggaggctgaggtgggaggatcacttgagcctgagaggtcgaggctgcagtgagctgtgatcgtgccactgcactccagcctgggcaacagagcgagaccctgtttcaaaaaaaaaaaaacaaagcagtctgctttgtgcagtgttttcagtaataatccaactgtgaaaacccaactgtgaagacttagggagagagagctgctcccttagcgggtactcagcaggcagccggggagtggtgggcacctgagagctcctgatggtacccaggcagacttcrgagaaggaagcgcggggccctgctgcctgggatcccagcagtggagccggctttttggagcaggaggcactgagggggtgttcaggckttccccccatgtttccccattcagggaaggggttgtacaaaagaggaacgcactgtccagtaacgctgcggcgccgtgggcagctctgagcgtggcggtgattggcagcaagtgtgtgagacttggctgtgaaccctgcagccagctctcaggtcagggtgcaggtgccctcagcacactcagcatcccaggaaaggggcggcctcgccccacctccctcccacggmcacataccacaggtcccaggggtgcctccggtattgaggctgccttgcctccctttgtccgcactgtccctgtccccttgtgccacctgtgcagacttgagaatggagctcactgtggtgttcatgccggggcctgtctagctcctcaccccacgatttgaccagtgccacaccacgggaccttgtgtgacctcgggcctgcgtcctctggaaaacagctgtggagtggtgtgatgaggacaggtgccttggaaagcatcaggaccttgtgagcacgaggcagctgccagcactccacgttcccgccatgctctcctcaccgtgtgggcatccacctggccagcgccgcctccgcagtgcccctccctctggtcgctcccgcgcagcatgcgaaggtgttatctgcccgcgtcctgccttttccccacaccggcacggaggagccacgtgttcggtggtcgttcggacgtggtgatttgcaggtgacatcgcaggtgttgagatgacactgaggatgttgaatattggggaggtgaagcaactgactctttttttgcttgagacagggtctcacttcgttgcctaggctggagtgcagtggcacaatctcagctcactgcagcctcgacctcccaagctcaggtgattctcccacctcagcctcccgagtagctgggactgcaggtgtgcaccatcacacgcagctaatttctgtattttcagtagagacggggattcgccgtgttgcccaggctggtcttgaactcctggagtcaagcgatctgtccaccttggcctcctaaagtgatgggattacaggtgtgagccaccatacccggcctaaagcaacccttgaggtccctccacagccaggcggctggatccacactaacccccaccccacggcaccyccaccccaccgtgaggcttctccccacaagggcattggccgaggcttcgtggctgtggatgaatgaggccaacatggtggaaagtaagtgatgcagagtcagaggcagttcctggaagatgcactcgctgttcccaaaacgccaagccacacccactcctttagggatggtagacattggggtctcggttttattggtcatcctgagaaggccactggagtaatagaaagaaatggaatttgaagttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcaccactgccctccagactgggtgacagagtgagatttgtctcaaaaataaaaaaaggaaaaaaaaaaaacaaggacagtgtggatctgcatcaggattgaggctttcgctgaagggcttgcgttggtgacggattgtagtcttgaggcctgcagtcacaggacacttcccagcagatgtgtgaggctgacagagtgattttgtaaaccgaaagcctgttgtacggagccttcctgagctgccagggcctggtttgggtatggtctggctggcacggggccctgtcaggccctcgtggggacagtttcaacatcctgctttcgtctggtgctcctcccggccccccaggcatggcccgcctgaggctgtggactgagaacttggtcctgggacctgaggggtttggtgggtggcggcccgtggccgtcctcgtgaggaagcttagctgtgtgtcctgcagccgtctcatcctctctggatagaaattatcaagagtttcttaacgtttaagtgatagctttttaaagacaaggttttttgtcccagagtaactcagacttaccaagttgtacttaccaatgttgaaagtgcagcttctgctggagtcgccttttcaactcctaacttcaccttttcaaatgtcagccatgtatctgagcattgcggagccgagtgtggtgagatcttgacaccagccaccacgcctcccaggccggccccgtcctgcggcggttggaactcagcctgtggctccccagtggggtcagtcaaagccaagtgcagtggctgaccttttatacccataaacaaakatgagcaagagtgagactgacccgcagatgagggcacgtggctgtgggggcatgggagtgggggctgcrgagccacagcgctgtctgtgcccgcaggcacgttgcccctggcctcgcaggagtcggccgtggtggaggacctgctgtacgtgctggtgggcgtggacgggaggtacgtcagtgctcagcccctggctgggaggcagagccggaccttcctcgtggaccccaacctggacctgtccatcagggagctggtgcacaggatcctcccagtggccgccagctactccgctgtgaccaggtgggcaccgggcgcggtccctgggagcctgygctgttgtgggggaggggttaggtcccatcctgatgaccatggggacgtctgcatcgcttctaaagagagcgcccgccttggtgacaactccgtgcccaactcagttttggagggtctgtgagtcaccatccagggtcctgactcatctcctcctggggcaaaagttcccctctgggatgtggggttcaagtgagtcatttgcttcctgtttgggatgagactcagaatatcggacattgtatgtgcctgcagcttgcctttttgaggaagtctgacagcttttcttccaggttcattgaagagaagtcttccttygagtacgggcaggtgaaccacgccctggcggccgccatgcgcaccctggtgaaggagcacctgattctggtgtcacagctggagcagctgcacaggcagggcctcctttcgctgcagaagctctggttctacatccagccagccatgygcaccatggacatcctggcctccctcggtgcgtgcccgcccggggggcatggggcagtggtgggtggcaggtgttgaacatggcacccagtgtgaggagagactctgcaggggccgtggagcagctgcccagggcaggggcgtgtggccaaagctcatgttgctccatgtgctattaacttgcaagaggaaagccctggaagctcttactggtcagctgaaatcagcaactacaaccttacagttaatacgtatcccaaagaagcagcaccgtcccaggaagaaggttggagaagcatgaggggccccagcagtgttgttggcagaggctgggcgtgcgcttccttctcagcagtgagccctcctttctccccacagccacctcggtggacaaaggcgaatgtcttggggggtccacgctgagcctgctccacgacaggagcttcagctacacaggggacagccaggcgcaggagctatgcctgtacctaaccaaggcggccagtgctccctacttcgaggttctggagaagtggatctacaggggcatcatccacgacccatacaggtagggctcccygggacacrggggacacggagggacatgggggacacggagggcgcgtgctgccctctcccgtacaggtagggctccccgggacacggggacacagagggacacggagggacatgggggacacggacggtgcgtgctgccctctcccgtacaggtagggctccccgggacacggggacacagagggacacggagggacatgggggacacggacggtgcgtgctgccctctcccgtacaggtagggctccccgggacacagggacacggagggacatgggggacacggacggtgcgtgctgccctctcccgtacaggtagggctccccgggacacagggacacggagggacatgggggacacggagtgtgcatgctgccctctcccatacaggtagggctccccgggacacggggacacagagggacacggagggacatgggggacacggacggtgcgtgctgccctctcccgtacaggtagggctccccgggacacagggacacggagggacatgggggacacggagtgtgcatgctgccctctcccatacaggtagggctccctgggacacagggacacggagggacatgggggacacggagggacatgggggacacggagggacatgggggacacggagtgtgcatgctgccctctcccatacaggtagggctccccgggacacagggacacggagggacacggagggacatgggggacacggagggcgcgtgctgccctctcccgtacaggtagggctccctgggacacagggacacggagggacatgggggacacggagggacatgggggacacggagtgtgcatgctgccctctcccatacaggtagggctccccgggacacagggacacggagggacatgggggacacggagggacatgggggacacggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcratatatttaaatgcataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaaagaaagcaccttcacacttgaagtgcgtaaatgatgtttgaagttgttcagatgatgacgtggagatgtctggtttctgtcaatgttggccccgcctaccccacacgagcatcattttgggtgtcagggccccacgcaccccacacgagcatcattttgttgcctgggctcatcatggaaggaaatgctaaattccaaaaagaggtgggtgcagataaagacaaatcagtttcccacctatctctgcggaccgtacattctccctgagcccaggttaaatactccgttccagagcgaggtttgtaggtttgttggttttcttttytttttttttctttttttttttgaggcagagtctcgctccattgccaggctggagtgcagtggcatgatctcggctcgctgcaacccccacctcccaggttcaagcgattcccctgccttaacctcccaagtagctgggactacaggtgcacaccaccacgcccagctgattttttgtattttagtagagacggggtttcactgtgttggccaggatggtcttgatctcttgacttcgtgatctgcccacctcagcctcccaaagtgctggggttacaggcgtgagccactgtgcccggcccctaggttcgttttagccgagaagtgttggggttacaggcgtgagccaccgtgcccggcccctaggttcgttttagcccacagttgagaagtaactggtagattaggctcggcccttgtggaacgttacttggaagtgtgctggcctctgttaatgtccctgcgcgctgccggcctggagaagtgtcgcctgcctcaggcgcccttgctttgcctgtgaccgaagcgctccctgtggttttagtgagtttatggtcgaggagcacgagctgcggaaggagaggatccaggaggattacaacgacaagtactgggaccagcggtacaccatcgtccagcagcagatcccgtccttcctgcagaaaatggcggacaagatcctcagcacaggtgcggcgcrgcrggcagggacytggsgtcckyggcgcagcgggcggggacttggggtgcgcagcacagctctgcctggagagtctcctgcagcccaggccctcccaccgggagcctgtgcctcaccctgtggttgccctgagccctggtgtccgtgaatgcggggctgaggtcaggactggcccgtgggctgggctgcggcgctgagttaggccttgagatggtctctgttgccaggttccctcaggtttccatctccgggactctgtccctgaccctgcgaggctctctcacaggtgccttctctatttctgtttctgatttctaaaactccgctagcatgtcaggaaaaaccagcaaagacacacgcctggcggccggcagtgtttcctatctctgaccacacaggttagggcctgacctggacccagggcagtggcgcggggacttggactcggcacatcggggccgtcacgaaagggttgggaagcgattagccatccggttctcataatgcctgttcgaaattatttctgtgcccttggttagaaaattccagatgtgcagagccacggcaaagccctgccaccaccagctcagtctgtagccgctgacagtgatttaccgggaaggagcaagggtgtggagccgcctcatgcagcccagtttccattccactgccttctgtgtagacaaagacagctggggcctcagactgaccgtgtggagagcccattcaatgtccattccactgcctcctgtgtagacaaagacagctggggcctgagatcgaccrtgtggagaataaaattttgaatttctgtgttttcaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtgattccrtgccctgtccctgtgcgggcactcacctccctctgaaaccggaacctgtgggacgtggggctgagatcgctgggtttcttctggcagctccgccttgtctttttgaaagtgggcactgctggatggtctctagctcaaggacctggcactcacagtgggtggtgtaggcccccggtcaccttgtccaggggccccagctcccctccttgcccagggcccaccagccccttctcagctcctcctgccacagcttgcgtggtggttgcacagcccctgcctgagagccaagcgcttagcctgttgtagtgtgttttagggtgatggctatggcgagcatctgtgggtgggcacgtgctcacgcctgctccctggccatggcgggcacctgcgggtgggcacgtgctcacgcctgctccctggctgtggcgggcacctgcgggtgggcacgtgctcacgcctgctccctggctgtggcgggcacctgcgggtgggcacctgctcacgcctgctccctggcgcaggtccatcaagcgctacttcctcatggaccagggcgacttcttcgtgcacttcatggacctcgcggaggaggagctccggaagccggtggaggacatcacgccccctcgcctggaagcgctcctggagctggcgctgcgcatgagcacggccaacactgaccccttcaaggacgacctcaaggtgggtgggggtgccgggggctgtcccctgtggcagaggcctcggaggggctgggaggagagcacagcagaggccagccctgtcccccactccccgtcccggtgaggcgaccgcagggtctgtttccttcacttggctaccggggccggcttgccgggatcgggggtctttgtgcctgtgctctggaggggcgcgggtctcgggttttcctgcagtgccctcgtccgggcctggctttcaggtcatgctggcctygtggaattgttttcacgtgtccctccatctgtcttttgaaagggtttcaggtcttttgaaagggtttcaggagtggtgttaattctttttgtttttgcctttttgttgtcgtygttttttgtttttttttttgagacggagttttgctcttgtcacccaggctggagtgcagtggcatgatctcrgctcactgcagcctccacctcctgggttcaagtgatgctcctacctcagcctcccgagtagctgggattacaggtgcgcgccaccacgcccagctaatttttgtatttttagtagagatggggtttcaccatgtttcccaggctggtcttgaactcttgacctcaggtgatccacccaccttggcctcccaaagtgctgggattacaggcatgagccaccgtgcccagccgttttttaaaatatatatatgttttatctgttttttactatttttaatagagacgggggtctgtgttgcccaggctggttgaacccctgggctcaagcgatccttcacctgcgcctccccaggagggtgttgattctttggctgtttggcagggtttgcctgggagctcttgggccctgggtttgtctttgttggagacttttgagggggacttggccccttgctggccacaggtctgctcagtccctttcctcttggtcggctgtctgtctcgcatcttgtctggtgcacagttcatgggtttctagtatctgctttttatttctgtaagattagtagttatatcccttctttttctgattttagtaatttgaatcttctttcgtcttagctgatgtagctagaaatttgtcgatttcattatcttttcaaagaaccaactcttgggtttgttgactgtatttttctgttttctctcttctgtcatctttgttactcctgtctgctgcttaggggttcagtgtggtcttcttttttctagtttcttaatttgaaaagttagtttacagctgtaaacatccctccgagtgcagccttcgctgatcccctagcgtcatmatttctgtttgtctggaggtgtttctgattccctctgatttcttgttggagccgtgggtggtttatgtttaacttccacatgtttgtgaagtttctggttttccttctgttgcttgtttctaactttatctccttgttagagaacagactttttgtgatttcagttttgtgaaatgtattgatttgtgtagtggccccacatccatcctggagagtgttccgtgcgcgcgggaggaggatgtgccctcggttccgtgcrcgcgggaggaggacgcgccctcggtgctgttggggtggtgttctgcaggtgggttgaggccgtgtctttcctcactgatcgtctgtcyggcggttctctccgtggttagaagtagggcaccgagtctccctgtcactgaagaactgcttttctccttgtcattctgtctattcttgattcagatattttggggtctcttgttaggagcaggaatattttcgtaggaaaaattcctggtagtgaaattgttgggtcacaatacatggcccttgtatgactaggctgaccttgctggagttgatggagtccagtctcaggacgctgctgtctgcacacctgcgaaagctcccaccttggctatttgatggacaagtgatgtcaggggctcatttctgcgtttgtgatggtcacgatttcgtctgtccgctgcttgtttcttcttgctttatcccctgcccttcatttcctgtcctgtcgttgtgcgatggttttgtaggaactctgttgcgggtggttggaacttagcaaatactygagtgattaacgtgaggacrgtattacttgcttataataactattatgtccctcgtcaaatatgcttcatttttcaacctgggcctggtgcttatcatggtacaaaggttttcgtcctaaggaatcacgtttctttcaccgtccttagcggtttttcccttataccacccacagcagcagtgggtatttacaaagtaattcatctgaatttttgttgttttgttctgatgggaagtggttcagttttgaatttgatttatcagtagatgtttgggtttttgaaaagcctctgatatttagaatcggaatgtagggaaccttacgtcagcgctgggtctgtgagcgaggatggcgatcgggatgcgacttcgggtcttttccttaaaactggatgctttgtttcatttccttccctccaagatcgacctgatgccccatgacctcatcactcagctcttgcgcgtcctggccatcgagaccaagcaggagaaggcgatggcgcacgccgaccccacggagctggcgctgagcggcctggaggccttctctttcgactacatcgtcaagtggcccctttcgctcatcatcaacaggtgcgggtcggctgctcgggcacctgccagatcttcactcaggtttggcagaagcgagaactgtgccacgcggtggccacctcgtcccacagaggacccaaggcggctctccccrgccttcagtgtccgrgagattcacgggctgtccgggggccacggtgcggactgtggagtacagacgccgtgtccacgacgccgccggtcacggaggcccacctgaggtgccgccacgtctcttgcaggaaagccctcactcgctaccagatgctcttcaggcacatgttctaytgcaagcacgtggagcggcagctctgcagcgtctggatcagcaacaaaacygccaagcagcactcgctgcactccgcccagtggtgcgttcttcctctgcccccgcatgccctcctgaagcagcgctcgctgcactctgcccagtggtgcagygccccccttgtgccctcctggtagacagctttctaggcttctggaagtgtcatctggaagcgcacgttggtggctttagatccataatgcttcattgcttcattttcctgtcttggggctgcacggcgctgccgtccaccccacaggggatgctggctctgtccctcagccctytctggagccttgtggtgactgcacgggcatggagactgcccaggtcggtgtgcaggacactagctcctcccgagagcggacagccacatcttgctgggaccagaggtgctttgcagccggtctgtgcctctagggtgttgaaaaaaggggtcgatggcagagcttcataagaatttgtccagtcgggtgcagtggctcatgcctgtaatctcagcactttgggaagctgaggagggaggattgtttgagcccacaagttcgagacccgcctggacaatgtaacaagagctcatctcttaaaaaaaaagaaaattattttaattagccgggaatgcctgtagttccagcaactcaggaggctgaggtgggagggttgcttgagtccaggaggtcaaggctgcagtgagccaagatcgtgccactgcactgcagtctgagcgacagcaagaccctgtctctcgaagaaaaaaagaaattagaagaaaaagaactcatcttgatgatgaagcacaaatatgcatctgttgtgtggcactttcctggcgtgggctccgaggggtccgtccaccaaggagcccgcgtcccagtctccaccgtccagctggctgggggtgtccctgcagggcacaggttggtagacggtgacagcttgtgctgggcagacgcaggagcagcggccgtgagtgtctggtgtgctgggaggggcgcttgctctgcagaggaaatagccacgtccagagaacgtcctccatggctgtcctccgtcctccgtgtcacttggtgggcgctgtcggggccgcgtcctccatggctgtcctccgtcctccgtgtcactcaggtttgctggggctttcactctgcggcagcgaatgctcaacttcgtccagaatattcaatactacatgatgttygaagtgatggaaccgacctggcacatcctggagaaaaacctgaaatccgtgagttttagctccacagataataacgtttgaaagccactttcctttcacagggagacaggaagtgcaggagaggcagggcgaggggagaggcagggagtgcaggagaggcagggaatgcagggagacgcagggagtgcaggagaggcagggcgaggggcgaggcagggcgtgcgggagaggcagggagtgcagggagacacggagtgcaggagaggcagggcaaggggagaggaagggatcccccagggcggggctgcacccacaytgctggccacacacgggaccccttgctgcctgccgtcctagggggactctgagccgtctttgccccgaggttgtctctcccacattgcgcatctgaggctgaggggcctgaaggcagaatctgttggtaccaaattccagaagctgccgcagcctcccttcctgtcttctgccttaagaaatgaaaccccttcggggtgtgcccatcatttttttagtggtgtttggaagttttcccctaaaagcccaaggcccatttaagaggtagaagtgcrtaaacaggaatgcacaaagccagaactgagcacgtgcgcaygcagggcccgtctgtcagccacgtctttctgagaaggggcttggcctgttccccgcaggcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcaggtgcgtgggtgtgggtagcaccatcgggtgggcaggcgcgggtgggcagaccatgtcccraccgtggccgcacgcagcctgctcacgttttcctgcccttgtgttygtggaggagccgctgggatctgagtgtttccagaactcctggtcttcctggccgggtgattccctcctggagcccctgccctggcagcgtgggcagggctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgagaatgaggctctccaggcagtgccatggggagggtccggaggagggcgagtggggaggtggaggagggcatggccacttcagggtcccaaatagggaaacaccaaaataactgttctcaggaaaatcagctggtcaccgtggaaggtagacctgggaattctgtcggcacagataagtcatttcccctgcagcctcagagatgcttgtgtacccccagccgcaggctacaacagaggtgcggagggtgacgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctgcccgcaggggccgaggagcrggcccggaaggagctcgccaggaaggtgcgtggcctccaggtttggccagagagagacgcttcctcccggctgggcggcagcctgggcatcctgacgcagggagaacaaacctccccccttttacttccatctcccctcagattgaagaaaagacttaaaattagcttccaagcacaagcacaagagcctctcacaatcttctcagctctctggtccccacttcagccagtcgggctcgagggaacccccacagatcttcagagcgagcgctgtgcagggcgcctgggcgagggcaggggccacacccgctgtccctgctgagctcggtcctgagttagaaccrtcaggctctcagcaggcacggacaggctgcatgtcctcggaggcatggccctgcggcgccggctccggggtggcatggtggggtgggcagtcccgtgttcacacgctggagctggagctggcagagaggagttgggtttggaagcgtgggggccggaggtgagggacactgagaggcgccccgacctccttgctgagaaagctgctgggaaagctcgttcatctcaccccaaaggagagtgaccacctcatcccacgaggcctggagtgtttctctgagtgctgggttctcaggaatgttttttgatgtcttttttaccttgaatctcctgaaaacatcatggaacccatgttttctatttaagaaaaggggaagggaaaggacaccggcctgctgggaacagygtggagccaagaaggcccacggtggggrtgggcatggctcacgcaccccggctttctttccagcacctggctgagcacrcagacactgtgcagctggtgtccggcttcgaggccaccatcaacaagtttgacaagaacttctcagcccacctgctggacctcctggcccggctgagcatctatagcaccagtgactgtgagcacggcatggccagcgtcatctccaggtgggtgggcgccaccccggctcagcccttcctcagctcagtccagcgcctgcccctgcccagcaccgccctggctcagcccttcctcagctcagtccagcacctgcccctgcccaacaccgccctggcccagtgctgtccykgctcagccktcccccagctcagcccagcrcctgcccctgcccagcactgccctggcccagtgctgccccggctcagccttcccccagctcagcccagcacctgcccctgcccagcaccgccctggctcagcccttcctcagctcagtccagcacctgcccctgcccarcaccgccctggcccagtgctgtcccggctcagccttcccccagctcagcccagcgcctgcccctgcccagcaccgccctggcccagtgctgccccggctcagccttcccccagctcagcccagcgcctgccccggctcagcccttcctcagctcagcccagcatctgccccagcccagcgccaccccagctcagcacctgtccctgcatccaggccccatctcccctgcaccctcccctggtccacctggtgtagcctccttcagaaggtggggcaggtctgtgtcctggtgctagtgctggtcatatgccactccctgaagtcaggctagcccagctctccctggggtgtgacattctgtgcaactgggctgccccattggcaccctgcggctgtgtgtgtcctgtggggctgatcaggcctgggtcagcttccctcatgctgcactaacacctagcctgggggaaagggccaggtggccaarctgccagcctggaaggggtggtgcccttgggggtgctgtccttgggaaggtgcctatttgtgcttttggaccaccctgtgccctgtgccccccacaaatgttctgattttctgagcagggatttctgaggccaccctgcattgagaaccactgcttggttctccaagcccctgacacctcaggccccattgctaggccctgttggggtgatgggagccccaactttctggggccaggagagaagaaacctgtgtttgtgcctttgagcaggactgaacaggactgaaaaccttcctgtggaaacattaattaggagcgtgcctcaccctcacccctgcagggcctcttatggtctctgtagctgaacacttccccatggtaggagcagggctgctcaggacggacccgcagaaggagtgtgtgccccagctccactgtccttcctcacccctgctgcccagcacgcacccgcagaaggggtgtgcaccctagctgcaccgtccttccacacccctgctgcccagcatgcacccgcagaaggggtgtgcaccccagctccactgtccttcctcacaggcttgacttcaatggtttctacacggagcgcctggagcgcctgtctgcagagaggagccagaaggccaccccccaagtgcctgtcctgcgggggcccccggctcctgcacccagggtcgcagtcaccgcacagtgagccctggctgtgacaggaaggaagggtgtggggtcagcagggactggtgcaaatgggtccrgaattttcaaatcgaatgctctgtgttctgtctttgcagtttaaatataaagcaggaatgattgactcagctcactttgtttctcaaggcgctgggtttcgttttatagaagctgcccaggcagggtggatgtctccctggatttgctaatctgtttgctttttgaaattacactatcacctttttgggtgtttttggcctcaaagtggaaatacatggtgtttaagccaggagcaagcaaagatgcatgtggggtaagatccaggcctggtgtccacatctttccgggtgagctggggccgggcttcctgaggtctgtcggaaccgggacaagcctctggaaacggtcagggagttgtggaaacccaccgggcatcgggtgtcgggtttgctttggccccagaggcagccccgttccttctcctgaggactcacccgcctccacgaccctcctcctgctgctgctccaactggtccagggcaggaggccacagacagggccctcaggcaccctgggagcccacacctccccctccgtgggagtgggtcgaggggcaggctctgctgctggctggaaaccccaccccgccctatccggtaccgccttgttacgtagaagttactcagcagactgacacccaatccccctcgggcgatcatctgccctgtcttcccacctccagggctacagtgggcagcaccgccatccccagtgtgacagggccctgggagcctcagggctgcccggccaggttggtctgctctggttacattctggccaagctgccccttcctgctgacctgcatgtgtattgttgtcaccttcagctctcagcacctcggcccccttgggcagtgaggaagggccctggaggcgaggttgggagaaaggatagctagaacaggatcctgcggggaacaagggtgtgggcagctctcacccggggctgcctcactgagagcaccgccgagtgggggtgggggtgtccaactctccagccacaaaccgcttcctccttgtctgcaggctgtgcaggtctggcctgtgagtaaacacatttatcagcaacccaagctgtcagtctcagtgttgtgcaaatgccggaccggtgagcagaggagcctgctagctttcctgcctggccccgaggcccagaaacccctgatcttgtgtcctggggtctgggaagccctgggccttgagaagtggggtttgcaggtggtgacaggaggaggggagggaagcctccagggctgtggggttcaggctcccagaccccccggcacctgctgaagaggagagctgtgttctgtgggattgggtggaacttcctcagcgcgggaggagcctgttctggcccaagctggtcctgtctttttaggaataaatccctggtagctcagcgtcggcaggggccttgctgtgcctctgatgtggccagcgtgccgcctttgcactttgctgttgagtaacttgcaccatgaggtcaaggaagggaagtgtgattgccagctggccattgttctataataacagggtcacctgcatgagctcaggcacaggccagtatccccagccctacctgggagcctctcggcagcctgggggacctcgtcctgtgccacacaggcaagcggacacacccccaggcagcagaagtcacctgcggcccagtgccagcccttgctttcttgcttttcatgccattcacattagggtaagaatggctttgagacaaaatgtgacagcatcactcacgccagcttagatcctccgggttccctgtcctcccaggataacgtccgaggccgcggcctcttcttgccactgccccttgacctctgtcctctgcccctaggcccgtgcagttccctgactcgccctgccctggtgccctctctccaggcaggactccctccagccccttgctggccctgccctgcctctccccagggaggccctgagggcccccccccccatgtgatctgtcagcagcgccctgtgtggtcatctgagctgcctttcctgccaccaccactgttcccaccccaggagggcggcctggctgtgaaagccccagggaggggtcctgggtggaccgtctggggagctgtggtgtcagcccaaacctgcaccctcgaggctgagcccaccacggggaatgtggtcaccaagggcaagcacgcttggccgcaggcctggagacgccggagccaggccacggtgggctgctgcaggctttggtccacgtcggccagcgtcagctgctgtctggggatcttaggctagggacggcccctgcacctgccatcacctgggctgggacccccacctagggctccccctccccacttggacgcctgcgggcccatgcctatcccactccggtgaggcctcagcctggtggagggggcgcaggcttgggggggagggtggcagagcttcccacagggctgaacctatgcccacaaagccatgacttgcccctgcctgaggctttctgttccccaggaaatcagagaccccctctcctgaaaccgccaggcggccctcacaagtcccttcccctccaggacctgcctggcgccacctccttccagccgccgggtccttcgagaggccccctctcggggctctggccggacttgggacaggctgtgcctgagtttcctcacctgtgcaagggaggatgctggattgtggggagaggggaaacggaccccgcccccaggtgccgcgcgccccgcccctcccaccggccgaggggcccattggctgcggggcgccggggcggggcgcgcggaaaagagcctcgggccaggagcgcaggaaccagaccgtgtcccgcggggctgtcacctccgcctctgctccccgacccggccatgcgcggcctcgggctctggctgctgggcgcgatgatgctgcctggtgagtggttccagggaaccgtcccgggcgcagcgcggggcagggtggctctccccgcaggacgcgacgcggaccccgagcccctggcctgcccgcaccccgcaccctggcccggcttcgggctggtccctgggagcgggccatcaggtgcacagtggtctctgggtggagagccccgggccggggaggccggggaggtcggagggaaccttcaaaggtgaactgtgagagggaagtcccgcctctgagcttgttagtggggtcggggccgggccaagcaggacgcttcacctgctgcgcgaggcgccctgggttcctgggattcacctgtggggctacccacccccactatttagccgaggagggaagggagggcagacaagctgaggcctggagtgcaggggtgtgggctgaggggacccgtctcctgcctgggggaggacatggggctgctgaccctggatcccacccctgctcctggagtgacttgggctggggtgtgctgaggagcttcaggctggaggccgggttgcttcccgccagtttcctgggcagataggggctggctgctcccctgctgcctctccaggttggagatgtggtcatggagacacgtccactattgtgttttaatgggagcaaagggtcctggggttggtggtctccgaaaccctgcccattgcatgctgggaccctgccctctgctctcggataccagggagtttccagttcttgggaggtgaacagcctccgggaggcacttcctgctccccagttagatgcgatcagatgatcagaagaatggaggaggagaatggaaacgggcaggtcggcggcccgagtcctcctccctggggggaaggttcatccttgccctcaggcccctccagagatctgagacagcctggagacctgtggagtcactggcacccgctggcacccacagcgtctctgagcactgtgtgtgggtgctgcaggacacaggcccaccggccatgcctgggggcgctcctggggtcttttaggcacagaaccctcacttgagtctttgtcccagagctatctggtgagttccccaggggagggtcaagcccagcaagagacagaatctgagggcccaggaggcctctgggaaggaaacctgccccccggcccctcatgcctgctgaccctccctcctgcagcgattgcccccagccggccctgggccctcatggagcagtatgaggtcgtgttgccgcggcgtctgccaggcccccgagtccgccgagctctgccctcccacttggtgagtctaagctggcctggggagggtccctggctggcccctgagcctatttttgtgaaaggagctttagcttacagaaagtggtgagaggccagtgggtgtctggggctgccctgtacagctctagccccctggggcccatctccgttcctccctccagcactgcctgagggctcccagcctcctcgttccttcaggagctctatggacccctggaagggagcaggggcaggttgtgctggccccaggcccctccccagtttcacttggcgaggctgataagccaaattcctctttgagaagtgacgctggctcaccgcagagttgacacaccttcctgtgttggggggggggcctggcgggggtttcccagggctagaaactgagaatgcccccctccccgactggggctgcccgagggtgattcctgaagcctgagtgggtgggtgtgcacacatgtgcacggcatatgcatgtgtgcacctgtttccagggagggcagttccggccccagccctgtccttacctcagcatccggggaacctactaccgacctgcccgctgccctgggctcatccagccggtggcacagctaaggctgtcccagagctctgcaggccgagccccagcctgcacatgggggctggagatgcagtggtccagcaggaggctctgcaggcaccaccaggtccggcagctgctggaagggatgggtcctggaggcaggcagctgtcgctggaggggcctgtgcgtgctatccccgccacccacctcctttgctgcctggctgaggctatgcctcccccaccctatgctttctcggggaaggggcattgtcgttacccatgcgtggtcagatggggaaactgaggcctgggaggaccgaggagcaccgtgtccttcctgtctacccaagtgctgggctccgccggtcgccttcagcacagccccgttccctaccctccaccctccaccccccgccccccaccctctgccctccgccccccgcctccaccctccaccctccactctccaccctccaccttccaccccccaccccctgccccctaccctccaccctccaccctctaccctgcctgaggctgtggaccctccaggatggagccttgacctggggctggaggccggcaccccttcccccccagctgagcttctctggcccccaggattgaggtgggcacagcccgggcaggctgctcacctgggacccttccctcctcgctcagggcctgcacccagagagggtgagctacgtccttggggccacagggcacaacttcaccctccacctgcggaagaacaggtgagtgggtctcgggtcggcccccctgcccgggcctggctccagcacactggtgtccccggcgtccagcctctgggccagcctctctgcaccgagggggccgaggcagtcacagcacttcttttccagggacctgctgggttccggctacacagagacctatacggctgccaatggctccgaggtgacggagcagcctcgcaggcaggtatgggtcgggcggagcagctgggcgggcaggtaggggctgggcggccctccccgagcctgtggggccatgggggcacagcctgtggacccctctcctgcttcccccgcaggaccactgcttctaccagggccacgtagaggggtacccggactcagccgccagcctcagcacctgtgccggcctcaggtgggtgtggcggacgaacgccagggctcccgcaggtggagaggaaggcctaagcctgtggtgggggtggggaagggaggcagggagggtgcctcctcctcccactcaggcctttgctgtcttgcatgggggtctgctcaggggacgccaagcccaagaggctcaccctcctgtaccctggggcctgaagtcacctgcggggggctgctggtggcagggtagggggagctgtaggcaacaaactggagcctctggtccttcggggcaggacca

SEQ ID NO: 17882 - DNA, 47622 bp, Homo sapiens
aatcagtcttaccccttcttccaacccttttccttttccgtgcatgtattgatctattttttttttttttttgagatgaagtcttgctctgtcgcctgggctggagtgcagtggtgcgatcttagctcactgcaacctctgtttcctgggttcaagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcaccttaatatttatcttgtctttatgctaggaacattatttgaattattctcttttacctattttgaaatgtacaatagattaacattagctatagttactctactgatctatcataggtcttatttcttctgtatttgtgtccactaatcaaactcttcatcctcacgtccccaccacctttcctggcctctggtaaccaccaatctacctccatctccatgagatccacttttttagctcccacatgtgagtgagaacatgtaatatttgtcttttctgtgcttggcttagttcagttaacacaatcacctccagtttcatccatgttgctgagaatgacagaatttcattccttttatggctgaacaatattccattgtgtatatataccacattttctttacccattcatccattgatggacacttaggttgattccatattttagctattgtgaatagtgctgcaataaacatgagagtgcatatatctctttgatatattgatttcctttcttttggatacatacccagtagtggaatttgctggatcatattgtagttctatttttagtttttggaggaaactatacaattttccatagtggctgtactaatttacattcccaccaactgtgtacaagagttcctctttctctgcatccttgccagcatctgttaattcctgtcgtcttgataggaaattttaagtgggatgaggtgatatcttgttgtggctttgatttgcatttctctgatgattggtgatgttgagcattttttcttatagctgttggccatttgtatgtcttgagaaatgtctattttgatcttttgctccccccgctttgtttttttaagagatgagttctcattatgttgcccatgctggaatcaaactgggctcaaacagtcctcctgggactgggcatagtggctgaggcctgtaatcccagcactttgggaggctgagtaggtggaccatctgaggtcaggagttcaaggccagcctggccaacatagtgaaaccctatctctactaaaactacaaaaaattagccaggcatggtggtgagcacctgtaatcccagctacttgggaggctgaggcaggagaatcacctggaccccagaggtggaagttgcagtgagctgagactgtgccactgcactccaacctgggtgacagagtgagactccatctccccaccccctccccctcccccaaaaaaaccctcctgcttcagcctcctgagtagctgggactacaggcaagcaccaccacatatggctttgcccatttttagacaggattttttgtgggtttttttcgctattgagttgtttgagctccttgttatatttattctggttattaatctcttgtcagatggatagtttgcaaatattttcttccattctgtgggttgcctcttcactttgttgattgtttcctttgctgtgcagagctttttagtttgatataatcctattagtctatttttgcttttgttgcctgtgcttttgaagtcttatacaaaaaatttttgcccagatcaatatcttggaacatttctccagtattttcttctggtagcttcatagtttcatgtgttaggtttaagtctttatccattttgatgcgatttttgtatatggtgagagatagagttgagtttcattcttcagtatagggctatccagttctccaagaatcatttattgaagagactgtcctttcctcattgaatgttcttggcacctttgtacttttggtattgacataaaatgagttggctgtaaatgcatggatttatatatgttccattggtctatgtgtctatttttatgtcagtaccatactgattgggttaccatagctttgtagtagattttgaggttgggcagtatgatgccttcagctttgtgctttttgctcaggattgctttggctctttggggtcttttgtggttccatatagattttaggattgttttttctatttctatttctgtagagcagcagtccctaatctttttggcaccagggaccgcttttatggaagacaatttttccgtggacgcggggggatttttttttttaatggtatgaaccatatttattgaaaacattatttctggcctttctcaaattgaagactgcaaaaaataaaagcagtgctttattgagttgtcattaaccttgagagcagtggcgctgcctctccacgctctggggacggtggaaaccgtggctggtgcgtgccacatctatcacacctcggtctacaaaacagtcctgacgtcaaataaaactattgtggccgggcgcggtggctcacgtctgtaatcccagcactttgggatgccgaggcgggcggatcacgaggtcaaggaaatcgagaccatcctggctaacacggtgaaaactcgtctctactaaaaatacaaaaacaaaattagccaggcatggtggcgggtgcctgtagtcccagctactctggaggctgaggcaggagaatggcgtgaacccgggaggcggagcttgcagtgagcgtagatcgcgccactgcactgcagcctgggcgacagagcgagactcagtctcaaacaaaaacaaaaacaaaacaaaacaaaacaaaaaaaacaaacgctcgtacatgacatttacattagaaaaagagagctgaaagtagggatggggggatggtttggggatgaaactgttccacctcagatcatcaggcatcagattcttgtaaggtacgcagcgccgtagaaccctcgcatgtgcagttcacaatagggttccagcctctgtaagaatctgatgccaccactaatctgataggaagtgagctcaggcggttattctcacttgcccaccgctcgcctcctgctgtgcgtcctggtttctgatgggtactggtccatagcccgggggttggggatccttgctctatctagagaatgccatttgtattttgatggggattggactgaatctgtaaattgctttaggtagtgttgtcttttttctttctttcttttttttttttttgagacggagtctcgctctgttgcccaggctagaggctggagtgcagtggctggatctccgctcactgcaagctctgcctcgcgggttcatgccattctgctgcctcagccttccgagtacctgggactacaggcgcccgctaccacgcctggctaatttttttgtatttttaggagagacggggtttcaccgtgttagccaggaaggtctcgatctcctgacctcgtgatctgcccgcctaattcttctaatccataagcgtggaatatctttcctttttgtgtgtgtgtcctctttcatcagtattgtatagttttccttgtatagatctttcatttctttagttaaattgattcctacgtagtttatattctttgtagctgttgtaaatgagattgcttttttgatttctttttcagattgtttactgttggtgcatataaatgctactgatttttgtatgttgatttggtatcctgaaacttttactgaattcgtttattatttctaacagtctttttcgtggagtcttttgatttttcaatacgatgagtttttatgtcttacttttgtatcctcttctgggaattattacctgctcatgtttggcaaacttctactcttcttcaagattcagtcttgagtgctactcctgggcagtgctgtattatccaaagagtaggaaaaaatgcatgcttatgtgccagcaaagcagagccaccagttatgaggcaagaaacaaacaaaaaagaaggcttgtaggctgtgggaaaagccagaactttgtagttttgtttggttattgagacagggcttgctgtgtcacccaggctggagtgcagtggcaaggtaatagctcgctgaagcctccatctcctgggctcaagtgatctccccacctcagcctctggagtacctgggagtacaggcatacggccaccatgcccagctaacttttttttttttctttttaaatttgtagtagagacgaggtctggctatgttgcccaggttggccttgaactcctgttctcaagtgaacctcccgcctcagcctcccaaagtgctgggattacaggcatgagccactgtgcctggcctgtagttcttctttaatcttatgttttattaattttgaattatttagatgcccttgatgagtcttcctttccccgcagtcgtcaggaactctctcttgtttccatttccttacacacttgtttcctaccacttggcctgaacccttcaaaaaagtcaatattacaaaaactaaaaccaaataggtaggagggcttttgtagattaaaatagagacagaaccaaatgcaagtgtgaaacttgattgcatctgaatcaaaacaagccccaaatataaaatcagtttgtagggaaatatggagaactttaaatatggatgtatattaggtaatattattgaataattaatgttaattttcttagctgtgttaatagtattacggttatgtaggaggatatcctaatcttaggagataaatggagatgtattcctgttgtccgcactttattttattttattttttgacacggagtctcgctctgtcgcccaggctggagtgaagtggcgcgatctcggctcactgcaacttcctcctcctgggttcaagcgattcccctgcctcagcctcccgagtaactgggactgcaggtgcgtgccaccacgcccggctaattttttgtatttttagtagagagggggtttcaccgtgttagccaggatggtctggatctcccaaagtgctgggattacaggcgtgagccactgcgcccggcctgtactttactttcaaatgattgagtgagaatggaagggcttgggcactttgagagaaagagaacacaagcaaatttgccaacatgctgagacttactgaatcaaggtaatagccattattcttttaacttttttttttttaatttgagacggagtttcgctcttgttgtccaggctggagtgcaatggcgcgatcttgactcactgcaacccccgcctccctggttgaagcaattctccaccatgcccggctaatttttgtatttttagaagagacggggtttcaccatgttgcccaggctggtcttgaacgcccgacctcaagtgatccgcccgcctcagccttccaaagtgctgggattataggcgtgagcgtccacgcccggcctcttaactttttgataggttaaaaacttacaaaaaacgtggatagagggggtctgtcttgcccactagaccgatatggtgttggttaggttaggttaggttaggttaggttaggttagaacccgacattgtgctctgtacttcctagccattcattcgcttcaagtgctctgaaatttaatttaaaaaatcatagttggaatcctttcggtcactttctctttctcccttcgttcctccctttccctcttgattcttccttgaggcgcaaacacctgagagaggcttctgtccctcggcggtctccgtaagtaagtgaaccgttattggctggagggcgctgacgtctgattgttgcgcggtcgcatttttccggggaacgcggattcgcattcccaattttaggtggcagtcgcaacccrtactattcggacagatggcacagaaaccgctgcgcctgtgagtgaccgtgaatggaagcctctctccctgtgtctctttcgtgtgtgtaggtgacgacacgggcgggagtctttcccatgacgggaagggagaaggaaaaggcggagagacacggggctgctggggagcttaggtgatgtctttgcctggccggggctgacctcttttcctggcccttttcgcttctgagggggtttctcttggcgacgctcgttcggagaggcggaagctcccagagttaggcctcctccatcttagggggcagtcctggcctctgacacatcctttccccttcgtttctcctgaccccatttatttactcgccaaatagccattgggcccactgatgggccctgggcagtggtggacagagtagatagggacccttccctggggcattttttttttttttttttttttgcgaggaggaggggtgggggtggtggtgaagagagggcttcatgcagcaagtatttattgaagaactgcagtgtgccggacgctgtgctaggtgttgcaacagatggagttcctgctttaatggagcgtagagtctagaggaacaggtactaaagaatccagataatgggccgggcgcggtggctgaggcaggagaatcgcttgaacccgggaggcggaggttgctgtgagccgagatcgcgccactgcactccagcctgggcgacagaacgagactctcaaaacaaaacaaaacaaaacaaaacaaacaaaaaacaatacaaataatggccgggcgcggtggctsacgcctgtaatcctagcactttgggaggctgaggcgggcggatcacttgcggtcaggagttcgagaccagcctggccaacgtggtgacaccccgtctctactaatacaaaaaaaaaaaattagccaggcgtggtggcgcgtgcctgtaatcccagctacttgggaggctgaggcaggagaatcgcttgaacccggaggcggaggttgcacagtgagccgacactgcacctctgcactccagcctaggtaacagagtgagactccgtctaaaaaaaaaggaattcagataaatgtaaagttaccatagtgatagggccaggcgcagtggctcacgcctataatcccagcgactccggaggccaaggcaagagaatcacttgagtccaggaattcaagaccagcctgggcaatatagcaaggccccgtttctacaaaaaatacagaaaaaaaaaaaaattagccgggcgtggtggtcccagctaattgggaggctgaagcaggtggaccacctgagcctggggaggtcgatgctgcagtgagctgtgatcgtgctgctgatctccaggctgggtgacagattgaaaccctgtctcaaaaaaaaaaaaaaaaaattgcaatagtggtaacttttgggaagaaaatattcgtgaatctgggagagtgcataagaggggtatttggcttaatgataggagtcaagaaggcttcccgagaatgttaggattgagccttgggaaataagagtaatccattgcttaacagcagggttatgttctgagaaatgagttggtaggcgatttcgtcattgtgcgaacatctttgagtgtacttccagagacctagatggtatggcttcctgtacacytaggctaaatggtatagctgtacgtcaagttactgtactgaatactgtaggcaattgtaacacaatggtaagcatttttgtatttaaatatagaaagggtacagtgaaaacacctggcygggtgtggtggcttatgcctgtaatcccaacactttgggaggccgaggtgggtggatcacctgaggtcagaagttcaagaccagcctggccaacatggtgaaaccctgtgtctactaaacatacaaaaattagccgggtgtggtagcgggcgcctgtaatcccagctactcaagaggttgaggcaggagaatggcttgagcctgggaggcagaggttgcagtgagccgagatcgcaccactgcactccagcctgggcgacagagcgagactgtctcaaaaaaaaaaaaaaagaaaaagaaaaaaagaaaatactgtatacaggaaaaaaaaaaagggcacaacctgtgtaggacacttatcatgaatggagtttgcagaactgaaagtttctctgagtgagttagtaagaggtgagtgaatgtattactttacagtattgtagactttatgaatactgtacacttcacctatattaaatttattaaaatattattttcaacagtaaaccttagtttactgtaacttttactttataaactttaagtttttttacactttttgactcttgttataacacagctaagacataaaacacattgtacagctgtacaaaaatattttctttatatccttattctacaagcttttttctattactttttttttctttttaccttttaaactttttttttttttggagacagggtctcactgtcgcccaggctggagtgcaattgtgcaatcacggctcactgcaacctcaacctcctgggctcaagtgattctcccacttcagcctcctgagtagctgggactacaggcggaagctaccacacctggctaatttctgtattttttgtagagagggggttttgctatgttacccaggctggtcttgaactcctgggctcaagttaccctcctgcctcagcctcccaaagtgctgggattacagacgtgagccactgtgcctggctttaaacttgttttgttgcaaactaagacacacacacgagtctaggcctacacagggtcaggatcatcagtatcactgctgttcacctccatatcttgtcccactggaagggcttcagtagtaataacatgcatgaagctgtcatctcctatgataacagtgccctctggaatacttcctgaaggacctgcctgaggcttttttacagtcaactttttttttttttttttgaatacgtaggagtrtactctaaacagtaaagagcataccatactgaatatatttttttttttttgagatggagtcttgctctgttgcccaggctggagtgcagtgccrcgatctcagctcactgcaagctctgcctcgtgggttcatgctattctcccgcctcagcctcctgagtagctgggactacaggcgcccgccaccacgcccggctaattttttgtatttttagtagagatgaggtttcactgtgttaaccaggatggtctcgagctcctgaccttgtgatccgctcgccttggcctcccaaagtgctgggattacaggygtaagccaccgcacctggccatagcatgctaaatattatacataaaccagtaacatagttgtttattatcattatcaaatattgtatactgtacataactgtatgtgctacactttttataaccaccagcccagtaggtttataccagcattaccacaaacaaatgagtaatatattgcactatgatgttacaaatggctagacatcactaggcgataggaattttttagttccattataatcttatgggaccaccattacatatgtggtcccttgttgaccgaaacattgttatgtggcacrtaactgtattcttgtctttaacctaaaaaggttattgaaatgcttaagaacgctttggcatgatcaaattttcattttggaaagcagttctgtctgcaatgtggagaacaaatcagagccaaagtagagaacagctgggattaggtagagtgatgacagaggaatagtttagggattcagggtttattaaggaagtaaaatcaacaaggcttgtgatggtttaattgtgagtgaaaaggagctggccttgttgggtcatagatttctatctttattcagtgggatagagaacagtggaaaagggcccagatgaggagatgaggcacctggtgatgtataaactggacagtggatctcccagagacaatggtaattccgtgtgacaactgctgtgatggaagaaatgcaggctcctatgggaacactagaaattggtaactgataggtactagaaggcttcctagaggaggtggtgctcaaaatataaataaaagtcatattagtttatgacaaagctttctctgaaatgctgtaatgtggttttctgagtttttgagaaggtaatgacttctgagccagccaggaaggcttcagaaatgtgctaaaccttgaaggatgggaaaaacttggatttaggatgggtagggtggaactaccctagggaatgacagaggcagagagtaatcaaattgccagttcagttaagaaaacttggagaaagtactagaaagatgacaggtcagggcctgtggaaagctgtggttctataggcagtggggaacctcttaatgttttgaggaaagaacattaaactgactactttctgtaggatggacaggaggaagagaaggcattagaggaaacataaatgtattctctactttgaatctaacactagatgcattgtatttttgtctgattcttcctctgccataggaagggggtgaggtggggtggagtggagtggaggttgcagtgagccaaggtcgtgccactgcactttagcctgggtgacagagtgagaccctgtctcagaaaaagaaaaaaaaaaagtttggcgaggtgtacaataaaagcacgccagaaagagacactcacaaaacaataaaattttaatatttcaagatgagttaaaagacattaaggaaatgatataagccgtggaaaaaccacataaatcagaattagaaaatctcagaaatgagatgatagtaaaagtcacttcacaacgtagggccagtttaccttaccaatgtcagctcttgccattttctacttcctgccccataacacttcacacatacctctgttgtagcccttttcttataaatttataatgattagagtgtcttcctttccctgattataaactctttgaggcttaaactgagtcttcctccaccttgtactgctaacatgtttttagcatagtatacttggcatattgtacttagcgtatggtaggtgtccagtacctgtttatcaaatgaatgactgaagccctgtactaagataggaggagtcgtactaagataggaggagtcaaaataagaaggatagaatgaatgtgaaagatgtttggaaaaagggattgatgggacttggtgactggatgggggatttttgacttttgttgaccatgtcagccatagacatgtccacaaaacttaggaatgaggagaagaagctggctcaattgtggagtaaatgataagctaaattttagatacggcgagtgggaggtgttggtgagaccctcagtggatctgcccagtggtttacgtgcactgaaccttgcaaggtaactgcagagagactagatcatgtatctatctaatccaaaagaccartatataccaaacccggcaggcccatttgtttcctgaattgctataatgtttatctctttgtttgcagcttggcttgtggagatgttgaaggaaagtttgatattttattcaatagagttcaagcaattcagaagaaaagtggaaactttgatgtaagatgtttgtttttactgaatttaattttacctttgtagtcayacataaaaataaagtttgcactcctttaagtcttgattgaacacataccatttttgttaaattgarttcccttcatgagcataggaacttagtagctgctgagtggctgggggagggagacctatttactgtttactattgatctttatattttttgaatttgaatattgttactttatcactgtacaaaaaactgaaaacagactagcaacacttccctaagtgattctgacctctgggtttgggaagcacagatctatttcatgaatgtgatgaggattaagtcaggtaacatacataccaacccatcacaagcttaaaagctctatatgaatgttgtgtatggttgccaactagactgtaaactcctaagagtacagaagagagtattccaggtatgaggataatttgttcattgggttaaaggttgggtaaagacaacaggcaggaaatgtgttttttataccttgtatttctcagattctaatattttaagtttttttgtttcacacggggattctttaaagatctatttctatgtgactgtatattccagggaaggatatgtggagagagccatgaatggcagagtgggactgggaatttgaggagcacttgaattctaacttactttaaaagtttagttccttgactctctcttacccatctctaacttgaatttgacagccaaagagccaaaacttaataattcatagaatcagtaactgttaacagttgctgctaaagaattgtatattgaaatctgcaaattgattaagaattaaaaactgatttgaaactattaaataactagttgaatattactatcaattatgtactgtwtgatattttaaaatctcatatatctgtttaaaaaactcattttagctgctgttgtgtgtaggaaatttctttggctccacccaagatgctgaatgggaggagtataagactggcatcaagaaaggtatagaaattatttttatttaacatatgatttctaataaaatttcaagggccagagttcttgcagagttgtttttcattatttaagaatttaagagttattttcagtatttaagaatttaagttgcttttcattattaagactatccggcgcagtggctcacacctgtaatccccgcactttgggaggccgaggcatgtggatcacctgaggtcaggggttcaagaccagcctggccaacatggtgaaaccgtgtgtctactaaaaatataaaaattagcagggcatggtggygcatgcctgtaatcccagctcctcgggagactgaggcaggagaattgcttgaacctgggaggcggagattgcagtgagccgagatygcaccactgcacttcaccctgggcgacagagcaaggctctgtctcaaaaaaaaaaaaataaaataaataaaatagccaagctacaaggttgggtgtagtatatccttagtggatagctgttccacatttaggattgctaaatatggggaatgtgaatgcatggactatttacttttaatataagtattttttctatagagaggcatatcttaagttctaaagcagatctggtaactatatggtgtcatgtctgtttccctcactagctcctattcagacatatgtgcttggtgctaataaccaggaaacagtaaaatatttccaggatgctgatggatgtgaattagctgaaaacattacttatctgggtaagctgatacttgttgtattttttttttgttttttgttttttgtttttgagacggagtcttgctctgtcacccaggctggagtgcagtggcgcaatcttggctcactgtaacctccacctcccgggttcaagtgattctcctgcctcagcctcctgagtagcttggattacaggcgtgtgtgaccatacccggctaattttttttatatttttagyagagacagggtttcaccgtgttagtcaggatcatctcgatctccttacctcgtgatccgcccacctcggcctcccagagtgctgggattacaggcgtgagccaccgcgcctggccgatatttgttgtatttgtaatgaacataatatagtgttctcaggaattagtctcccaggaaatttttggctagatttttcagtgattgcagcctgagataatggggtttggagggttttttcccagagtctgtatatgtgctgctgtgcccttaggacaatgcctttaggacagtggcattttttctttattatttctaccacttagccccaatatcgttgcgttcccacaacccggtacacacttgtttagccaactggagggataaactccttgtctatagtatatgggatacttaaggtataaattatgttcacacaaaggaaatttcatgtatgtggctttaccatacaatcttgctaggtatatacagcttacttgttaatgagcctcccaactatttatagctctaggtttcactctaaggttttggcaactcaggtttttagtgctgttctttgggggctttttactctttttttactctcctttttctggttctaggtacactcttcagttccagcttaaagttgtttcctccacagccctctgtattgcttttagtggctctttcaatgtctggctgttttcaaaagcactgtcaaattttgcttttgttttccccccacctgctggcagtctgctgcctcttagatcattcaactcttttttttttttttttttaagacagtgtcttgctctgttgctcaggctggagtgcagtggcatgatctcggcttactgcaacatccgactccctggttcaagtgattctcctgcctcagccttccgagtagctgggattacaggcacgcactaccatacccagctaatttttgtatttttagtagagacgggatttcaccatgttggccaggatggtctcgatctcctgacctggtgacccgcctgcctcagcctcccaaagtgctgggattacaggtgtgagccactgtgctcggctttttttttttttttttagttgaatttactattcttcacatttcctccttgttggtcttatttctctagaaaacttcttcatttcctttgctgtaaatgtcctctctctccttccccatcatagttcatcttggcctttagtctttatttggctatggccctcccgttaccagtcttattttgcactaatcctgtgggacttctttaagcaaaaattgaaggaaggactttatttgttttgttgttttaatatggaactcttcatgaatttgcatgtcatccttgtgcaggtgccgtgctaatattctctttatctttccagttttagtatatgtgctgctgaagtgagcactgtttagttttaactacacatatcagatacgcattttgaaattctgttgtagattttaacatgagcctgacttatgcagttcttggtatagtttgtagatttggattaagggcattactgtagatatttggcagccattttactatatgaatttagtgccaggaaaggaaagagcagctaaggtacttgggttatttctgtgaaatagattttttggatccagtaggaggatcaagcartgaacttggtagtgaacatgtgatagtgagcttgaaatactggtaggacatccaacatatagttggaagtgagagttattattattattttttgagatggactttcgctcttgttgcccagactgaattgcaatggcatagtcttggctcactgcaacctctgcctcccggattcaagcgattcttctgcctcagcctcctgagtagctggggttacgggtgtgtgccaccatgcccrgctaattttgtattttttagtagagacagggtttcaccatgttggtcaggctggtctcgaaatcctgacctgaggtgatccagctgcctcagcctcccaaagttctgggattacaggcattagccactgtgctggtccgagagttctttctagagtatcagtgttgaagagtataggctttggagagttggtcccataatgatgaaaaatagagctgagaagaggatcaaattattaaggaagaaatacaatcagaagggaagcaggttgatgatagtaccttggtgggtggggatggtatatcttcatctagggggtaggaacaaagacataaaagtgcttagaggactgtttgagaggtaaagatattgtcaacttcatggaatctactgaagataacatagtttcaggagaacattggcaaatatagggtgacctttaagagagtgatgggagagggaaactgattgcagggggttaaggaactaataaagtaggctgggcgtggtggctcacacctgtaatcctagcaccttgggaggtcgaggtgggcagttcacgaggtcaagaggttgagaccatcctggccaacatgatgaaaccccatctctactaaaaatagaaaaattaactgggcatggtggcggtcacctgtagtcccagctacttgggaggctgaggcaggagaatcacttgaacccgggaggcggaggtggaggttgcaatgagccaagattgcgccactgcactccagcctggcaacagagcgagactccatctcaaaaaaaaaaaaaaaaaaaaaaaaaggtaaagcacttagcatggatgactcttcagaaattcaaaactgaagaggaggaagtttcttagtatgtgtgttcattttggatggcgatgattgagcatatttttttctgaacaaaaagcgccagctgagtagactcagtagatgaaagggaagtgaaaattgatggagcaaggtcttgaaggcaacaggagggaatggaaacaaggccacaagccaggaataaccatagaagagagtggcgtcttaaatttttcctaaacacttgttctttccaaatgttttccttcacttggaagttgctgcctgcctccaagtagctgggactacaggcacacgctgccatgcctggctaattttttgtattttagtagggatggggtttcactatgtgcatcttttctagactgtagcttccttagaactgtatttttcttcgcattgccttttcctgtstccagatgtctgcatttaagtccatgtagaatcttctctagaacgcagaaagccttttccctaatcttctcttcccaactttttccagtaatatttgtaaggcacctggcataaacatactggcccgtgggctccagcagcctccacgtagggctgttcatatttactgagcaggaatactgttgtagccattcaccattgatgcctagcagccagaagggagctgctggagagtttacacttcagacatgtaaaatggcagggacataggagagtcatgggagattcatccccctattgatggcttttcattctgcaattytgactaaaatttgttcatttttctttgaacccaggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtrtgtggggaactttgggaattcttctgtgagtagtgtttgtttagttggaatttctaaaagcaaattgcactggcttgagttgggacttttttcttttcctgtttatattgagtattttagctcttgggtaccttttattagaagtcttctgtgaaaattttcaggattctaaaagttctgtcaactgatcaaagcaaaagttaatttcatgaaagtgtgattcatagatgagactgctgaaatcttaattataaaggaatggttttttatattctctgcttcaagtgccctttcctaagcctcttaatgttttgaggcttcactgatttttttgttttttgttttttgtttttttttgagatggagtctcactctgtcgcccaggttggagtgcagtggtgcgatcttggctcactgcaacctcctcctcccgggttcaaatgattctcctgcctcagcctcctgagtagctaagattataggcatgcgccaccacgcctggctaattttttttttttttttttgagatggagttttgctgtgtcacccaggctggagggcagtggcgccatctctgctcaccacaacctctgcctcctgggttcaagcaattcacctgcctcagcctcccaagtagctgggactataggcgcacactgccatgcctggctaattttttgtattttattagagatggggtttcagcatgttgcccaggctagtcatgaactcctgagctcagacaatctgcctgcctcggcctcccaaagtgctgggattacaggcggatttttttgtatttttagtagagatgggatttcaccatgttggccaggctggtctcaaactcctgacctcaagtaatttgcccacctcagcctcccaaaatgctgggattacaggcatgagccaccgtgcccagcctaatttttgtatttttagtagagacagggttgcccaggctggtcttgaactcctgcgctctagtgatccacccgccttggcctcccaaagtgctgggattacaggcgtgagccaccatacctggccagattttaatattttatgagtaatcttgaaaaggatggtacaccaggagtgacaactatcatggggagtgaaacrctacactggtggaagtaagcctaaggaagattttgaaaaggttatgtgtgagggcagaaaacactgggtgagcttcattgaagggaaatgtaagaatgcatttsggaacaaatctccatggttggattcaggattatcagtgatgatccagaagtggagcctgtataccaccccttgccagtttcagcaccatgtgtccatgaccaaaaaggccaacaggataccaggcattatcaaggaggatgctctcttcctttttgacaaacccatgattactctttacgtagaatacaaggcatagagctggttggagcacaaggatatagcaaagctagggaagatcgagagaagggctgctaaagtgatgaaggaagagagaaagacacatatgatgctctgtaaggaaggatgakaaaatgaggcccctttgttttgcggggagctaaaaattgattttgatcaaggcttataaataaccatacagtatatttatggaggagaaaagtatagttcaccagtccctaagatgctaggactgacctcaaagctaattccctgcccttcagcagaaacctgaaggaaacaagcataagacaaaaggaaattcctgctttacgtagtggaaaacaaactttgttagcttatttccaagtaataccttctcttagaatagagttcataaataatgctgtgggtgagagatcacttaattggttgttaacagaatctggggatgttctgggagcaagaataactttgagcaaacttcatattacttaagaagggtgtggttatgcccttcctcaaactgccacttccttgactgaagcaaaataaaggattatatgctggtgatgaagtccttgaatactctataccagatattctgtggatcctaggagccctgaagcctagcttttcgctttgattttctgaattgactatgactgtctggacccgtgaactacagatgcactacgtaacaaactagaggctgggcgcagtggctcacgcgtgcactttgggaggctgaggcgggcggatcacgagatcaggagtttgagaccagcctggccaacatggtgaaaccccgtctctactaaaaatacaaaaattagccaggtgtggtggcacgtgcctgtaatcccagctactagggaggctgaggcaggagaatcacttcttgaacccaggatgcagaggttgcagtgagccgagattgtgccactgtactctagcagcctgggtgacaaagcaagactccatctcaaaaaaaaaaaacaaaccaaaactagaagcccagtctgtgggctccagagggagagcttactttccaaaaaaggttttaataatttgtgttttgggtattgatatggaggagttaccttttaatctctggcttccaacagttgttcctatttctacattcatagtagttcagctcccttatttgttaagattttttctctgattgccatacttatgaaattcaatgtgcagttccttctgtccacatctgtattcatgtataaatttcaaagacatttcaaaatgtcttattatttatttgcatttcttgataacttttggtctgtatggatgactaagtttttgtttactagggagaagtggataccaaaaaatgtggttctgctttggtttccagtcttgccacgggcttgaaaccaagataccattttgctgctttggaaaagacctattatgagaggcttccatatcggtgagtagcatttcattcttcttggctttttgaagaatttgccatggatcttctgtataaacttctcttgttcgtttttaaccatataacatcttggttccatttggttactcagacactgaagtaagtgactctcaagtcattcatcttctctgagtttgttccctaatttgaaatcactttggaaatccttcagtttcagaatcaagaacttgtatcagttttttccttttcagggccaggcatgatggtgtgtgtctgtggttccagctacttggaaggctgaggcaggaggctcgctcgagcccaggagttcaagactatagtgtgcaatgactacgcctgtgaatagccactgcactctagcctgggcaacatagggagccccatttctttaaaaaattttttaccacaaataaatatgagataatgtatatgttaattagcttgatttagccatcccacagtatatacacatttcaaaacagcatgttgtatacmataaaaaatacaaattttagttatcaattaaaaataaatgagagggaaaatttaaaaaatttttttttgtcttttttttttttttgagacggagtctcgctctgtcacctggctggagtgcagtggcatgatctcggctcactgcaacctccgcctcctgggttcaagtgattctcctgcctcagcctcctgagtagctaggattacaggtgcgtgccaccacgtccggctaagtttttttgtatttttaatagagacggggtttcaccatgtcagtcaggctggtcttgaactcttgatctcatgatctgcccacctcagcctcccaaagtgctgggattacaggcgtgagccaccatgcccagccaagaaaatatttttttttattttttttcttttgcactcagaggtggagtttttatttttttaatttttgggggtacatagtagcatagtaggtatatagaggtcaagttcttttttttgagacagagtcttgctctgtcgcccaggctggagtgcaatggcatgatctcggctcactgcaacctccgtctcccaggttcatgccattctcctgcctcagcctcctgagtagytgggactacaggcgaccgccaccacacctggctaattctttrtatttttagtagagacagggtttcaccgtgttagccaggatggtctcgatctcctgatatagaggtcaagttcttaaagaatatactgccaagaaaaccagtgttttacaagtgagagagttaagtaaaagctcagaattatcttcactgataaagggcatggattatccctaaaataacttctttcccttcttttttacaaaagtaatatttacgtgttgctagttaaaaaaatttaagtgagcaagaagagaataccccccttaccataatcccacagcctaatgcagaatcataggtaatacaggtttttctgttaaatctccatatactyattctagaagaatgtcttgttctctaaaaatatactgcgaaaacagaagttttgggaacaagccactcaaaacttacacagttcttaagaatcggaatacagtttttcatagaacatataaaaatggccaatagggctgggtgtggtggctcacgcctgtaatcccagcactttgggaggccgaggcaggcagatcatgaggtcaggagatcgagaccatcctggccaacacggtgaaaccctgtctctactaaaaatacaaaaaattagctgggcatggtggcgggcgcctgtagtcccagctacttggaaggctaaggcaggagaatggcatgaacccgggaggtggagcttgcagtgagcagagatcgcgccactgcactccagcctgggcaacagagtgagactccgtctcaaaaaaaaaaaaaaaaaaaaaaaaggccaatagacatataaaaagatgctcttatcattagccattatggtaatgyaaatcaaaagcacaatgatacaccacttcatacccactaggatggcagtagtcaaaaaggcaaatacataataacaagtgttgacaaggatgtggaggaattggaatcctcacacattgctggtgagagtgtaaaatggtgcagccgctttggaaaactgtttagcagttcttgaaaggttaartgtaagagtcagcagcatggtaacggcaattttattcctgtcccaagataagggaaaacatatgtccacacaaaaacttgtacacagatgatcataatagcattattcataatagctcaaaatgcaaacaacccaaatgtccatcacctggtgaatgggtaaattaaaagtggtaaatatatgatgaaatgttatttggcaaggaaaagcaatgaagtactgacatgtgctacaacatggttgaaccgtgaaaactttatgttaagtgaatgaagccagacacaaaggactacattttttttttttttaattttttttttttgagacaagatctcattctgtcttccaggctggagtgctgaggtactatcaaggctcactgcagcctcaacctcgtgggctcaagtgattctcctaccttagcctcctgagtagctgggactgtaggtatgcaccaccatgcccagttaattaaaaaattttttttgtagagacagagtctcactgtgttgcccagggtgttctcaaactcctgggctcaagcagtcctcctgtctcagcctcccaaagtgcctggcctattttagctttttattacacaaaagaagaggcaatagtaaagtgaaacctcatgtgtccatcacttagcttgaactattgtcaacattttgccaattttacaactcttttaaagccaaaagttggagttttgatggtttctgaagacataatctcatctcttcctaaaacagccttgtgaggtagggattgttgccctattagacggatagatagtaacttatctgaaatcatttgactggcgatgatgaactgaggacctctgctctttttatggccccatagagtccacatattttgtcattgcaaatcaaaagtaaaattgtttgcaattttttgtctctcaaatatgttgtagaaaccatatcattctacaggaaaatgcacagcatgccacccggtttatagctctggcaaatgttggaaatccagaaaagaaaaaggtaaagatttacctatttggtggarggttgatattcatggtctgcctgataaatgtatctcttgtccagtttagcattcagatcttctcttctccctgactgcaaggtctcagcagtttcggagactcctttgtaaaggtatggtaatgaaaggtcaagtctctttgggtctttttgtaggagagtttaaagaagggtttgggaaaataggcccagaggaataaaggcaaaatatcaaatgaacagtgttcctttacttccacatctatgtggttgtctctatgggtatttgtgaatttgccctcagatgcttgcttacttctttagcaacttcatttagctgaaataagaaaaccccaaagagctgggcatggtggcccacgcctgtaatcccagcactttgagaggctgaggtgggcggatcacttgaggccaggagtttgagaccagcctggccaacatggtgaaaccccatctctataaaaaataaaaaaaattagccaggtgtggtggggggcacctgtaatcccagctactcaggaagctgaggcaggagaattgcttgaatgtgggaggtggagactgcagtgagctgagatcgggccactgcactccagcctgggtgacaaagtgagactctgtctcgggaaacaaaaaaaaagaaacccagaggacttacctaagctctccttagggctaagatttcctgagggaaatcttagtgatacctggaatctatctttgtattggaaaacagtgcagttgatgaaaagaatataccagaaaaataggttgtttttctcacttctctgagagtatttctgatttcccagggccaaaactaacctattgtggattgagacagctaaaataagaacagttagtgaagtgggaaaataggcagataaagagtctgaagattattccactatcacatgccatagacaatgcatacaaaagataagcaaatcgatattttgtttttttcataatatttcaagctttttttgggggagggggcggatctgaagtgattttgcctttatttccttcactttaagccaatcatgaaatttcatagtgatttctagggttggggcagaaggaagacagtgttaagaatcatcagggctgtggcccagttggcctgcggaggtgcaggcagggtggcccctcaggggcagctggaggagcatggactgccccgctggcagggagctgatgttcccagagtataagagctggaatgtgatgtcctccacagcttccagcttgcgcagctctatcaggctgttccctgcggtggccagtgagttggcgatcagctctgctgccttggaatcgccctcagcagagatgatggctgcctttttctgctgctcagccttttctgccacaaatctggtgctctctgcttcccgctgagccacctgtttggcttccactgcttctgtgaactccttcccgaaggtcagatgtgtcaaggacacgtcatccaggatgagcccaaaggtggctgctygctctrtaaggtcgttgctcatctgcctggagaccagctctctttaggtgattagttctccagcatcaaagtgagccaccactgacttgaggatctcagtagtgatggacagcagcacacgcttatcataatcctcttcaatgctggtcaagatgcgaggaagctggctagcgacaggcccccatgtgcaccgtgatgttgacattctgtaaatctttgctatcagtgatgactggcacattacatggtcaagaacagcagtcaaagataataggtttgtgtacccatggaatgagaaagtgagtcccttcccctaccacagtgttctgtactccatggaatcggtcaaagatgacagctctttgctcagcatccacattatatagggcagagttcaccacgtctcctgcaacagctaaggccaggccaaacttgccaacggactcaaaacactttggcagccatgttttcttctgctggaccctttcatacctgcttccactctgacctccacataaattccccagcctattttcagcttttttgcccaattcttagcaaatgtagatttgtaatttttcttttaattgccctttcaaactgaataacacttagtattttcagtctgttttattctcagggacatgttagcctcagccataagcaacttatactttcgtcaaaaggtgtgcacattataaaatttggcaagcattgttaaattcatctaaaaactttgttccaatttatacccctaccccagcagtgkttttttttttccccctccatatttctcactggatcaagtcaaagtttttgtttgtttgtttaagatggagtctctgtctattgcccaggctggagtgtagtggcacgatctcggcttactgcaacctccacctcccatgttcaagcgattctcctgcctcagcctcctgagtagctggaactataggtgtgtgccaccatgcctggctaatcttttgtatttttagtagagatgggatttctccatgttggtcgggctggtctctatctcctgacctcaggtgattcgcccgcctcagcctcccaaagtgctgggattgcaggcatgagccgccacccccrgcccacgtcaaagttttattaaagtttttgccaatgtgataaatgatatataattgttacttagttgcatttccctaatcagtagtaagtttaaacatctatttatatcttatctaaagttttcgatatctgtggcattagtgcaagattccaaatatttatatgaatatttattgctttactgctagtctcctaagaaaattttattagcatatatagcagaatttgtataatatcagagagagaaacactaagttcgtttgtaattttcattaggaaaaataaatggcagtgccacaattctgtggacagagtacacaaagataagggactcagagacagaagcagtttgtcttcaagggttatacagcaagtccctctgggccttgtagtgacagttgtcactattccattatccgagtgagaactcctggtttgtgagggtgggggctttgatttcttgttcatttctttgtcaacccttggtgagcccctgcagaggccactgaattggcatttgatttactgtttactctctgagctatggatgggctggttgctgttcttttaattttactgagtttcacatgttttctgtgaaatcttcacagtaaaataggttgattacagttgggtaaatagtatttcccctaatgtcattatgttctttttctctaaagtatctttacgcrttcagtattgttcccatgaagctaatggatgcagcagaactggtaaaacagcctcyggatgtcactgaaaacccttacagaaaatctgggcaggaagcatccataggaaagcaaattcttgcccctgtggtatgttctgattgagggttggcatttttatatgtgttcttttcctagttatagtttagtacataagacaagtttaatcgttagaatctaaatcttttttttccccttgggaaatcatgatgrtgtttagaaaatcttagtagatttcarctaagcttagtgttttttattgtagtttggggttaacagtttgatacattaggtctttctttgtccaaactggattcagacgtttggggttacagttttatttgtaaagtctttgtctaaagtgattatctgttcttagctctttaggcaaggctctagcagcttcatagcaatgtaatttgtgattttatgatgattgctagtaggaaaataagattcactctgaagaaattttcttaatagcagagttttctcaaattaattttttccccactaaagcaaggaatgtcaagttcccttactagcatgcacggtctgctttctcagacttttctttctttccaagcagccttctcatctcttaaggctgaattaggcttgtttgacctgtgaaattgtatgactacactatgtccctgttgagagaaaaaagaaaagagaatttaggtgggttcatgttctgctttaggcaagaattactttataacttgcattttaactcgtttttccaaagagatgaatttggcagtagtttggataagtgttgatgtatgactgagacttcaggcatcagaactgggaagatattttgcttccctagagtgtgcagaaaggactgagaagaaagataggtatggcatggcaggaatgttcccttgtatgtgagtggtcggctacttatctaaaggttagttgaataacatttaatcttctgcttttggccattccaggaagaatcagcctgtcagtttttctttgatttaaatgaaaagcagggaagraagcgttcatccacaggtagagatagcaaatcttctcctcatccaaagcagcctcgcaaacctcgtaagtacctttattccagaggtttcttctatgaacagtaactgttattttggcttttctttggaaagcagcattgctaagagagcctcttctggcaggggagaattgtgcaatgagtcattaggaccaacagtaaaaataaaatataaacatggccttggccaggtgtggtgactgcaccatcttatattcccactggcaatgtatgaaggtttctgcttttccacatccctgtcaacatttgttatagcaatagccagttttacaagatagctccctcttttcctgtctcataaataggtatggttctctaggggtgatgcttttatatacttcttggactctgtatttttagcccatctacttgagagtgatgagttccttttgctaattaccatttaaagcaattttctttgtcctaaaaaggcagtcttctgttgcttatatacccatattgggataaaagcgttgatattcttggccaggtgtgggggctcatgcctgtaatcctgtactttgggaggctgagccaggcggatcacaagttcagaattttgagaccagtctggccaacatagtgaaaccccttctctactaaaaatacaaaaattagccaggtgtggtggcacggtcctgtagtcccagccactcaggaggctgaggtggaagaattgcttgaacccaggaggcagaggttgcagtgagccgagatgatgccattgcactccagcctgggtgacagagtgagactccatctcaaaaaaaaaaaaaaagttgatattctttttatagcttcagattcagaaactagagctttatgaatttttatctagaattatgtaatgctggaaactgattcacactaactgtaatcccagcactttgggtggccgaagcgggtggatcacttaaggccaggagttggagaccagcctggccaacatggtgaaaccctgtctctactaaaaatacaaaaaattagcaaggcatggtggcacccacctgtagtcccagctcctcaggaggctgaggcatgagaatcgcttgaacccaggaggcggagattgcagtgagccaagattgcaccactgcactccaacctgggtgacagagcaaggccctgtctcaaaaaaataaaataacgggccaggcgcggtggctcacgcctataatcccagcactttgggaggccgaggtgggcggatcatgaggtcaggagatcgagaccatcctggctaacacggtgaaaccccgtctgtactaaaaatagaaaaaattaaccaggcgtggtggcagacgcccgtagtcccagctacttaggaggctgaggcaggagaatggcatgaacctgggaggcggagcttgcagtgagccgagatcrcgccactgtactccaccctrggcgacagagcgagactccgtctcaaaaaaaataaaataagaatggcctgacttcgaggctgttctgaggcgcttcctgtactatggaaaaagcacctttcctttgtgtctgtaaaacataatgaggtgaagagcctccaaaaccaatatgggttcataaaataatagaatgatcaaactcgaaggaaggactttaagagtgtttcattgagattctctttcttcatctttttgtttcacacaagaagstgaccttgggagggtaaattttccagggtcatggctaatggcatagctggggctttaattggggctcctgacacccagttcagtgttcttttgttgtagcctattgccagttatgtgctactttagtcagtgtgtgattttgcacttgtgggttacctacctgtggattggttacaaattctaatggaagtttaatttcattgaaaatgttcatagggggtcgtagtgaggagcacaggctcagcccattgtggcagtgttgtataccagtcttttcaggatataaaaatcagacaaagctgagttctgtggggtgattatatgctstagtgcttggaccatagtaacacctggctttcttttacatgaagctcagcctccaggaccctgctggttttgccttgctagccctgaagtggaaaaacatttggtggtcaacatcggcacacatgtgagttacttccttggactttatagagaaggagatgcctatttgttttttattaactttattgaggcataatctacatataacatttacccatgtttaagtgtatgattcggtgattttcgtaaggttactgagttatgccaccatcacgtggtatagttttagaacatttttatcattgcagtaagatctcttatgcccatttacagttaatccctgttcccaactttagcctcaggcagcaactagtctacttactatctccatagtttgccatttttggacatttcttataaatggaatcatacaacatgtggtcttttgtgtctagcttcttttacttagcataatattcttgaggttcatccatgttgcagcatgtatcagtatttcattcctttttattgccaaatcatattccagtgtatagatgtaccacatttcgtctatatctgttcatcagctgatggacgtttgggttgtttctactttatggctattagaaataatgctcccataaaatatctgcatgcaagtctttgtgtggatatagacctaggaatggtctatatkttggatagacctaggaatggatttgctaggttatatagtaaatttatgtttaacttttaagaaactgctaaactgttttccaaaatgactgcaccatcttatattcccaccagcagtgtatgaaggtttctgcttttccacatccctgtcaacatttgttatagcaatagccagttttacaagatagctctcttttcctctctyataaataggtatggttctctaggggtgatgcttttatatacttcttggactctctgtattttttagcccgtctaattgagagtgatgagttccttttgctaattaccatttaaagtgattttctttgtcctaaaaaggcagtcttctgttgcttatatacctgtattgggttaaaaatgttgatattctttttatagcttcagattcagaaactagagccttatgaaatttttttttttttttttttgagatggagtctcgctctgttgcccaggttggagtgcaatggcrtgatctcagttcactgcaacctctgcctcccgggttcaagtgattctcctgcctaagcttcccaagtagctgggattacaggcacctgccatcacatctggctaatttttatatttttagtagagacagggtttcaccctgctggccaggctggtctcaaactcccgacctcaggtgatctgcccgcctcagcctcccaaagtgctgggattacaggcgtgagccaccacccccggcctatgaatttttatctggaattatgtaatgctggaagctgaktcacactaactgatcacatcaaagataaaatttcagttttgcttagtagtggagggtgtagcttactaatgacaggaatacccatattcacactcctggtgtgagtatctaggaacccaagatgatgatgatatggttgtttggtaagcattgaatcagactatgagaacgggatggtcttgagtatgattttattcaggtggtggaaagcttgaatgtgtgtgtctcatgggaaagtcattctatttcacatttccccagatacttttgcttgggtagggctggattagacattaaataataccagtgtttgastctgatttccctgggttttctgtagaccattgttctttttcattcatttagaatgaagaaaacttaatttttaacactatagtcaccagtgactagaattggatgttccccaagattcctgaggaaaatatttataagtcatttttgttttgtgacagttttgggaggtggggcctaataagaggtgatttggtcataaggactctgccttcatgaatggattaatgttatcacagtagtgggttatcatgagagtggctttgttaaagtgagttcaggtccccttttgcttctttactctcaccctcacttgcccttctgccatgggatgatgcagcacgaaggccattgccaggtgccagtgctatgcacttcgacttcccagtctacagaaccacaagccaaatagatttctattcaaataaattatagtctgtggtattctattatagcaacacaagatggactaagacaattccttaagtgtgtagtgcttctgaagacaggtgccttcatccatttctcattgatttgttctacttttggtttctggggttgatcstttcaacttatcctaacaatctgaggaccgttttttgtgtcttccttcctgtagactgactagagtctcaatttcatcttacactttaaggagttacacttctgcctgtgttgtttccacctgaagagtctcagtcttttacattttaaaaaatgtcttggccgggtgcagtggctcacgcctgctcacggctgtaatcccagcactttgggaagctgaggcaggtggatcacgaggtcaggagttcaagaccagcctggccaagaaggtgaaaccctgtctctactgaaaatacaaaaattagctgggcgtggtggcgggcgcctgcaatcccagctactcaggaggctgaggcagagaattgcttgaacctgggaggtggaggttgcaggccaagatcgcgccactgcactccagcctgggggacagagcaagactctgtcacaaaaaaaaaaaaaaaaaaaaaaaaaaaaggcttaattagtggcacactcctgtctctagggggagcactaatgaagtcaaggccggtgacacaactgagccatagaacctgtggatgaagtcttcagtggaataagagcaaacttgagaagctctagcttttatagcagtgccctttttggatgatctcttttgcatcttttttcgtctttggattagtttatgctatttttctctcccacacaatttgtatagtaagttaggctttgaattgccttctgtttgggaagcttcaataggttcaagatcacaygcaggagataagagatttggaatgtgtgacatagctcagtgctgctctaggcctcagtgagaagtgacttttcttttccattcatctttctattgtccaggttactctaactcagggtgtgggcctgggcaacaatcaaggaaacctgttttcttctcatctaggcctgaaactagaggggaaaaaggtcttgtttgtggcccaacccaacatcccaagtaggccacatgagtatttcagcctagagtctacaytgtccttaggtagaaacctcttacaaacctgtaatgacctttgggtgtctgtggaagagtttgggatctcctccctgcaattattctttttgattgcctttttttgttttttaaattttttccctggctttctctttgtcgtgccttcctcaaaggtagtacatagaattgtgctgatggtccatagccacagattagtaaaaagggggaagggctgctgagagtgtaaaataattattgcaaaatcaatgcattttacttacggggagaaccatttatccaggtcctatttacacatggttagagataattctagtatagaacagattagaaggtgagagtttgaaagagagaggagattaggcaagcgtgaaactattcacaaaaattgcaagtacaggattagagatggtgcagaggagctctttagtttagacatcattacctaaagaatgcacatcataatagagaagytgatgtttatggcagtgaccttctgacaaaaatagctagacgactcaggcttctagagtaaccttttaaacaaatacaatataaagtggttattatacaaataaaaaaaagtttttagtgcctgtgaggttttcatcaactttagtcatctggaaaattaactttgtcaatatgctcagtcctctctgccaaacaaatcaaggacaatcatgctttagtatctttccaatacatatcctgtcattctgttggactttcttattatagatgagaagtgattccttccttcagccttaactttgagcccaccacactaagagcatagttggaataattttttattttttttccygagacagtcttgttctgtcgcccaggctggagtgcagtggcacgatctcggctcactgtaacctccgccttccaggttcaagcaattcacctgcttcagtctcccaagtagctgggattataggcacgtgccaccatgcccagctaatttttgtatttttagtagagacggggtttcaccttgttggccaggctggtcttgaactcctgacctcgcgatccatttgccttggcctcccaaagtgctgggattacagtcatgagccaacgcacccggtctggataattgttttctaamgtatctatatttgcctgtactggtactcattgggcccttctgtgctcactcatggcatcttcccatcagagaatatctgagtggtagaccattcttgcatgttttggtttttacagaaatatttttagttgccattaaaggctgacatccattgttggaaatcattcttttctgcctctttggatgcatctgagtttgaggttttactttccttctaccccattaggttgtatgtttgcttttgttttgtagaatttagtcagcagsttaaggcttaggaacattagatgctaatcatgccatcttagctttttttgtgagcccaaggagtatattcgggggtgggggtgggaatgaaagttactggggaggcagaaaggggtcattttttttttttttttttttttggagacggagtctcgctctgtcacccaggctggagtgtagtggcgcgatctcggctcactgcaacctctgcctcccgggttcaagcaattctcctgtctcagcctcccgagtagctgggactacaggcacatgccatcacaggcctggctaatttttgtatttttagtagaaatgaggtttcaccatattggtcagcctagtctggaacttctgacctcaggcggtccacctgcctcggcctctcaaagttttgggattacaagcgtgagccactrtcccagccgaaagtggtcattttgaaatcagaagttgtatctttttgtggttgagggtgataaaaactgaaaaactgttttcaagtttggagcatgggagggaaaacccagcgatttgttctggtctccctcagctcagtgtgtttgaagccaaaagcctgcttgtgtgcctctcccaattcatttgctcctagttcatttgctacttgcatagaaattttcatgccgaatctcactcttcagcggatacctgagaacattgttgctacaatctctaaaatcagattttttcaagaaagaatttttattaataacctcaagtacttttcgcctacaccctcaggctcactttttgtataggyttttctccctggagaatcctacatgctgtattgatgtctcaattctgtgtgctgcttcttcagtgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtaggtggtctgttcatagaaacttggaagggcgctatggggactttgatattggtaaataagtatttaaataggctgggcgaggtggctcacgcctgtaatcctagcactttgggaggccgaagcggttggattgcctgagctcaggagttcaagaccagcctgggcaacacggtgaaaccctgtctctactaaaagtacaaaaaaattagctgggcgtggtggtgcatgcctgtaatcccagctactcgggaggctgagacaggagaatagcttgaacctgggaggcagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactrtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttstttgtttgtttgtttgagacagagtcttgctctgttgcctaggttggagtgcagtggcatgatcttggctcactgcaacctccgccttccgggttcaagtgattctcctgcctcagcctccccagtagctgggactacaggcatgcgccaccatacctggctactttttgtatttttagtcragacggggtttcaccatattggccaggctggtctcgaactcctgaccttgtgatctgcctgcctyggcctcccraaggtattacagkcatgagycacccacgcctggcaagatctggtttttgacatgttgagcctaaggtttttgacatgttgagctatcaaggcattccaaaaatgttattaaataggcaatgggttgggcatggtagctcacacctgtaatccaacactttgggaggctgaggcgggaggagcacttgaagccaggagtttgataccagcctgggcaacaaagtgagacaccttgtctctacaaaaaataaaaaaataagcttggcatggtggcatgtgcctgtagtcttagctactcaggaggctgagagtcaggaggatcacttaagcctaggagtttgaggatgcagtgaggtatgattgcaccactgtacttcagcctgggcarcatygcaagaccctgtctctaaaaaaaaaaaaaaaaaaaagaggcagtggacaatttggaactagagcactgggtattgactagactggagatgaacagggcattactccaaagtttagtgctttcctgggaagagcaagaaattagaatttcctaaggtaggaacttagaaggatagacgccactgggaggatattgttagtatcttccagttagactttttaagccctagttccactaagtggcttgggatctatagcaacatacatatctttttttcttgtgcatttagactgaattatttgcctagagatgaactcagattatagatttttaaagcattattggacatcctcatacaactctgtttactttagattgcacagccaggagcagcatatttttatgttgaacttgacacaggagaaaagcttttccacagaattaaaaagaattttcctttgcagtttggaaggtatgtttttcttcttttcaatgtattttcactagacctgctatgaacagagtggtgggctacatgggacaattgataaaaagctaaattgtaaacagtccttgccccagaggacccatggtcttagggcagatgtttwcatatatgacagtaatgtaatgtagaatgtgaagagtaccatgacagagttttggagaacaatgtgctgtagaaattcagaaaagggacagctcatttctagttggtgaaagccttcatgaaagtggcaaagttgaacctgagaggcatatttagagggcaaagattgaggtgagggcattctagccagaagtgctagggaactttaattgagcacatactctgtgccaagaactgtaccaagaactttacacatacatgactcatttaatcttcataactctgtaaggtaggtactgtcatcccgatttaccagtgtggaaaatgaggctctagagcagtgcccggtagacttttcacaacgatggaaatgctcaaatatctgcactgtccaatacagttgtgactagccacttgtggccmctgagtgctgaaatgtggctaatgtgactgaggaactaaatttttgattttatttaattaattagaatttaaatttaaatagccatacctggctaatggttaccccactrgatagcaggctgtagagagcttaggtagcttgtcctagtcacacagtggtaggttcaaacccaggcctgttggacctcaaaacttgaggtcttaacctcagtgttctacagtatggtaaaggcctagaggaggcttcagttctgttcctcgtatcaggcaaaacatgactgcaaaaccatagagggagtaacataacttaagcaaagattgaagatgggaagttgctggcaagaagatacagtttgaaggggagtggaaaatgtgtagaacrgagtatctgatgctggtgtctgtgatttgcagctgttttttctcccctagttaaaaatgggctttgagtgagccttgaacctgtcttggactaattcagaaagcctccaagagattgcccccttagataagtccagtaaatgtagttgtctacatttttcaaaaagataaatgggaacaagtgtgctacgagattcagacatctgacgtgatgttttcgttgttgcctcagcaacagatgcggttatgaacattgacaacataagcacacgattgcagatacacataggcgtataaagcacacaaaaagaagattctctgaatggttttgtgcttatgatgtattttcaatattgagtaattatcaagatactaatttatagttatatagcattttatagttaacaaaatatttgaaatggcatatttttttcagctgtacaagaaaggtagttctattttccttttatatttgaaataggctcaaagtttgcccagggagcttaggttctttgacttatagagaattcatgatttgtttctaactcttctatttactgtaacttcaaagtggaaaatgaaccatataaatgtgtaatagaattatttctaatatatcaaaataagtaaaaataaaaatataaagcaatggcgattagaaggcagcttgtgtgtgagtgtgtctgtatgtagttattctttagtcctaagagccaagatagttgttttgttgacattgggcttgtgctgctgttacgtgggcctgagtyccctagaaggagaggcagaggaattttaaatcagagtgggtatgactaggctcctgactctgcaaactcatgtctagttgaggtgacaaaactacagtttaaggcaggttgtaatcacagctaatatggcactttgactgtgttatctctgtacctcacaaaaaccctgtatggtgggtgttcttatttgcatttcataggtgaggaaatcaagactcagagatgaaatcatctgtctagatcatagatagcaagtggcaaagctggaaatgggatccagtctctgatctttctcacaccagggcctgccctttttctatgtggtgttgcttctctaagtaccaataatatagttccaagttttttaagagagggagaagcaagtggggtttgaaggatcaggaaatatatagtacctgagctggtcatttaaaacgggtatgattttgatcaatagtatggcagagatggcactcagggcaggagagcaaagtcagagaaatttgcatacctcctttgggtgatgttgaggagagctcaggctgatagtttccattttgacttctttgtgctatttctgcagggaggtcctggccagtgaagccatccttaatgttcctgataagtctgactggaggcagtgtcagatcagcaaggaagacgaggagaccctggctcrccgcttccrgaaagactttgagccctatgactttactctggatgactaaaacaaagggaagaactttttatgaactccacaggaagtagtaargcttttttttttttttaattaaaagaattttttttgagacaaagtctcgctctgtcacccaagcaggattgcagtggcataactgtggctcactgtagcctcaacctcctgggctctagagttcctcccacctcrgcctcatgagtagctgggaccacaggcgcawgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcrcttgtartcccrgctrctcaggaggctgaggcrggagaattgcttgagcctgggaggtggaggttgcagtgagccaagatcgctccattgcactccagcctgggtgacagtgaaactccrtctcaaaaataaaagaataaaagtatgtctgtcatccagctcctatgtctgttatccagctccaagtacagcttgtgtatatcaacattttcaaaaacctttaaactaccaaatgaaatccagatgtttttccatggttgagaagtgtcttgtgttcatgttgcctgtgaccgttgaaatgaagtagtatgtgtaatagcaggggctagagctttaggcccagctgttactccaaaatcacacagggcagtttctccctgaacaacccaaagtggaaaagggatccaaggcttttgctatttttctcttaaagcattcatcttattcatagataagagcccatttagtccttcggatatttaactcctatgtgccaggcatttttctaagctccaggaccatagtcatgtcccaatatggtccctgttgtcccagagattacagtttaatggggaatagaagggacagatttaagaaaaaaaagataattctcctttggatattgttttaggtgcttgatatatctaatatgtgtctgttgtgctgctgggcagttctaaactcatcagtacctgggttggttacagggctttggggatcatcagggtataggccataggtgaaattaagatagggtaaatacagtcctgagctgaagatgattacctgagaaatatcagtatttaaggagtgcttgaaaatagtgatctaacatttacatagagaaggagcaaagagaatgctacatattaggcgcaaaaagaaaaatatttttacctttatattgggcacttatggtccagacactgtttcatttaatcttcacaaaatctctgtgaggtaggtattacctctattttactcatgaaaaaaaaactgagactcggaaaattgaagattgtggagcctggggtcaacaggcttaggctttttaaaaaacaggccaggtggctcatgcctgtgattgcagcactttgggaggctgaggcaggcagatgacctgagatcaggagtttgagaccagcctagccaacacggtgaaaccccgtctctactaaaaatgcaaaaaattagctgggcgtggttgcatgcgcctgtaatgccagctactcgggaggctgaggcagtagaattgcttgaaccctggaggtggaggttgcagtgagctgagatcacaccattgcactccagcctgggtgacaagagtgaaactccatctcaaacaataacaacaacaacaacaaaaaacaactcaaattactcatggccctgggaatgggggcatttaaaaagttaaccaagggaaccaacctggtttccacaaagatggccacttctgggtcagcccaatcatcagtatccctgggtcctcagcatcccttcctacctcttttgactgggaattacgagattacagccccacctacggaaattgagcacattagcactggccatgctgtacatacagcaaatgagagggcttcatactgttacaacaatctgtaccacaattctctgtgcggtctgcccagctctaaatgacatgtcctcagaggcatcatcatctccaagtccatggaaaccatgcacttacagaaaccagaacctcccataccacatgttactaatgacctacaacatcgacttcgtctgtatcatgcagtgctcaacattctggttgcagcatcacatttatcaataatttgattccatgctgattcctttacttggagtattgagatcccccaggtacagtgaaggtatgaccctcttaaatggaagaccaggagttgtttcccctatgctatggcaatccgccacccggaagcacttgctgcaccaacagcattcccaaagcttgcctctgcagccctgtagcacccattagaaacacttctcacaatgaactactgtgctggcaaacccataactggactgccggacagcaagctctgtgaggcatctaggaaaaaagctcgcgaaatcccgagaaacactcttcactccggaatagcgtcacattcttgagtcatttgggatgacaggggatatcctggagcaggtgtattgggaagtcagtgaacaagaaggctaattcattagtgggcctgctagcgtagtattttaacgatttcgcagcctttaaatcattggtggtctttagcgtgccggatcagctggtggtggagttggaggatagatggcagggatctgaagaaaggtgaagtgtagataggagtagagacaatatgaagtttagaaaagactaattgctggacgcggtggctcatgtctataatcccagcactctgggatgccaaggtgggaggactacttgagaccaggagttcgggaccagcctgggcaacgtagcaagaccatgtctctacaaaaaataaaaaattagccaagcgaggtggtgcgcgcctgcaatcccagctactcgggaggtgagaagatcgcttaattccgggaggtcgaggctgcagtgagccgtgatcgtgccattgcactccagcctgggcaacggagcgagaccccatcttaattaaaaagaaaaaaatacaggagagactgggctgctttgaaaagtggatttgacgggaatgtggggtttggagagatcttatgttttccaagactagaaaaacattgtggttccgttcagccctcccggaaaatacgtaggggacttaaagagcggaccgagtacctgtttgtttccccatcccttagccggcagggctctggcagcgccctgggagaacttagggaagggccttctcgcagcggttaccggaagtgacgcattcattctcgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggtgaggcggggcgtgagagggagcggcggtgggttggagcggcggtgggtttgagcgtctgtggaacacagggctgacagtgtgggatagatggttggtgggaccttgggcagtatttgggggccagtgggcttgtgtgtgtgtattagagagaaagatactatgcctgtgtgtccaaagttgtatttgaggtactgggcatagatagagctgttgcggggaacttgggtatgactgtcaggctgtgaccaggtgtttagtgagtgtgacagtgcgtgtgtgtctctgtgaatgtggagtgtcagggtgtgtgaggcagatgcacgtcacagtgtgtatgtaggagcacgaatgtgtgagaagagggctgaaggggactgcctttgggaatgtgtgcgtccgtgtgtgtgtgtgtgtgtgtgtgtgtgtgtgtgcgcgcgcgcgcgcgcgcttggaggccatatgatatcagtggggactggagtagacaaggaaggcttcatgatgggtccagagttaagcctttggaagcatggatgggctttggaattggggatgtattccaggtcgggacagtatgagggtgagttggtgcagagcatggcttcaaacgaaaggctatattagtagatggagatggggggcgctctagtaggtggaggacagttaacatcagactcaagaattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctagatagggcataggagaaaatcttggagaaagagaatggaaggtgaaggactaaggcattaagtcctgtgatagcaggataagtagtaaatttaataattctcaccatcagagggaacataacacactaaaaaaaaaaaaaagtgggagccaagtgcttccagtggcatgttgcctgtgttacctaagcctgcctatccgcctggtcataaggaaaaaggatgcatgctggcagcttttgtgacttcttttcttggtccctgggtggggatggatgaattaatcactttttgttttattatggtaaagtatacataacacaacatttatcactttatttttaagtgtacagttaggtggcattaagtacattgacgttgttgtacagccataaccctatctccagaatattccgacttttttgttgttgttgtacatctataaacttcccatagaatattctttgtgaaaaggtagaatttcacagagttgatgaaatataaattaaggagttgaaggatcttacaaagtgggatttttgaaatagataacttattgctccattaacatgagcattcagggctcagtgttgttcatggttgtgcctgattctcatttccatggtggtaaaggcctgcatgggacatagatataactggtcacctgctcataacaaaaggaagattgaagggagtgagaactgtgggtaggctagcatgcagtctatcctagtttccttcttctctatgcaccaggtatcatcttatctctagcttcttttttcctctcaccctccaattcacactaccctatccaagctatgtcttgcttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacatta

SEQ ID NO: 17883 - DNA, 14062 bp, Homo sapiens
gcctcactcacgcagcttccgattctgtacctcatcctccacgtgcacactgagcaccagctgcacgccaggcactgctctaggctcgaggaggcagcagccgccaggagatggcatctgtgccctcatggtgataagacagcagggctggtctctgtccccggtgccaggcagagccaccgcctcgtctccaggatggtctgcccagaggcagcctccagcacagcagtcaaatgtgtccacgcgggcccaggtccccttgggtggctgtgctgctgtcacctgagtgcccttgggcaagacccctcaccacccacccccaaacccaggctcccttagcctgacctggtgctggtgactgtcagccgtaggcttttggccgtagtgctgggggctggaccaccttgtaggcctgcgatgcagtttgctgagttcctgtgctggagagacccggatgagcctggctatagtccatgcaggaaagggcgactcagccccacacacttctcttcccacctcgggctgtccccaaggcagttgtgtccagcggctcctgcagttctcttgcgggtctgcctgggccttccagcaagccccaccagcccagggtcctcggggtcctgagcaggaaggggtcagcagaggagggagcaggggccactgttgcggggctccatgggcaggcggctctggactactcactcctggttggagagtggtgacagccccggagtctctcactgcgtcccttcgtgagcaccagggtccaggagccgtcttggtttgtttggctcctcccaggagcccgaatgtttgactttcacgagcacaacatcctgctggagaccctgagcaggaccgaagggaaacggcctgtgcctgcgtctggacctggctgaacttgcaggtgcccccacccgaggtcctggcagcctctgcacacaggccacgtccatcctctgcctcctgcttcagaggcagccagggcgggctgtggcgcttcccaggctctgatggaggcaggtgtttctggacacaaaggagaagcagttgtttggccaaggggacagagaagccacatttcagcgaggtcatgtgagctactgacctctctgtgccccataagccccatgtgagctactgagcagatgccctctgtgccccataagactttgagtgcacgcacccgtgtttcacacacatgcaggtcgcgcctgcaaaccctcataggctccacgcacactcagcgtggttgccgcggggctggctgtggtgtgcaccccgggtgctgctgaggccactcttgctcctcccctgcagagttcgaggagcccagggtgattgacctgtgggacctggcgcagtccgccaacctcacggacaaggagctggaggcgttccgggtaaggaaacacggccctctccttctagctctctcctgtggtgaagattctcttgcagtttccgggtaaggaaatgcagccctctcctccaagctctctctctcaagattctcgcagtttcttccttaaccactcggtgaacctgcttgcgttttccttctcatctgcgtgggaactcgtgtttcaggggcggggccaggctctggagggaggggctttggttcttttgtccgtgttcacgtctgagcgtggccttggtgcgggtcctgtggatggtcaacagttggtcgggacccagccacagcctggggggaggggaccaaggacactaccgggatcgtttaggggtgtcaccacttcctgagatggaggcccagggagggaaggagaccacctcaggtggcaggggctcctggggcgtgtggagtgccagatcattctgagggtggagaattcatcagctcggtgagcacccagcagggctgtgaggagtggggagtccagcgggggtcctgggtgggcagccttgagtatggtatccggccatgagttcacccagggtccctatagctggtgtctgttgggagggaggtgggtgtggtcctgccctcataggacttgggactttcctggccccaggaagggcccttagcacctcccccagaaaggggtcaggagcttccctctggggctggggcaccttagctggccgcaggcacgtgcatggggcttggcaggtggggccacatggagggccctgggtctggagcgtggggtcaaggcagggcagggcacctacaggagcagggacagagctgcagtccagcagcagtggagcccaggcaggctgggggcagggtgcagaggcagccaccacagaagcacagcccctggacatggggtctggctgggaacgagctggaggccccctagattcggggggcgggggtgccatttgcagagacagggaaggggtcggcttagggctgccaaggaggcgcgggctgggacccgttgctagtgtgatggcctcccagctgccgccccctcattgcccatgtcaccgcaaggcctgtcctgccccgggtatggcgccgtcccttggcgtccttgcagttcacccgggaccacaagatggcgtggcgagcacggggagggaacactcacctatggaaaccttgttccaggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgcgcacgggttccaggaccggggaggccacagttcccctgcaggaaagatgaggccgcccacatgcagctcagggcttcctgtagatggggtgtgggccccacgctgttgtcttccctgtccgagttgaaccccagggccacaagtgtgtggggcactgaaggccacagcagccatgctaggggagccccccgggcttgtagtgcagtcccccgaccctcaggtgagagcgcaggccccggcgggccactgcctcgtcctcctgtgaccaggatggggcgtgacctggatacccacagccagcccatgagtcagggcactctccagcctttgagacaggcgagcctccttccccacagcccctgggatgtgaggggaggaggggcagagcccaggagaagctgaagccagcgcacagccttgccacagaggcacagaaaaccctggaagctcatgccaagttctttctggagggagctggggctcaggagccccatctgtgccttttaaactttgaactgcaggcatgtgttaccgattcaaaaataggaaaggcctaaaaaataaatgaaggtagaagttctgataggagagggtggtgcgggtctgcctggcagaatgtgcaggagagcagcctgtggcccttgcccgtgggcaggagctcaggtccagggtgagcaccaccatgtggggtttgcagggcgctcccgcgagacgcggggatggaatgctagcgtgcacctagcttcacctgaccacggcaaagctcggtgttggttaagaaagccgtgtggcactgcctgaggcacccgcaccgttggggcagaggtcagggccgctgagagaagggaccttcggtgagttattcaccctgagccacgggcttctatgtggagagggaggtggcgcccacgagcagggttttgtgagaatctggggagagctacagtgaccccagcccaggctgggctgacgcagcacctgctgccactggggtggtatctgtggggatgctctgggctgttgtgatgtgaggagctggaggtccctctccttccctcccaggccctgaggaggaaggcgcctttcccagagctctgtcccagtctctctggtcattgcttttaaaaataacactgtggggctgggcacagtggctcacacctgtaatcccagcactttgggaggctgaggtgggtggatcatctgagctcaggagttcgagaccagcctgggcaacatggtagaaccccatctctaccaaaagtagaaaaaattagccgggcgtggcggtgggcacctgtagtcctaagtacatgggaggctgaggtgggaggatcacttgagcctgggaggcagaggttgcagtgagctgagatcatgccactgcactccagcctgggtgacagagcgagaccctttcagtaagtaaataaataacaccatgggcctatcacagagaccctgagctttccacttcagcatgaactgctcctggctggtggctcttagcgttctttggtgggattttctagttagcactgagctgcttttgtgatttgagcatttctggatgggtgtggaattggaaagtcagatgtgcagggcttgcgccttttccttttggatcgcgcgtctcctgacatgaggctgagctcacagagctggcctcgaggcgcgctgtccccagctgatgagacgtttctgtccacaggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcgtgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaagaggctcgggtctggctccgggcgtggttcccttcccgtgtctgagcctggaagaggctcgggtccggctccgagcgtggttcccttcccgtgtctgagtctggaagaggctcgggtccggctccgagcgtggttcccttcccgtgtctgagcctggaagaggctcgggtccggctccgagcgtggttcccttcccgtgtctgagcctggaagaggctcgggtccggctctgggcgtggttcccttcccgtgtctgagcctggaagaggctcgggtccggctctgggcgtggttcccgtgtctgagcctggaagaggctcgggtccgggtccagctccgagcgtggttcccgtgtttgaacctggaagaggctccaccaggcgtattgtgttttgactgcagctggatcttggcttgactgttgagatctgccaaacatccgctaagctatcatttctgagaaaggtcaaggctagaggcagcatgtcgggagttggcgcatcagggttggaagggccccagggtacagcatgtgggtgcctgttcctttgtggacttgtgtgtgtgtggctggtggggcggggggtggattctggttcttttttttcccattatcctgagagccttaaggtactcagtgtgttggtgagactcagccctgtcatctagcagaagygtgttccttttcattgctgtatagtattccattgcatgactgtcctgtgctctgattttaatgcactttattgtgggtggatatttgagttgcttcctttctggggtaataacactcacttggaaatagctgtggtgaacactcgtgtgggggtgggggtgggggccaactctaggagcacctaatggatcttacgaagcgtgttgtccaagtatagagatgattccaaagtggttggactgtgtttctttctcccagctgggtggaaggagaacactagtggattgctgagacttggtgctcggtatttttaattatggacagcctggctggcgttttgtggtgtctaattgcggagtagcgtgtcttactgtataatggcctcttttgtatgtgggagaccatggtgttgaggggaggcagttacacaaaaarcccagataccgagtgttagttccatgggtgtggctggtcatggtgcgcactcacgaaggatgtaggtgatgccctccactccgcagagccagtcccacaggggtacccattctgactcctaccaccrcagctccctacctcccgcctgccatgggttccacgtgcatggctctgggcagtctgtgtctttgcgtgcgtctgtgtatgtctgcgtgtatctgcttacattcgctcagcatctgagattcacccaggcttttgcgtggatcagcggcagactcctgattgccgcgtggcggcctgttgtgtgggtgtgtgccgcgtgtgtatccagtccctactcaggagtgtacgtttccagtgtgggttgcagtcaggatccatttctcccttaactttcagattatttgctgcataggcttttttctcctaatttggcgcctttgtcagaaatcaactgacctacctgtgtgggtctgtttctgtttgtccttacgctcttgccattgccacactttagacaaggtcttgctctgtccctcaggctggagtgcagtagcgtgatctcagctcactgcacccttgacctcccatactccagcaatcccctcgcctcagtctcctgagtagtagctgcgaccacaggcgtgtgtcaccacacccggctgattttattttttttatttttattttttttgtagagacggggttttactatgttgcccaggcaggtcttgatctgggctcaagtgatgctcctgtctcagcctcccaaactactgggattacaggttgtaggtgtgagccatggtgcccggccgccacactgtcttggctacagttgggtttataataaaccctgaatcgaggtgatgtgcattttccaactcttctttttaaagattcttgtggctgtttatgtccttggtgtttccatatatgttttacaatcagtgtctcaatttctaccaaaaaaacatgccttctggaatttcaatagcaattcccttgaacgcatttttgaataccttttctgaatgtcttgaatacatgttgggaagaatcggtgtcttaacagtctccagtgtccacgcgttgactgccgtgtgtgactccagtcggcgtctcaacagtctccagtgtccacgcgttgactgccgtgtgtgactccagtcggcgtctcagcagtctccagtgtccacgcgttgactgccgtgtgtgactccagtcggcgtctcagcagtctccrgtgtccacgcgttgactgccgtgtgtgactccagtcggcgtctcarcagtctccggtgtccacgcgttgactgccgtgtgtgactccagtcggcgtctcarcagtctccggtgtccacgcgttgactgccgtgtgtgactccagtcggcgtctcarcagtctccggtgtccacgcgttgactgccgtgtgtgactccagtcggcgtctcaacagtctccggtgtccacgcgttgactgccgtgtgtgactccagtcggcgtctcaayagtctccggtgtccatgcgttgactgccatgtatgactccaggtattgagttcatcttcaacttctcccaacaatgaactggagttttctgtgcatgtgtctggcatgttttcctttagatctagtcctaggtgttcgatatgctattgaggactgtgtatttttatttcatttgtcacctgtgcgtggtgctttaatcctgtgccctaaactcccgccttggccatggcggtgtttctgtggactcgtggggtttccgtgtgcacacgcgtgtcctctgtctgacagtggctttgcttccccttgtcagtctgtgcctcggcttctcactgcactggcgaggtgagccggcgctcgctaatcttattcccagtctcggtgaacatgggctcagtctctcccggctcagtgttgggtttgcactggtgcacttacaggcggaagagcttcctcatttgctgagggcttttcctgaatccgtgttgaatgtggtcagctgcctttcctgcacctagtgagatgctcatgaggtcacttccttaccgcattactgtagtgaattacgctgactttcatatgccaagatgacctggcatttccaggtaagtccctgtggccatggtgcattggccttttctctgcatggccagatgagatttgctcataccgggctaaggacctcctgtgtaggaatgctcttgagggacactgggcttggatgttcattgtcttgtcatgtgatgtgtctgtcatggtttgatattgcattaagtgggcctcctgaaacaagttctgccatagtttgtataggattggcattatttgtttcatagagatgtgatgggtgaggccatctatgcctgccattttctttttgcttaggtttttcattaagaacttgatttttaaaaatagacatgaggcctggcatggtggctcacgcttgtaatcccagcactttgggaggccaacgtggatggatcacctgaggtcaggagtttgagaccaacctagtcaacatggtgaaaccccgtctccattaaaaatataaaaattagcagggtgtggtggtgcatgcctgtaatcccagctactctggaggctgaggcaggagaatcacttgaactcaggaggtggaggttgcagtgagctgagatcacaccactgcactccagcctgggcaacagagcgaggctctgtctcaaaaaaaaagacatgaggcttttggattttctgtttcttcctttgtcatttttttaaagataggtttgtcgcagaatttcatctaagttatcaaaacaatttacataaatcattcacagtatcctctgtgcagtgatgtccattctcattcctgctctgggccatttgtgttttcttttccccctgatcagactagctaagagtttatcatttttacagatattttccccaaagaaacctacttttgggtccattgattttttttttctattgttttctttttcattgacttttgctcttttcttatgaatttcctttcttctacctattttgtgttcaatttgctgtccttgttttaggttcttttgatagaggcttagatcattgatgaagaatatgaaagaatgggataatacagttaaaaacttggtctacttatgcccattagagaaaacattcttaagcacgcatggaatcttttaaaaatggacgaggtactaggacccaaagcaaatgtcagtaattcgcagatgataatgtaatgtataaatatatgatatgtaggtaaataatacaaatcacattctttggccagagtgcaattgaggaggaaatcagtaacaaaaagacaattaaatccatttgattcttttgttttcgttttgtagtaacttgcacttccctggtgccagaggcatgacacctttttgtctgctcttggccatttgggtggcgtctttgggaagggcctacttaattcttttgcctatttaaaaaactgggtcttggaaatcttgtctttttttttgagtcaggatctttctcgcacaggcttggagtgcagtggtgcgatcatagctcactgcaacctcaaactcctgggctcaagcgagcctcccacctcggtcttctgagtagctgggactacaggcatgcatcactatgctctgctaatttaaagaaaaggttttttttatagagactgggtctcgctgtgttgcccaggctggtctcggagtcctggtctcaagtgattcacctgcctccacctcgcggagtgccaggattacaggtggcgggagccgccacacccagcctggtcttagcgttattcccaggtctaggtgtgagtccttcctcagatatgtgttgtgaataatttccgatcctctggcttgctattttactttcttaatggttatcttttggaaagcaaaggtttccagtttgatgaaatctaatttttattttttatttttccgttctagtggtctttctattttctcatcaaattgagactttggggaaactacacagcagcaaaccaggatatatcctcttaaaaacagctcgagccggccgggtgcggtggctcatgcctggaatcccagcactttgggaggtggaggtgggcggatcacgtgaggtcaggagtttgagaccagcctggccaacatggtgaaaccccatctctactaaaaataaaaaattagccaggcatggtggcaggcacctgtaatcccagctacttgggaggctgaggcaggagaatggcttgaacctgggaggcagaggttgcagtgagccgagatcgcgccattgcactccggcctggggacaagagcaagacttcgcctcaaaaaaaaaaaaaaacccagcttgagccaagtgtgggtggctcccgcctggaatcccagcactttgggaggctgaggcgggcagatcacttgaggccaggagtttgagaccagcctggccaacatcacaaaatcccatctctactaaaaatacaaaaattaaccaggagtggtggcagcatctgcctataatcccagctactcgggagcctaaggcacgagaatcacttgaagctgggagacagagtttgcagtgagccaaaatcgtgccattgctctccagcatggataacagagcaagactctgtctcaaaaaaaaaaagcttgaaaatttaaaaatatctcaataattatgagatgcagtgattttttttttacttccctaagctgggtttccaggtatctctaggttcagctcctccggggctggaagtacatgaagggcagcattgcccaccttgaccagagcaggctcggagcagggcagtggaagagctggtcccagctcagcccagcctgctgggtcagcatccatctgaaaggtcatctctacccaggaacttgatggcttccagctccaccctaacagaaacctccccagcatcttgccgagttgtaatccagggtggtggtatagacggtcttggggtagctggtatagacggtcttggcgtagctggtatagacggtcttggggtagctggtatagacggtcttggggtagctggtatagacggtcttggggtagctggtatagacgggcttggggtagctggtagtggtgctcaggaggcgtgtgggctgctggtgcagctggaagcgcacctcagccatggtgttgtgccaggtgtggttggggatgcaggggaccttccggccgcaggaggcccctgccaggcacaggcagctgcgcggtgtggaagaagtgccgctcggagtcatgcttgacaaggaagtacaccttactcctctcagtggtgaggggtcaaaccactccttcccagcgatggggccagcagcctggcgagggctaggcaccggggagggatgctggatttggagctggggggaaggggtcaccctgcattgggctccagtgctccgggtgccatgcctgctcccccaccactgccaccgcagccgctgcgggacaccaggggctggggctgaagagcagcctcgagccgggctgtccaggacacggtcgcccttcttcctcgtgtccgtgagctcaggcacaacctgcagcttagccagcccactatggctgcgtgcgtggcaggacccgggccaccatggctgcgtgcgtggtagggcacatgattattttagcctctggtatcactaaccatccctaaagtctccaatggtctgttcctgtctttccctctggttcacttgtggggtcatgttgtcttctgttctttgttatttcttatttttttcttgagacggagtcttgctctgtcgcccaggctggagtgcgttggtgcgatctcggctcactgcaacctctgcctcccaggttcatgcgattcccctgcctcagcctcccaagtagctgggattatgggcacctgccaccatacccagctaatttttctgtgtgtgtgtgtgttttgttttttggttttttttttttttttttgagatggaatctcactcaattgctcaggctgcagtggaatggcgcaatcttggctcactgcaacctccacctcctgggttcaagaaattctcctgcctcagcctcgcaagtagctgggattacaggcccctaccaccacagtgggctaatgtttgtatttttagtagagacagggtttcaccatgttggccaggctggtctcgaactcctgacctcaggcaatccgcccacctcggcctcccaaagtgctgggattgtaggcatgagccaccatgcctggcctaatttttctgtttttagtagagacaggacttcaccatgttggccaggctggtctcaaattcctgacctcaagtgatgtgcccacctcggctgcccaaagtgctgggattacaggcatgagcttctgtgcccggcctgaactgttaagtgtttgtgaagaattatttgggggcctatttgagagctgttatatggatcatcctcctggagagggttcttaagcctctgagaccgggtttggggctgaggctttctgacccacacaagtcatgctgacccctgaagggccgcaggccagatcttgccaggtgagcactttccccgctcacattcaggatagggcgagggggttggtaccgattcaccctcagggcctagatttgggggcttcagcttgctgcagataggtgctcccttcactctcacctgaggctgggctggagcctggtgtctgccccaccctgctggtcagccccctaggacctgagccccgtaagcctggactggccacgccctggggcagcagcactgggtgcttggcgctcacgaccttcctgggcccctgggtccctcacttctcccttgtttctaccttcctggcttgtcagattcccacagctcttaaggagaaattcagtatttactgcagcatgtgttttcagtgtgatggttcatctaggtaccctagcctgtcattgctggagttggaaatctctgttgtctgctgttgttttgtgaaacaagcgcgtgaggttataagtttccctcaacgtaccacactaaccacatttccctaagttttgatgtgtagtgttttcactgccattcagttcaaaatattttctcatttcaagtatgatgtcttctttgatccatgtgtatttttaagttgctaagtgtacttactttggccgggcatggtggcttacgcatgtaatcccaacactttaggaaactgcgggggggaaggatcacttgaacgcaggaggctgaggctgcacgtcacagggagagacgggccgcggtgatgtacgagcttcctgttgataggcagttaagttggttcgggataacgtggcctgcctggcacgggtattcccagagtcacagatgctcacccgtgccagcgttggctgcttgggacatggggacggcgaggtccccacaccccacatgtgagctgctggtagctgggctgagcccaggtcccatccgtgtgtggggcgtgagtgtgcggtgccatcgggtctgcacgggcctcgcctcgtcccgg

SEQ ID NO: 17884 - DNA, 18193 bp, Homo sapiens
ctcaggtgacggactcagactcctggcttcatgtggcattctctctgctcagtgatctcacttaaatctatatacaaagccttggtcccgtgaaaacactcgtgtgcccaccagcggccttgaagaggcaggtctgggccagatgctgggcaggaaaccccagcggcagatgggcctgtgtgcacccaacgtgatgctatgcatgtctgaccgacgatccctcgaccagaatcagattcaggagctcagtttctttttcacttgggtctctggattcctgtcatagggaaggtatatcaggaggggaagaggcctttctagaattttctttgagcaggtttacaatttagcttacatttttcgactgtgaacgtgaataggctgctttttgctttcttctttccagaccccacagtagagcacttttcacttatttgggggaggcttcaggggactgttctcaccttaactcagccagaaagatgccctagttgtgatcaaaggtaactcgaggtggagggtagccctggggcccctcgacatcaccgtcattgatggagcctgaaccgtgtgctcctcggcagatgctgttgttgttacttccctccaagaggctggaaaagggctcagagctgctgagcaggaaccggagggtgacccatttcaggaggtgccggtaccagcctgactaggtacaggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcagggcctgctacgcgggcaagcgtgctgcctctcttctgtgtcgttttgttgccaaggcagaatgaaaagtccttaaccgtggactcttcctttatcccctcctttaccccacatatgcaatgacttttaattttcacttttgtagtttaatcctttgtattacaacatgaaatatagttgcatatatggacaccgacttgggaggacaggtcctgaatgtcctttctccagtgtaacatgttttactcacaaataaaattctttcagcaagttccttgtctaaatctgggaagcagttttatattttaatttctttgttcccatgtttgtctcgtgctgaaaagagacctcctaatgttcatgtcttgataaaatgtcacctgcagccacgcgtgcggcaggacgtgccacccagcactcctggtgtccctctccacgggaactcagggtgtccagggaactgctggcctgtccttgtccccatggtcccagtctcactgtcactgtgtgctcatgtttgatggggagggctctgtgctggggacatcctgccagggtgcggggcacactgccagataccacctggccagggctgaccccagccttggaggagcctgcctgagtgagtccccaggctgccactgtgcagagggggaaactgagggtctcaaagagccttggacccttccggtcagtggagccattcattcagctccagctgcctttcctggtgtgggtagaagcacggctatatatggcgaaaggcacttggtataaaacaaacaggtgctttatttcatcatcagaaacctggtgcatagtttaaaaaacaaacagaagccctgacagccttggagtgctgcagctcggagtcactgaaggagtaagtaagtctggaggagctgcctgagcttcctgcttaggggccggcccccacccacagggtctccctggactggcggggggtgggggtcaggcagtgggcaggggcctgacctaggctcccactctgcctggtgcccacagcctgggcacagtggctcagctactcagccttgagcgtctgtgccgggtaactcagcttctgcaggaggaagaaggggagcaaaaagagcccggaccacgtggtgaagcaggcctgggccccggccagccagtacactgcggagagacggtggcgtcacccagtccccgagggggctggcacttgggaggcgagggcaggtgcttggcccccagcctgccccagcaccatcccgcgccctcacctgaagcggccaccaggggccccgcggccctggccagagcacctaggctgcgcagtgtacccatgaccgtgcccttctgccctggtgagcctgtgggaagaggcacagtcaggcaccactgcccttctcccgctcaggtggcttcggccgagggaagggggctcaccatagccagcgaccacggaggacaggcagggcaccacaacggcggcggctggtgggagacatcgaggaggtgcccgtcagcccaggggagggtgcatcacccagcccctgctgcccatcggatcccctgccagggcagggccactcaccaaaggagtagagcagcagccccaggcccagcacgggcagagaacgtccccagccgatgaggaggaaggcgggcaccagcagcaggagggcctgcaggtgggcacggcagcctcagcacagcccgtgccctgcaggactcaggggactgcctgccacccgctttggaggaagccccctacccgcttcacggcagcaacttccccgccagggtggatccgccgggcataggcaccctggatggtggccatggtgaggccgatgaggaaaaacatcttcccctgctgtaggctgggagcgggtgtgttagtgcagggcacccggggcagggccacccagggcagggccagggcgagagtggctgccaaggcttcctggggatgggggttgcttccctgaagcaggggcgttatttcagggagacagcaggccgtcgccagatggggacccacctactgaactggaagcgctggtgtgtgaggaagctcagcgtgtactccaggcccgagaacaggaagaggtagaggaagtagactaggcccaggcggcgcaggctgctgagccctggggagaggtggcgcgtgctgagaaggcgaccacagcagggaagggcgccgcccggggaagcccaggggagagcaggctccacgcttgggttggtcgagtccttactgtctccagagggtgggtcctggccacgagcgacagccgagaagcgcagcagggccagggggctgagcagatcagccgcatcacggaaccccagggcgatagagggcgcctgtggggatggcattggagagcctgcaggagcggctgctggcctggcaacccacggactgtggcctcaagggtcccaacaccaagagagcggcccagcctccctggcatctggggctggcacacaggggcactttacatcgctatggaatcaagcctccagcccctaggcctgtgggtcccagaccacagccctacccgtttctccaggggcagcgtctctggcaggaagcagaagatgaacagcaggtcggaggctgcgaagagcagggcaaaccagggtgccatttccaggggcagggaggctccgagcatagggcccagggtgaagcccagtgagaaggccaccccaatgaccgcctagggaaaagaccacccgagctgcacagggagacccaggcccagaagtcaccaccaggaccccaaagacccagcctgtgcacttaccatgccttgactgcgggccagaggcgagcccaggtcagcaacgatggccgtggagaggctgacgttccctttgctgatgcccccaatcagcctggaggccaggaaggccgcaaagctccgagaggtggcccagactgcatatgaggtggccacacccatctgcccaggggcaggggccaagaggcaggggcggtcgcttaaggccaggagtggctcagagtagggcttggcaacccagacaacacccctcaaccctgccctatttcgaagcatctgagggccacttgcgttctcagtgccttcctaggggccaggagcagctccttgaaagcctggctctggaacaggagccactggtcccccgagaaccccctccaggatgcgatgagggccaaccagtggccatgaggggcccacagccacctccctctccccacctaaccccatggggctactggctgggtgggaggaggcttccccatgggcacccaggcccaggaacataccaggcacagcagcatcaccgggcgcctccccaagcagtcagaggtggccccagtgagtggcgcacacagaaactgcaggacagagaatgccgagccaatgagacctgagagacagatgtcaccatcatggggctgcctggcaccatgagctgtggtcttggggccctcaaggccaatgtccagccccgtcctgagggtccagtcatgctgggccctacactcacaggccatggcccttgagccgagggggccccaatggagagatgaggaaggatctgaacgtgacacgcggaggcaagggatcatgcccagaagccaggacatgtgggcaagggcaccagacatgccagcccagggagtgggaaggcaaggaccgagaattggggaggggcctgggctggaccacgtccaccaaacaaaggaccgtagagagcccgccaagggcacagagccagccatacctccgaacaggacactgttgtacctcttctccactggcatcccgatggcggtggcaaaccagtccaccccgccctgccaggagccatagagggggtcctaggggatgaggaatcacgataagggctggggaggtctgatgggcctggggggcagggggcactgtgggccgcagggcaaggactcacgtgggcacggccgtggctctccaacagcccgggcagcaggggcagcagcagcgtgaaggccaggaggtccagcaggaggccgagaaagacaacggtgaccacgcggcgctccggcggctgctggtggatgggtgggcgcggggtgcagcctccaccccctccccatcccatggtgggctgctctgacctggcctgggtggggtgcggcgggtcgggttagcggggaagccgagtcctccggggcctggcatacccccacacccgacagccggcgagcaccctaaaggggctgatggcaggggctctggcctacggacgcaggggccgttctggcctgcgcgatgcccccgccccgaacccaggcagcaggaaacgcaggcttcggggattgcacaaaaaatagccgcaaaggcaacggtcctgagagaccagggtgagcacatcgcggacctggccccaccccaccccacggccgcgcctcccacgccctcgtaacagcgagagaaaacttgaagccgcggggaacccggatcccgatcccgatcccgatcccgatcccaaccccaaccccagccccggcccgcgccccgcgattccggcccctggcccggactcggtctccctggcgggggccatggggtgcacaccggacgcaggagcacccccaaccccgcgcgcctcccactccgccatcccgcgtgcgtcccggtccccgcccccaccccgcgcgcccccggtcccgccccccaccctgcgcgtccccggtcccgtcccccaccctgcgcgccctctaacccccacgccgcgcgcctcccaccgcccccaccccgcgcgcccctggtccagccccacaccccgcgcgccccctactcccctaccctgcgcacctctcacccgccccacccccgcgtaccccgggtcccgtctcctcccccaccccgcgcgtcccctgtcccacccccaacccgagcgccccctacgccccccaccccgggcgcccccggtcccgccccgcacctgccgcggctgcgcgctcgggacggacggtcgcacagacgcggaacagggcaccaggcacgccgccaggggcgggacggccacgcccggccacgccacgccccggaagtgacgtacatctctgcacgttctcttccggccggaggcagtggcggggttctcgccggtcctgcgggtcgctgctcggctgtgggttagcagcaccctgagcggagcggaagagctgcccgccgccgcgtaaccccgaggccgagactcctggcctggcctccttgggcccacgacgcctgccccgcggagcggacccatgggcctgaggtttgtgtgcggggcctcaggcgagcgctggcgcagcctgtcccccatcgtctgcgccctgcgggcctggccctccccgtggaaggaccgcgggcttcggggccccacgctggggggctgactcctgccacacacacagcggtggccgcgggcctggggcggcagcacagccattctgctcgggctgcgtgagctgaccccgctctctgtgcacctacttttgctgcgtttggtgctgagcctgaagtcccaggacaggcggctgagggggaaagatggtgtgaattgggtgggcagagacaactgaaagccacaggacccggttggcacctttttggccgcctgcgcctttgcctgcagccccgctccctgggtcacccgaaggaggagctggcgctctttccgggcgcagaagcacccgacccacgctggaggaaacggtccctctgggcaggagaagctttgggcctggctggagcacactcacggaaccacgccaacgcctggcctgtagccagctcccacctcccctcccaccttctaaaatgcttgcggatctcacgtggccgaccctaaccagatacacatggggaaaggaatcaggtggcacacataccgcctttactccatagagaacttccaattgtgggtaagaacaaagccccacctctkcctaatagatgcagttttccacctgcagccaaaaagacaacctgttattagcttttttcccagaggacaggcatctctatgaaactgccattgcaaaatttgccgacagtgagataaccagctccattttgcttctaacctccatgccctccttgtttactgctgcacgcaggttgaactgtgggaggaacttagtttaaaacaaagatgataacagccctttcccaaaggaaacctttcctggggattagcctgcttttgtgggaccaacagattagccacaagattagaaactacggttgaagagtcacgcagcgggaggctacaggattctgaccctccccaaactgctcctggcgataacatcaccatcgtaaagcctaagatcagcacttggtgggtcacctggcaccacccaggctcatctgatgttgtggcacccaggaactgactcagtgcgaaaacagcttcgactccctgtgatttcatctctgacctgaccaatgggtacttctgactcactggctgccccccacccaccagcttatctttaaaaactccaaaccccagatgctcagggagaccgagtaataataaaactccagtctcccacacagctagctctgcgtgaattaccttttctctgttgcaaatgccctttcttgataaattggctgtctaggtaacagggaaggtgaacccactgggcagttacacttttatccacccttccagctggatcacgcgccctcttcaatgacatgacacgcagctagagtgtatgagcttgctgccggcaccttccgtcctggatcgcatagcaaggcctcaatggacagccaggtgcctggtccggtcccacttttttttctgtcctgttctcgtttcctctttgcttggccaaagagggttgggccagggtcctgagtgcaarggcttggcttggtgaattaaagtggcagtagccgtgtggcagagaaaatttgtagatgggtgaaatcctgggcctacacagtgacaaagtgtatatagacagccagcctagttggtggatgtgacaaccccagactcttctagatttgtggatccgtgcacctgccagacctgtctctgagccatctggggaggctgggtaagatttcccccgtcagggcctgagcctcatmtccaagctgctggcttcagcccagctgccaccagcgctgtctctgtcttgcgctttccagagagagactgactcattttgagctccaggcctaccaggcagcccaaccgcggcagtaactgcctctcacactgaggatggctcatgctctggtccagccatggcttgaacacctcccaacaagaacaaagccagactcattctccctagcatcttcttccttgctcaaagatcccacaccccgttagaagctggaactgggtccttgtcaccttcctcacctccccagtcgtagtctggttaatccttacatctcaccacggtcaccgtggctagatgtgacctccgcgatgcttcaggcacgtacyagggcagcctgggcagggctggtcactgtgatctcatgaggtgtgaacttgaccccggccttctttcctgggatgccggctaaggacacaagttcagtgtttgccctggcttgtagcccagcgggggctccgtcatcccctggggaatgcctcggcctgcaagaccgcataccgcattggaacagggaaaccacctacttcagcacctccctcagcaaggtggcaggtcccaacaagccttgcaccacgaggaagtggcagtggcattcgggatatggctccctggccagcttgtgaagttcaaggggctcgttacttcttacagctcacagtccctcccgggtccagcacacctgagggctgacctccctcttgattagtgcaggggaaaagcactttaaaaagctgtgtcatgcgtaacttgcacatcttctgattctgacctgaaactgcatcccaggtcggcacagacgcaacccagtctcctcccacctccgagagtgcagtgtcctgaatggagaaccccagcacccagaagcatccactgaaggacgtaagtaggacaaggccaactgtggctgttccagcagagggactrtgggtgatgkttcccttctctgatttctaaaatatctgcaaacttgtttcatttataattgaaaatataatttgcataacaacagtaaattctacacatgaaggcaaacgtccgtggttgacagaaattacactggccagaatccccagtccccatgaggcttgtccagacgcagtgaaccagtcgcagctgataacacacagaccattcccgatcccagaggtgcatttcaggattcattctatttcatcaggtgacgttttaacagaaacaaaaccgcaggcagcgggtggggggagctggaggttggaatcacaccaacattatagcattattactctaaaaaaaattacttttttggctgggtgctgtggctcacacctataattggggggccaaggcaggtggattacctgaggtcgggaattcgagaccagcctgaccaacatggagaaaccccgtctctactaaaaatacaaaattagctgggcgtggtggcacatgtctgtaatcccagctactcgggaggctgaggcaggagaatcgcttgaacccaggaggtggaggttgtgccattgcactccagcctgggcaacaagagcaaaactccgtctcaaaaaaaaaaatttttttttaagcgacacagtcttgcactgtggccgaggctggagtgcagtggctcaatcacggctcactgtaaccttggactcagctcaagcagtcctcctgcttcagcctcccragtagttgggactacaggtgcgtgccascacacttggctaatttttatgtttttttggtagagacggggtyttcctgtgttgcccaggctggtctcgaactcctgggctgaagcaatcttcctgccttggcctcccagagggttggaattgcagatgtgaggtaatgtccagttccttgccttatttataaaatgtaatttattttttgaactttttcctcttcagagccttccattcgccttcctgtgtagccaggctgttaaaaagctgctttactttccgctttctttccgcatccctaaaagaaacaaaaggcaaatgcccatttttggattagttcttggagagcatcttgccctctctctcccacatcagaaycacattagccaccgtggccacgttcagttcaaacagggggaagtgaacctgcctggctccaacccccagccagagccaaggctgtgggatgccaggtgcccggtgctctgcccagggccacacagcaccaaagctgagtgacaccacaatcgtgtcgcacacacacgtccccctcaccgttccatgatttctgagagttgcatcctcgccaggaactgattgtccttgcggatttctcgaacggcccctttaaattcacgcttgtgtttgtggatcagcctcttcctttcctgttcctccttactactgccttgttttcttccaaactcgaggctacaaccagaaagccactgttaaggaagcaagagtctgtccccacctctcagccagagcctgcttgggagtgtggcttcactccgtagtcatctgctcaactgcasaactggcagacgccccccgtcagctcccactgagcccacagccctggcctcccagggagatgctgccagcacccacactttgaccagccggggtgtgaaaagcttcagtgggacaggcttgctcttctcacaggtcagcrgccggcagagctgcttctggctttccatttcggtcagtgtgctctgacacagctcctgaaaaacacgaaatccccractctgcgatgactcacctgctgcrtgccctgagctccacgcacgggttctgtggtgtcaaggcagcgtgaggacagtgctgcgagctccctgcagcaggatggtgcccttgctgtgcgcctaccggtgggcgggggggtaagccaaggctgtggctgctcaagtcctggcacagccggaacgaagtaaagccactgtcttcttgaagagggagggccgtgggctggcccctgagagcactctctgaaaggaggggacttggggagttggaggtcaccatagcctgtgctcctcacagccagaaacgtcaacagaacccctctttcccagacaaacttggcacgaaaggccgtgagccacttgcttcgtgagaaggctcacaggagaacccctttctgccgcggggggccgtgtgcatgctagagcccagtgtgcaaactgacgctgggtgctaggcggggcagggtttccaccagtcttggcagtttgaccttattttcaagccaacagaaccagatggttaagacccattttcaccaagaccttggcttccagaagagttggctggtggcttctgaggaatctcccgaaaggyagttcactgaggttggtcctacccgctttctcctgcacaggtgtgtcctggaaccctggctgcacccacagatacagccactccygggcccatgtggatgtaaccttcgagtgccggaatgcctcgtctccatggagaccaaactcaagggcctgactggcccagtctaccgagaccatgagacctgctgtgcccctcggccaggccaacccaaattcttktaaataaaaggcacaagccacagccacaccagcaggaagtggatacaggataaggggcagggctcacatctcatcctcatcagcctttgaccaggcgacggagtctgtgatagctagcttatctgctctatgctccagggacctggccggaacgagccgagttgctgtcctcatggaactctcatcctagtggggcagagacaaggacggtgtaacgtgcccgggggtcagcaccacagacaaaacgcagggagcacggcacagtgtgggccagggaaggcctggcttcccaagggtgtgggcgcgagcagcatggctgtggggagttcyaggtgcagagaactactccagagacgaagccaggcctgcgaggaggccggagcgcatgaggggaaggcacgaggcaaggctgccagggctgtgctggtggtgcgggacggtcctgtgggggtagctgcggagatggcactgatgccttcggctccagcagcatcctgggctggtgcgggccaataaggggcagggttggggcaggatgaaaggcacaagycacagccatgtcaagcaggaagtggatgcagggtacagcctgtcagggtcagggtgaaaggcagggaggcgggtaggccataggtgaatttggagcagcctgtagaggacaggatgtgccatcaaagacttgttcttgggtccagctgagactgtcccttggggcttcctgtcaccttgtgcaggatagtgagaccatccttggaaaacccatcgggactgcagagcgcggctcagagctgactgtccaggcctggcaggggctgacccctgggcgctggtgcaccctccgtgcggcctcttggaggaagcacacaaggcgacagttcccagctgccgcctgagatgcagcatctgctttactccagcccagcactgctcaccgtcactgcccactcttatgattttacttcccttcatatttgtgattttgcaaagatggtgttgacttacagctgcagcatcaaatgactgactgccaccagcttggccccagctcagggacatgtctgagcccaggcagagcaccctagtggccgggaagcctcacctggagctcctgcgggtggctgcagtccgccaggtgatccgtgaggagggcttggagaggccccatgatggcgtggaaggatggcagggacccgtacatgagcacgcagcgcttcagcagggccaggcccacagccaggcaggacagtctgtgagggcaggaggcaagaggaggtccaacttgttctgtttgtcactgacaaaaccaataacgtggcaaaaatgaacttccccacttccactaggctgaaaactccagtgtggccaccttggccggccagggttgggcccatgcaaccacgggcaaggcaggctcagggtcaggcctaacgcaggaggggaggctgtgggaaccgcagcgccacctgggatggggcggctccatttttggttccaaattatgatttgtgaaatcaagcaaatgtattttgaaaatgaaaagaaaaagggacagcaagccaacatgcctcagaaaggctttcggcctccatcaaaccaaacggccgggcggcaagttcactaagaacagcacatcagaaagcacgagtggcttctcctgcctctggggacgctgtagggcacaggccccaaagcggggtcccctcacataccggatgtgattggcctctgtcgaagttggggccctcagtctactcgcccagcggagggagaggctgctctgctgccacgtggccacatcctctctagcagacaccacgagcagttccgagttcttcccaagcgctctgaaagggtgcaccagagtggaacctgaattccaagtgcgacaggacagagatggcctgaacattactgggctcccagcaggctctgcggcaccgagcctgtggaagttcaccctctaacagacgcacaccgatttttatgtttctgggttgtgccagacactgagggtttcagcgtgggcagggacacctcaggggaggggaaaagctttggcagggggcgcggtgagagccaagtgcctgatcctgcctgagaggcctgctggccacagacttcctggggcctactaggcacacatggggctgatgaggcgctcaggccacatccgggaacagactgaagtccctgcccctgtcggggagacaggcagtgcacagcacccagaggagcaaatggaccagacagaacacgagaaaggaaagcggaggggcaggagggagacaggagagtcagtcgggggtgacggtggagggcgggagaggcctgaggggcagacgtcagcaaaggcctgtaggacgcaggagtcaattcactcgccacggagaagggcaatccaggccgagggtgtggctacacggggaggggtggagagtgggtacagtggggcagaggtgccgggccaagcgagaggggaaggcgtgggtcaggccccgccccacacttccccaaagccgagatgcccaccccttccttgactccacctgtgcccagcctgttccgtcacagcccttcacacgtgggactgcagctatctacaggtggctctcccggaggcagggagcatgtgggcggccgcgcccctctggcgcccagcaccgagcctgacagacaggagccttgggaggcaggtggtggcagaatgggagcactgaaccggaagagtgggccagacccctcttggaagggactctgctggtggtgtgaatgatgccacagcacctgctcctcaggtcagtcccctggacatgcaggcgcttagcactgcacggtgagctggaaatagaggacaggggtctgagccttgaggtccaacctctggtcaggctgggagaggcgtccacagacatggaagagctcaggaagaggctgtgcagctcctcaccccccagagggaagcagcaagtgctgaggaagcatccaggagcagggctggcatcaggggaagggggaggagcacaggggctggggtgagggcccaggagggcagccagtgtgcagactgctcctcatcccaacactgctcttgccgccctcgctcctgaattcagagcgttaagagaagcgacacagcagcgcggcctgtgtgagctgcacgagaactttcacactgccttgtcgtcacgtgagaaaaagtaaaaagttaagattgattttaacaatagaccttatctaaccccaaataccaaaatattatgattttaacacataatacaaaaaattaagatattttaagtatttctggcactaagtcttcgccacttgggcatatgtcacaggtagggtacgtctcagttcagactctggcccctggcaaccacgctggacagcacaggtcaccggtagcactgcttttccccatgtggcgcgtgcacacgctcacacagagggacagacagtgcggcgggtggcaggttgtgtgtttcctctactttcgcatattctaaactttctacaatgagtatgaactacttaaaaaaattctaaagtataacatatttgtaggaacctccctcaaatcaactcaccttggcttgctttgtttggagttgctatgtaaagaatcccaagaagaaaattaataagctcaggtataaacctctgggacaaagccacatactccaggaacaggcagcacacgaacaggcccttcaccacgtcctggagggacaggatggggcactggaaaggaacatatggggggttactgtcctgggacgatgtcatgccatgctaggccgaccaccgggcttccctgatgaaccacgcaccccactgagcttcacaagtacagagggaacccccgcaccttatagcagtgtcgagagcatcaaatgagatgaaaacaagataaagagctttagtgatttttttttcccgagacggagtttcactcttaccacccaggctggagtgcaatggcacaatctcggctcactgcaacctccacctcccgggttcaagtgattttcctgcctcagtctcccgagtagctgggattacaggcatgtggcaccacacccagctaatttttgtatttttagtagagacggggtttcgccatgttggccacactggtcttgaactcccgacctcaggtgatccgcccgcctcagcctccgaaagtgctgggattacaggcgtgagccaccgcgcctggccagagctatactgattataaagttccttccacccatacagagcgtacgattactgcactaagcatgtaccaatcacatgcctaataaagaaaaaggaacagcttgaactttttaagccaaaaagggaacaaaagcccttatcatcacactggataacttcaccactaacttgaaaggttgttttctggggtagcaccatctgtaaccttgaggtgccaaaccaggccctcccactcccacccacatctggggctgctcgagccggggctcttttagatgggccctctttggcctaaccgcagtgctcggtctctgcagcccttaaacagccacactcatgttccacaaggccccgaggggctgtggctccggccacccgtggtgcagcaggccgacccctgccgcatgtggagagaacgcaccttggtgagcagctgactgaggcacacgagggcaggggtcaccactgggtgccagaagtcggaagttggaaatagcagcccagtgattttcaaataaatgagctggaaagaaagtgttaccacaggttaaagaaggtaaatgaagtccatccatatgccctccccgcaaacactccggagccaagaacaggatctggcgaggagagggtgcatctccttggcccagagctctggcctcagtgtcacagaacaggcgtccaaccaccgtgggtcaaccagctaaacgtgcagtgaggacactgaggcccatgaagacttcaaagcagtcaacaatggttatagacacgggctcagatcatgttttggggagttgattaaaaatcactaacctaagtcctacatttttaagcttctgctaactattgtgaatccatttcaacacaaacaccaggcaacagaataaagagcgtatctcagcaagtatttccttaaagttactaaagctgaaaatacagcatgaggctgttataaaattgttaaaaatctcagcgtacaaatgtctcccaacctttgaataacatagaaaccgagaccaatttaaaccagcccacaggcttgggcccttaaggacaataccgtggttctatttgccttccaatgtttttgtcactggaccaaatacagcaccattcacgtggaatcaaaccagaatctccctgcacgacccacacgttagtccatggctagtggaggagtgccctcccctcccaggctcgctgccgtgcactctcactccagatcaccctcactgccgtgcactctcactccagatcaccctcactgccgtgcactctcactccagatcaccctcactgccgtgcactctcactccagatcaccctcactgccgtgcactctcactccagatcaccctcactgccgtgcactctcactccagatcaccctcactgccgtgcactctcactccagatcaccctcgctgccgtgcactcactccagatcaccctcactgccgtgcactctccagatcaccctcactgccgtgcactctcactccagatcaccctcactgccgtgcactctcactccagatcaccctcgctgccgtgcactctcactccagatcaccctcgctgccgtgcagctcactccacatcaccctggaagcacagggtacagccaagagcatcgtacccgtcgtccaccttctgtgatgccaaacagaacttctgtggcaggggcagtgcctagactgaactctgcttaccacatccaaccctggcaatgccgcccggcctttggtctcaatcatttcttccatctcatgcatcgcatctcggagaacaaatttgatagcgtcacttgcagattcaggaaacatctggcaaagatgatataagtgcctgttaagcagaaatgtaaagtcaggagagaatgactttagataagaaacacagaaaagccctgcaagccactttcctatgcagtcacctgttgactgagcaagtaagaactggatgaatccgctttttctaacagcattcttaagagtctacactcacttctgccatttcctaaaaactcagccataacattatggactggaggtggtgggagaaacagctcgatttgtggtacagacgttgttgggggcaccactctgtgtggcagctgcagctgacagctccaaggcactttccatattaactcatttattcctcacgacaggtacttctttgatagtgcctccatgcatgcagaagatgacgtggagagctccgcgcggcacagggcaggaagctggtgtgcactctcatggatccgaagccaacacacgcctctcaactgaggactctgcccctctggcattcttccagccaccagccctgggggccaggagccactgagtgggtcacacagccttagagggcaacgagggcaggagctcgccctggcggtccccatgcag

SEQ ID NO: 17885 - DNA, 126872 bp, Homo sapiens
  misc_feature (1)...(126872): n = A,T,C or G, or insertion/deletion polymorphism (see Tables 1-2)
tatggagggtggtggaggagcaggaggccttggcaagatttgatggaggacagataggggtgtccgggaggggtctggcatcttcgggggcctaaaaagactgcttacatacaccaccttggatctttcagattgctaagagttttggggggtgtgtcggaagagggggtggtaaaagatgcgatgggatataggaagataacttctggattttagggggtcatattttgatttgcaaaaggagttttggcccttggattttgctttctgaggggtgtttttaaaaaatcaagtcctggacaggagaaaagggctgagggaaggcctggagttgggggtggggagaggcatgtttgtctcagcttaaacgtggctctctggggtgggcccgcctgccctggcctggtggatgggctgatggaggttgctgtgggggccggctcgggtcctcaggggccctggggagtgggaacagcactgggggttgaatacctggccccccaggtccagatggccctcttcctgggctctgctgctccccttccccctggtctccatttcctgcctttggcctccatcttgtggcaggcccagggcccagggcgacttccggcccccctctcccaaccatgttccggccccaccacctctggactgccaactcccaaccctgctggccttggccctctgtctctccttgcttttctcttgggttctgacccagggagaggaaggacggacacaggaagccttgggtccctgcccttgctgagacaggaggcagtgtgttggcccctccagtcattccctatttcttctgcctctgaccccaccctagggatcccctgagctgagttcctacagagggaagatggtccaatcttactacactgtgagctcatccccatggtccgtcgccttccagttgcctgctcagcccgtccctggttcctcccaaacgtttttgggggccatgtttgccttttaaggcttctctatccccccgctcctggaggtggtgctggggtcttcccagcactgctatgtgctctcttcctttcaacccaccccggtcctgctcccgccccagcagcacactgtggtttgtacggcactgtggccacgtccaaaccacactgtggtgttagagcgagggtgggggaggcaccgccgaggcttggccctgggaggccatcctggagaagtgacacaaaaaacatctggggccttgtgacaaacttcttgccaggtgggcaaggagagggtggggtatgtaagcacccctctaaaatctccagggcagtttcaagaatactgatggccagagaccctgggagtaagttctgcctcaagagaacaaagtggagtctttgttgcccacacccagcttccctggctctagcagcacagaaatattggcacagggaagcgagtctgccaatattggctgtgctgctccaggcagggtggtgaaaactaccgaggaggggctgagcccccatgggccgaggagagaagagggaacaggcctctcctgctaataatgttaagcagacagcacgaagctgagagggaaatctttattgttttctgtataaaaatgtccatcagatgaaggtcaaaggggttgggggcagatgcttatgcgggaatagcgaggtggcagccccagcagcctttcagccctctctcgtgcaggccttgctcggagtcccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagcaccttctcttctgaaacccctatacaagggaggggcccctgcggagaccgtgccctgccatccaggtgagccctttctccccaaccccgtcagctgtgtgggaggaggaggactcctaccctggtcgaagttgagtttcttagctggaggagtttctcctagcccttcaatatccaccacgtcactgttggcatcggagtcgttcagagcactgagtgtcacatctgggaagggggcataagctaggttctaggttcccctgacagcctctcccccagccccaagcttcccaaagctttgtgcctcctctcccctcccctctgcccctctctgggaacctccacagggacaggaagagagactgacccttctttgacccaggcccaattctctcactaaacctcagatgggacctttaacccctaggcagcaactccacagccctcaccagccttctgtttctttatggggggacccccggcctcagggacactggagctgctgggaggaggggcagctggaggaggtgacaagacaccagatgccaccttcttgggccctttcttgggtgactcagctggaagggggatgccagaatcttcatataccttgcgtttcacagtggcctttatctgggccctgaagaaaagagagaagaggttaggaaaggagtcatcagagagactaacagaagaggggacgggaggggaaggggttctgggagtcccttcataagaatccaggtcggggccccaacccattggtagggttctcactttctcgaagttttacactcactcaggatggatggagtgtggagagtggagtccctgaactgagtagtgggaaaggcccatctcctaattctcttctgggagagacatcaggtagagcttggtgatttacaggtggattgagatttactgatcaactagttcagggtcaccatatccctggaaacactgcagtggggtcctcaaacatttatataaataaccaggggacttccatcatcaaatacaataacagcatctcaggcaacctaaattcacattcttggaaggattaccacagcattttaggaacttctgaccaactgtgacaattctattctttcagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagatcgtccccaaatcgcttcacagcagccctcagcatctctatttccgtctccgtccacttcgcgctgtcagaaggggagaggggggatagcaaaaatgggagggggggtgtggagcccgcccacaggctatgcatcccacagccaaccagccgcctccttccgatttctgggaccccttccacggatgcataaagaggtcctccgtaaggggaggcggaaagctcttgaggccctgcgggaaccgggaggaccccaatcacaagaaatcacaaccacctccaccttagacacccctttccaccatcaacgttaaacggctgctgtacacagcacactgaaaccaactcgccaggaagggcttttcaaaacagacccaccaacacagcctgcagccgtctgggggaattccatgaactggggtggttgggagtggcggtggtttgtggtcgacccgttcgcagcagggagaactgtgaaacaggagtctgggctatgggcctgtctgtatttttatctgtcattcattccctcacccaacgatcatttattaacaccgactctgtgctgtgccacgcacaaagggaaactaatgtctgtccctgtgctagagagggtccgtgtctgtgaccgagtccaagcgcccgctctcagcgtccacgtcccagtccgggctcacgtaccccgcaggagaagagtcggccacgggatgcagctgcatcgtcagctccccgagcttcgtgaaggcggcgccggccgccgagaagatctctccgacctgggggcggggcagcgtcacggggggccggcgcccgccctccccgtcccgcccggagcccctagccccaccccaggctcggctcccgcccgccccccgcccggggcggaagagccgcgagccaagtggggggcccgccctcccgtggccgccagggagcgctgtccgcgagggaggtcgaacctttgtggacgctgacgtcatggccccgcgcgcctcctcacggagacgccgccgccgccgctacacgcgagccgggaccacggagagcagggagactgagcggctcgggcccccgcgcaggaagtcccgccctccccgcagcggataggctcaacccggcggctccccgccccatcagacgcagtcgcttagaccgctcggcgcgcccagtcgatggggaaagccttcgcctcacttccgcgccacacttcgctccacttccgctcagagatcgggactttccaggcagaggccgacctctagtctcagccccgtgctcgcccccactcaagcacagacacagggctgaagagagcagattctctttattgagatacgggacacagcgaagggtggagagacggaacagccccccagcctcagccctctccacgggggccggatgccagagatgggagaagggattcagtctctcgcccgggaaacccagtcccacagagggcgccggcaagggtgggacgcgacctgggtgacacggtgcagggagtctttaaatagaggaggggctggagcggggaaacgcgccggggccctagcgcaccatgtattccttgcgcttattgagccgaacttggcagaaagagaagcctccgaggaggaggtaaaggcctgcagcgatgaaacagttgtagctgacttgctcgtaaaggttgtatatgttctgggggccattcctgggggtgggaatgaagcaaaggggtcaaactttaataggagccaacattttctgagcactatgtgcccgacacctgtttaggcgctgttacgtgtattactttattcaatcttcttgaccatcctatggggtgagatctgtcatagccattttgcagaggtggactgagaagcacagaaaagtaaaatacctaaagaggtcacacctaaggtggtgggtttgggatggccgctgaggtctgactccctggctcctaaccacattctcaagaaagccgctctcctctccaagtcctctaacctaggggccctaagcaccgggcctcccagacgtaattctgaccctaggcctcgccacctcccacctgctcccagcccgcctcccccacccgaatacttactcaaaatctttctccgtgaagggaacgtcctcaatcaacacagcggaatggacattgaaaaatattccgagcattatctggaaaaggggaatgggtagactgttgaattcaggcacctgacctcatgttcacttcgtaaacccctcccatttccaatgttgctacaacacccgagcctgagattaaccaaaacgaggtggtggttactggattcggactcagccacctggaacagggcgtgaggtggtgacattgagacaagtggtcgaggcaagggtgggaatagtgaccaagccatctctcccaggaacccagattatcgtcctctctggaggcgtcatcatcacgggacagtgcggaagaggggagggagaaccggcacttcttcatatcatttcttcttgaagtggcggtgggtggattactgggaaaacaaggcccagctacacatttctggaacaagcactctcttttcctcccatgtcctccattcaactcaagcacctctcaggaaccccgctcttgtttctcctaccttgaggggtctccacctttaccagccctggctcctcccactccagggccctccgctccagttcccttttttctttttctttggggacggagtctcgctctgtcacccaggctggagtgcagtggcgcgatctcggctcactgcaccctccgcctcccggattcaagcgattctcctgcctcagcctcctgagtagctgggattacaggcgggcgccaccacgcccggctaatttttgtatttttattggagacggggtttcaccatgttggtcaggctggtctcgaacagttcccatttttcaatttcagtctgtctccttctccggggcctgtagatccccggcccctccggcctgcctgcggcccagagtttcctcgcctcccagccctcccagcccggagcccctcaggccctctccgatccttgccggggagtcccctcaccaacatgatcactccccaggcgctgaggacgatgccgcaggcggccagcttcggcccacagcacaggagcgacgccataaagaagggagtcggggatcgccgaggtgcaagcgggctcggaaagcggtgggagaaagcccaggatgccctcgcaggggggcagagggggcgtggccccggcctcaaccatcccatccgggggcggcaggcggaaaaggctgggctcctctcaggactttcgcgggagacggcgccgtctgaaaccaaaactgctcctggggaaaccttccttgacctctgtagctagggcgtgagtattggaagagcgagggcctccggtttgttggtccccctccccccgcacacgggaatggaaggagctggtatgtcacgtgaccaagcctgtcacgtcacgtgacgaggaactagccttagcgaggccatgggggaaaaagtctaactggcggaactcctgggaactggggcgatgggctcttagtatcggaggattggagccatctgatttttacctgaaattccttagtctctcctgtgttggggaaatggtaagtaagacagattttcaccaacagagagcgtttctatctcttctctactcctcccttttaaaattgagattctgacagygtaaaggagttaggacccccttttggggatcsggcatggttttgtggctttaaaatgctttaaaattgctgaagtttcttggtattggaactgtttctcctaagtaacattttatcatcgcacgtgaaatactgtaactctcggtgccaaatccaggaaaaatgggcggttaggagaagtccagggaaagccgactgagcaggttgtgaaggtaagcagtcctgttaaatgtacacaaaaatgtcactttgcttctctaaactaggaaaactgataggacttttgaataaggtaggatataagatttaaaaatataaataggtcatcccctccaaaaaagccgtttgtatgtttaactggtgagtgacagatctgtaataattayttagaaataggaatgtcgaggcgggcggatcacctgaggtcgggagttcgagaccagccaggtcaacatggcgaaaccctgtctctactaaaaattacaaaaattagctggatgtggtggcatgagcttgtgatcccagccactcgggatggtgaggcgggataatcccttgaacccgggaggcgaaggttgcagtgagctgagatggcgccactgcattcccgcctgggcgatagagactacttctaaaaaaaaaaaaaaaaagaaaagaaaagaagtagggatgtttgaagaacacagttttgcagtgagcaagttgtacccactctagtgaggacagtgacctcagaataattgagagggatcatttgaccttgagaccccaggacctaacaaataaacactatcattggctagaataactttgtagttcttgtccatttattttgtgcatgttgttcttaaaaggcttgtgaaagataacttggaatgtgggaaacacatagatcccagartattaaaggggctggaaaagtagccttaagacatgaattatgtgcctttcatctgggactgtttggagaaagaagccattttggggcagtggtttgtattctgccccaaaaacatgattcttattcagggacttttggggtacatgggtgaataggagaaatatgggtggaaggaatttgccaaagaactgagtcaggaatttgtacattggccaccaggcatgaaggttagttcctgggaatggagagttagctgaggtaagctgatttttctaagaaatccccctgctccatgatcttggatgttttggaagtagggtcagggcctcaggctagtgcagggttcaagggccaaatccagtctgtagcctggctgtgcatgtctcaaacaaagcacatttgtttgtggattttttttgcattttaaatggttgaataaaccaaaagaagactactttgtgatgtaacattcatatctcagtgtccataaagttttattggaacatagtcacactcatttccatgttgtctgtggctgccttcatgctgcagcaggagagctgagtagttgagacagtgactatgcggtctgcaaagcgtaaaaaaggatctagtctttgcagagaaagtttactgctcccctgggctagtgggatactaatgtagggggtttaactgggggaggaaatagagccttagcagcagagactttaggaaagcatgaaattcaagatagaaatgtcagtcctaaagctgatgtgaaatcttgcaggtagagtcactctagggctcagatggtgacactgttctctatrcagctgggcttcagatattcatagggccagtcaagttgctcattccgggctgtaatctccttttcyagcttttccaaatctgttcggaattggtttagcacagctttgggcttggggcctgagaaatatttttctttgtggtgccccagaggcacctgagacagaacaaaggatcagtcagtttctaaagacaaacgcacctagagcccagcccctcactctgatgtttcctttccaactgtcatttccctctcccgagagtcccctctcaccatgtctggctggcggcgactcaratgccatgagatggccatttgaagacaggcctgccggacatcaggtagtgaccccatcactgtggccatcgtcacatcttccttggtggtgggtgggggcatccgcattgtgcatggagcattagggacccaggcataccagtccagctggaggaagaaactgtaaccctagaaccctggtacttagggtttgaactcccatctctccctcaggtcaccttgccttcagggacctgggctttcagctgtccatacctggccctggttgatggcggcatgctgggcagtgcacgtgaagacgcacatggtgaggaaatggcagagttgactctgggactggaaggagacagggaaacctgggcaggaaaggaatagcagttagaagctacagcataagaggagaggaacaaaggctgttgttttgggatgcccatattttagaattgatgaatttgtttattttatttagacgtatttgcatcagacatgcgtttaagtcctggctcagtcacttacacttagttaccataggccagcttaacctatttgaacctcagtttttttcacctgtaaaatatggacgatacctacattataaatgagatgatgtatcaaaatcacctggtctgtaataaatgctcaataagtaagtaataattattgttatggaaggattgggggctgaaaagttctgagtgaccaaatatcccttgcctcaaaaagtggttaagaattgagggatgcggccgggcgcggtggctcacgcctgtagtcccagcacttggggaggccaagatgggcggatcacgaggtcaggagatcgagaccatcctggctaacacggtgaaaccccstctctactaaaaatacgaaaagttagccaggtgtggtggcgggcacctgtagtcccaggtactcgggaggctgaggcaggagaatggcgtgaacccgggaggcagagcttgcagcgagctgagatcccgccactgcactccagcctgggcgacacaacgagagtctgtctcaaaaaaaaaaaaaaaccaattgagggatgcgtggtcggtgactcatgcctgtaatcccagcactttgggaggccaaggcaggaggattgctggtagtcaggtgacagagcaagagcctgtctctatttaaaaattaaaaaataaataaataatttaggaatgcgtaatcctattcccrgacagaattacaagtgtctgcgttataatgtggggaataagtcatggatttccagtgtcacagctgagaggggctcccacaaaggttatctcagtccactcattttgcagtggatatgggggctcagagacccgataatcttttttttttttttgagacggagtcttgctctgttgcccaggctggagtgcagtggcacaatctcggctcactgtaacctccgcctctcaggttcaagtgattctcctgcctcagcctcccaagtagctgggattacaggctcccaccaccatgcccagctaatttttgtatttttagtagagatggagtttcaccgtgttggctaggctggtctggaactcctggcctcaggtgatctgcccaccttggcctcctaaagtgctgggagacccaataatcttatcagttaagtggaataaatataattactctcattttataggtaagaaaatcaaagcccatagagaataaactgtcaggactgcatagttgggaaaaggcagaggctgatcttgaactcaggttcctgactgctaatcccatggcatttttaattttagcctctaaaatgtctgctgggaaaactagacaaaagtgagctatgagaactgaaagagaacaggggggagggtggttagtggaggttaaagttaacatgtgtcatgaactgaatgtctttggctccgaaaaatttttatattgaaatctaatcctattgtgatggtatttggaggtggagccccacatgataattagggtgtgagggtgcagccctcctgaatgggtttgatacctttatgagcagaggacagagtgctagcttgctatctttctgctgtgtgaggatacagggagaaatcggctgtgggcagcctggaagaggggtctcaccagaacctgatcttgaactttcagcctccagaactgtgaggaatacatttctgttgtttataagccacccagtctatggtgtgtggttttttttattttatttttttgagacggagtttcgctctgttgcccaggctggagtgcaatggcgtgatctcagctcactgcaacctccgcctcccaagttcaagcgattctcctgcctcagcctcccgagtagctgggattacaggtgcgtgccacgacgcctggctaatttttgtatttttagtagagacgggtttcactatgttggccaggctggtctcgaactcctgasctcgtgatccacccacctcagcctcccaaagtgctgggattacaagcgtgagccactgtgcccagctagtgttttgttgtagtagcccaaactgctaggagcctaagggactgtactgagaagaactagagagagtttggtcctggaagggtagggtggtgcagattccccagggagaggctccctccagggtaaggaggtttgccacattcccaggattcgccataagggctccccagtaaatgtctgtagttgtctcacagaggcagaggatggtattcacagcctagatctgaagtgtgagggggaggggccgaaggatgagtgacagcagtccaggctggtgcctgtgtgattaaacctaagagctcagcaaaggctttttcttcctcagaggttcaaatgtggggagtgagagttgactaaaggtagtggctagattttggccaaggggtggttagggtggaagagttggattagccaaagaaacctgagccccaaggatcagggtgctgagtttgggtttgaggcaaagcatgtataggattgagcttgcatcaagagctgaccttgcactgtagcaagcgtgcggtattcctggaccctctgtgcgtgctgcacagtggcaggcaggaagagagggagggaaagccagggtgggtccttgtgggcttcggagggaaaatcttcccatttacatcctcagttaggaaaacggaaccatcaggagagaatatgagcccagcagggactgtgcagacccctcccagctgtggatatggcctggggggccccaggatatggcagttcaggggcatctgtgactggggtgtagtgggactaggggttgatggccagggtctctgaggaggacagtycttgggtctctagaattgtcctgagtcggaggaggtgggaatgggatacacatgctttcccgtgtggagggaggaagggaggcgtgatgagaggctggggtcctgtccccagaagggcagggctgggaaggcgccctggsagagtctcccaggagcttcttctgtctctagaatggatcttacctcggtcctgggcctggcacagccccacctccgtgatctcccgacaccaggcctgcagctcagggtcccccttcactatgtcatccctytggtagaagaggtggacgatcccctccacatacctgcccagggggaaaaggcacttgagggcagaaagcccccgcctctgacctctattcctctttctgtggcatctgcccaatgcttccacagtatctgggaagacacctcgcctttgggacatcctcagccctctaaacacactagcatctcatggaagatgtgggtccttagttctaggaattcgcatggttgctgtcatacatcgtcagaaaatcctgatttttccagacacctcccccagtctccccccacagctcccctcacctcctctctctgcctcatcccagtctcctcattttcagagccacccactgtgtcctcacttttcctcatctctccccaggattgagttctctgcttctcctttctggaccttcttgcttttgccccatgctggcctcaggccagagcccccccscccccsrccccaccatttctcagctcctccttactcacctggcaatgatctcccagagccgtaaagcatcatgggcatagagagcacctgggagtcccagcaggccccggtcagccaggtcgtcaggaggacagagggagcagtaggtcagctgagctgccgcccgacggagcaactgtacatggccccctccacctgtgctcactgcctgggacaggagatcacaggtcttagagggggaaacagggctggagaaccaacacatcttccataaagtggggcaaatgtgggattttcagatattaagacatgggtatacagcactttgggaggctgaggtgggtggatcatgaggtcaggagttcgagaccagtctggccaacacagtgaaaccccatctctactaaaaatataaaaattagctgggcatggtggcgggcgcctgtaatcccagctactcgggaggctgaggcaggagaatcgcttgaacccaggaggcggagatggcagtgagccgagatggcgccactgcactccaacctgggcgacagagctagactctgtctcaaaaaaaaaaaaaaaaaaaaaaaaagacatgggtataaaagggacaggttcataggttaagagtgaggacattcacacatagttgatcttggatcctgaaagtggcagatcatggagrgatggatgaggcagtcccatgccccgtaccctcctcaccttatcaaaaattcctccatctgagatgagttgggtccgggcccgggtgttgatttccatggtgtagcggatatgggggatcaggaactggagaggaggagattggagggcgtgactggtggaggccatgcttgggtccttcctggtagggcctggcacccagcatggcgccttctcctcttgatgctttcctttacaggctgatctcctgctgttctgatcactcactcttgtgctctccaacttccctgtgagttgggccctggagccagactgaccaggattttaacctacactttactcctcatttgagacttggccaagttaataaccttttaatctgcaatctcttcatttgtcaacagggggcagcaatagactctcttatctcaggggctgtggtgatgctcacctaagtgatgttggagagtgtctattacacataagagtcctggaatagtagctgtctgcttcattgtttctaccttgagtataggtgccttatgaatcagccctttctgattttctttgctacctcctctgtcattcacatcctcttaaactagcctctctgcttatgatcaaagctgcatctccatcttttagttgtttcacagttgggggtttctttaggggatggatggggagaatactttctgtcagaactagaagagctatattcagctacctgtttaagcaaatctttctccacccctacttaagcactgttgggcccctcttctcctgcttttccttagctattgaaaaaaggccatggtctttttttaatattaaaatattttccttagctattaaaatttaatattaaatttaaattaatttaatattaaatatttaattttaaattaaaattttaatttaatattaaaataaaaatattaaaatttaatttaatattgaagcaaaattaaaattaaattaattaatttaattaaattaaattaaattaaattaaattaaaaatattaaattaaattaaattaaattaatattaaaattaaaaatattaaaatttaatttaatattaaattaattaaattaagttaaattaatattaaattaaattaagttaaattaatattaaattaaattaatttaatattaaaattaaaaatttaaatgtttatttaaaattaaatttaaattttaaatttaaatttatttaaattttaattatttatttaaaattaaaatttattaaattaaaaatattaaaatattttccttagctattaaaaaaaggcatggtccttacatgcgtttctttttatcttagactgtttgtcttcctttccacatagttaacatgcaggtttcaagcagttttggtgcttgtctgaattgttgatgctggacactggcaatgaccccaatgacacctttggtgttaagataccaaagcagctcacattaacctgaagcttttcagaagattcatgaaagatgccaaatgtcacggaaaggccaaagtccacatgaggagaaaggatgcctaaggataaacagtccytaataataataattgcaagaactagctgggtgtggcggcatgtgcctgcaatccaggttacttgggagrctgaggcaggaggatcgcttgagcccaggaatttgagactagcttgggccacatagygaaaccctgtctctacaaaaaataaaaaaaattagccaggcatggtggtgcacacctgtagtcccagctactctgaaggctgaggttagaggatcgcttcagcccaggagtttgaagctgcagtgagttatgattacgccactggactccagcctgggtgacagagtgagaacttgtctctgaaaaaaaaaaatttgcaagaactaatgttttttgtagcatttagcttgtgtcacaccattaagtcattttaacctttaataacctcacgatggaacatgtgaggacatctggaaattattgaggccggggttcaggactaagaccccagcaatccaaagtcagagcctgcataggccactgttaagacatstgcaggcttgacccttgtgtgcatctgccagcaactcagctgtccgctggggcatggcattactgtggtgagtggagacacggagaggactgaactaggaaamggaattgtaagtgtgaatagaggctkcacttgttcgtgtggagcagaggatggggaagcaggagacagcatgagatgaatgaaatccaagattccattcatcagactggtctccatcttgtctatgttaccgaaggggaaaattccagaggcggcacagctatactggccaggcttggggggtcttggtggaggcccccagctgaaacacaatttggttgtttttacccaggacatacttgcatatcttgccaatacatcaaactccatgtacctaaaaccaaacacctcatttttgctgactctggtttcttctaactttactgtttctgacaattactctggtttgtaagcttgtatcatttttgtgctccctctgccaagttccctgtatataaagtatcatcaagattttaagaacattttcttaagcaagcacaggtcttattttgccttctcccagcaatatatatggaactcactgttttataaaattacagtatttctttctttctttctttttatttagagaccgggacttgctgtgttgcccaggctggtcttgaactcctggtcttaagcaatcatactgctttggccacccaaagcactgggattacaggcgtgaaccaccacacccagctcttaaaaccacagtatttctaggtcagtataacacacctgccccagggacttacaggtgtggcagaagcttggacttctggcttttctctctcttgcacccaggcacgctgcagctaccatttcctcccttcactacgttttagattctttccttttcattcctgtcattaccatgctaacrtacatctctatccaccttrctgttgggcaggtatgagcggcttgctggctgttcttccttgccttttggtctgtttctacttagctgactcctcaattgggtagaaacattcttcatcaatactatactgttataggctgtcccttgtgatttcaaactctagtaccagatactgttctctggttggttcttatgggcatcacttgtttttytggctaaatactagatctaaggtaggaatatggcttttkttttactagcagtgttcaagccctactgtgagcgcactgctagactgtcagatctctgagaatttcagaggattcctatataatgttaagtgactaaacttaataaacttaattaaaatcaacatctcaagatattgagacagtctcctcttcactcacaaattgctacaaagagtttttgctgctgcartatcttttgatatggggctgttcctctctctggggtctgagggatatgtgatttaatagattaataagtaccttgaagatggggtgcagtcctgggaggcaccgcatggtggcgacagcgatgacctcagccaccaggtgmgtgttcagcaagtgatactggatctcgtgcagttggaaatctgaatttcggacccaggactttgccaggagccaggcaagtggggggtctgagggcaggaacagtgttggggttggagagctggggytgggaggctgaatctgggagaaagagaaattattgaactcccattccgtatatgacattatagtcagcattcttggggaaacagagatgactaagtaagattattgccttctaggaggttatagtctagcaggaggactgtgaaccctcccagcctgccgctcgctagctggagtgccctgatgtcaggtggaaggcaggagggactggaagaagggggtccagaaggaggccctaacagtggtgtgggagaaacctgctgctttggggtcggcgctcagatggtggtggaatgtgaaggagaagtaggaggtgtaagattattgacagttcttgtcacctgactgttaagaatagtgagagaaggccaggtgcagtggctcacascygtaatcccagcactttgggaggccgaggcaggcagattacttgagcccagaagttcaagaccagcctgggcaatatggcgaaaccccatctctacaaaaaatacaaaaattagccaggcccacatggtggcacatgcctgtggtcccagctactggagggactgaggtgggagaattgcttgaacccaggaggcgcaggttgcagtgagccaagatcacacaactgtattccagcctgagtgacacagtgagattctgtctcaaaaaaaaaaaagaaattgcragaaaagatattcaagagatggcgagggttcagagccagaggccactgagagatgagatagtgattctgaaagtgtagtcctgaactggtagtgtcagcatcactttggaacttataaaaacgcaaactcttagttcccaccccagacatactgaatcagaaagtctggtcatgggatccagaaatctgcatttcaacaggcattcaggtgattctgatgcacactgaagtgtgaggaccattggatacaggatgagaactccargaggccattttgactcttgaaaaagtaattctagttggatgaggcaggggagaygagggtacaggcaaatagtgacatgaagacaagtctcactgagtgaggatggggtttgggagccaagagctgggggttgggtccctgggagcagaggttgaggtgaacagagtgcaacgttgtgggagaggtctggggcccttacctggatgaccatgggctgcagcttcccattgggctccatcttcagcataacgaggggggcagccaggtattgcttctctcctcggatcacgttggctggaattccatccagaaggatgaagtcagcttcaaacagggaaccattctggggacaggagggatgtatccatttttagagttcaaagtctacccccagggggccggggcaaagggcaagagatttagtctagcttcttgccattctcctgcatcagtaccggagycctgttgggagaactagagcccctggtccagttcctctcatcttaaagtgaagaaacagtctggtgagggtagatgtcttgtgtgtggatgtggtggcagatctgggtttggaaccaggcctgctcaatccagttggcatcacaggcattgtaaactgaccacctgtcaaatggccaggcccctttctgatcattcccgaatggtctgcgctctggttttggctcctatcagctcagcaaatgctctttcattccctattcaaatctcacrtcctctgccaaatattccagagagcttcccctactacccctgccaccgcatacagcacacacatgcatacgcacacattttgcctaggcttgtcctcagtacagtccattgcttccaaaccccgctctctttttctagaaagcctccccgattctccccacctgatggcacttcctcacttttctccctgcccatgaacactggagtccagaacactgcggccaggcaatgtcactgttcctgctaacatctccagcccctctctgtgtgctggggatccattctattttccccttcctgctgggagctcctcatagtttcttcccctacatattttatttctgtatttttccagcacaggactgcaccaaggggcaaygcagtactgcagccttcctctgactcagtttggattctctctgtccgttctcaccacactactaaggagagaacagtgccaggcaggggaaggagaggtacctgaagttctttctccagttgagccygaagctcttccatcccygagggcagcactagcctggagggcagagaggtcgagcgtctcaacagcatggggttggcaccattgaggaactggtagctgaacaactcatcatcctgccagcactggcgaaccttctctttggtgggyggtgaaaggaggatatatgtaccacagcctgcatatcccttctccaaaatctaccccaggggttcaggtatataaccctccctgaacccagcttctgcgttttcattctcaaggcctctctgagttgaccagatatgataaggtctcttcttgcraagagttacgggggactgtggagtgtgatgagtcatccagasgggccattaagggattatggagacctcggggaaccactgaccagccagggcactcttctggccccagaagatctgatcaaagtcttctaggcagttccaggagctcaggagggtgtaaacaygtttgagggccatctccagagccctaggacaggtattgaggcttaactcatcagctgatccctcagtccctcaccgtctatcatcattcttggccctcccagcccttatttcactycgaggtctagcctttttctcaccctgccttcagtgtccattcaaagtccagcctcttctcctcatggaatctcatatttggaggtagatcatccttacggtctgcagcgatggtcaggggtaacccttccttccaggtggcccagctaggagttggggacaaagcttcaggaaggatgtcatggtcagtgatggggccaggggcaggggcaggggcagggaaggggtgggacagtggtggcggggttagtttaaggggtgggtggtcaccagtagatctgctgtctgtctttcagttccttctctcgatgcttctggaacatgtccaaagcattgtctcctggcaggcgggctggggagacatcaagacaattggcctcacggctctgtctggtcctatgcccgcctcttgtcctcatctccctgtggttagccgtattccatgttttcagccatgcactgttgcttttatctctggctttgcctcatttgattatccaccagacaygtttatcccatctttgccaactttgcactcctgctttctcttatttcagccctcatcctttgcctgtagataaaaacctcctgtttgccaccatttcttgctccttcactcatcttcccctacctggccttacttcatcaatatctatggttggaaaaaaatcaccttaattaaggtgatgaaatcttagtcacctatacacctacacctactgtctactacagattgctttgattaatttcacatcttaaacctcacctgccacgccttcacctgtcctcaaaagattctacatttgcttttttttttttaaacctcatctttctggatttactatcataatctgtatctatggacttattctgggtcttttctgcatttacactcacctgtctcaaagtcatagatttgatgttccatccctactgccctcactcatctctggattcatctctcttttactcattacccatggttaaaaattcactatttgggccgggcgtggtggctcaagcctgtaatcccagcactttgagaggccaaggagggcrgatcacgaggtcaggagatcgagaccatcctggctaatacggtgaaactccatctctactaaaaaaaatataaaaaattagccgggtgtggtggggggtgcctgtagtcccagctactcgggaggctgaggcaggagaatggcgtgaacccaggaggtggaggttgcagtgagccaagatsgcrccactgcactccagcctgggcaacaragcaagactccatctcaaaaaaaaaaaaaaaaaaattcactatttgccatcctcattcctcctcrtctcctgcgggccagtgtgcttcttgtctttcacgggtgtcttccgtgttattccaaccaaaccagctctccagcatcctatgttttcttcccttagctgtstgctctcacgggtcacccaccccctcctgttccatgtggtcccctcacctgacttctgagtcacctttacatctccttcctactttcactttgcttctctgttttcctggatcgctgcaactcccactttctgtctttgccttcttggaagatgggatctccagatcacttactccctgcctccagcctcacacgcagcctctcttagcctgtgtaaaactttgggaattcataactccttcccgttttctgtccagcaccctgggatccctacatttcacctgccctgggcccatacmtcctctaagtctgctccgaccgtccttaactctgccctcctagccccgcagcagttcccgrgaccttgtgcctccttccccracgccgcctgctcaccggtgccctcgggcaggctcaggatgtcctcgccctgcacccagcggtagcacgggaaggccacctccgcgcaggctccagggccctgcaccgtgatgcggtcgcagaaccacgcgtcgtccaccagccagtggtgcttgcgcagcctcacgaactgcaggagccccaagtcctctgcaacgtcatgatcaaactcctcctcctgtgcaggccggacccaggccagacttagtaggagggacccractgaggccgtttcgaggacagagcygcgctcctgtgcaacctcagtttctcagggcctccaaagacagcatcgcctcgttcccgcccccgcacaacctgctctttgggtctcagacgcccggagtcgggtggaggacgagggcccgcagcgcctggagctgatgctggagcagcatcgcccacgtgggtcccattaactgagctctccccgcgccggttcttggaggagcttcacgtctgacctctggcctcatacttacattggctctgggtcactgggagaaggagctgggggctgccgggaccaggggcgggaaagggagatggggttgagcccagcccgggatcccagctgcggaccctgtccctratcttgcccacctcgtcccagcttcgtggaagtcccagtccgcgaggtcgcgctgtcacctcgcccccagcctcccgccctcccgccgcgagcccagctcgrcccgggcctgggcccggggtccccgctgccctagctcccctcgctccccgcgctgacctcgccccgcgcsggccgcagctgcagctccagctccgcctccccgcgcgtcccgaccagccaaagctgcacgcggttgtacgacccggagaagagccaggccccggtggccacgcggatgcggtagcggcccatggcgccccccagcagcttaggcgaggggagccgggtcctgtgcgattcccgggaccgcccagggctgccggcgcctcggggccacttccaacctttaaaggaccggtctgcggccccgccctcctcgcaagttttaggcgctcccaagtccccgccccagactagcccaaacctgcgagcagagcggtagagccggctgtggggactggctgtgcytcctggtcggagcgtagctgcaggatgataaaggggcccgagccagggtgaggccaacggggtgggtgcggcgggaccttcctggacctcccgggaaggcggratcgaggtgggyctgagcccccgggttggagcgaacatagatgagaacacttcccgaggtctccaggtcttctgkggagccaggaggaagtaggggatgagtccatcttccaaacggaggggaaggtctccgcttttctgggctgggacccggggaaggcagtgggccggcttctggaaggtcggcctgggaggccgtgctggggtctggggatgtcccgyggctagacccggcgcggcccatgtgtcctccagtacctgagctctgccgcccttgaacgctgtgcttccgtcaacgaccaggggttccccagggtacctagaacctggaaatgtagcagctcaacacccgctccccaccccgtttcaaatatctgggcgctggggtcccaatgtacaccaaatatcatgggccagacctttgagagaggcctgaggcagggcagtgaaaaactcattttgtccaacctccgaagcgggtacagacaatgttagggacccaggaacaccagtcggggtgttagggtgcgggatggaattgcttagggacctggcctacgtggccagttcccaagaactttgtcttttccaggtgagtgcagccccttccgctccagtaggttccagattaattttttatccccaagctctttcctgctccttcatgggtctcaggtctcctggaaatccaggaacagcaattagcccactgctatttagggcctttgtaaacattgaaggatgattcggagcttaggctttctctcccgtgtcaggaatcagtcagatgaagcctgctgcacgcgtccctgtctagatcttgattcaagtgattatatgcatttggatctccgtggatgcatctggtggcctgggctaggccagtgtaagttaaatctgctttcttgagccagtcctcagaaatgacttggtggcctagttgttggtrgaggtaagtgagtgggagttttagccccgccttccagcctccagatcagactctatctcaaaaataaataaataaataaataaaaataaaaaaataaagtgtctgtcccttactggattcaattccctttcttatcttctaggtccactctggcctacatcctctgctcaggactgcaggtcggccatttgctggtccccagttcttccagttttctggggtcaccccattctgtaatatccaaataaaatggctcaaattcccatcctgcctaatagtaggatctggcctttccacacacattttcgtgggttacttttgcctagaaaagagtttgtctcatacctacttccaaaagcactgtttctttgctgttttgtgacttattttctgcccactctagtgtactctacggccacgtgcagagagagggaatgaataattgaaaaaccggattcaagctactgcgcatgctaaatgagtgaatatggctaaacagtgagaacagtgcttggcgtgtagtccctctatgtattagctgctatgattgtattatttacaactgaatgttagcgttgctcctctaccgttcctctccgcatgctatttctccatgtccctctctaggcctagcctctcactagagctcttatcactctagacccttccccctcctgcttttgtttcccttttaagcacatgcgctatgttgggagaatataattagaagcaaaattttctcccaacccagaaaaaacctctccacgaaagtagtgaagaaagaaaacagttttattattgaataagcattaaaccagaatgtgagcacatcacaggcagtttgctaagagactgcaaagacagaaggaagtctcacttttatctagccaagcagatacagcccattacatatgtgttctcaagataaactataaataatctttaggaggactcgatagcaccatttgtcacatatagtgcagtctagagacacctggcaattgtgatgaccatctatgttagctaactggcttaatcagaagaaaaacttctcttttttttttgagatagagtcttgctctgttgcccaggctagagtgcagtggcgtgatctcggctcactgcaacctccacctcccaggttcaagcgattctcttgcctcagcttcctgagtagctgggattacaggtgtgcaccaccaagcctggctagtttttgtatttttagtagagacgaggttttgccatgttggccaggctggtcttaaactcctgacctcagatgatccacccacctcggcttcccaaagtgctgggattacaggcgtgagccaccatgcccagccagcttttcagatttttatgacagcagatagttttgcagctcaagcaaagtgtccatttaagttagtcctaccctcccacagaaactgggaaatgaaggctccatctttcttggtgtttacatttcaaggagatggctcctgggtctttgtgaaagacatccctgggtagtaaagctggcaagaggctgtgtggcttctaaaaatatttatacacgttttgaagacacagaaaataacttacaagttttctggctgggtgcggtggctcacgcctgtaatccccgcactttgggaggctgaggtgggtggatcacctgaggtcaggagtttgagaccagtctggccaacatggggaaaccccatctctactaaaaatacaaaaaattagccaggcgtggtagaggatgcctgtaatcccacctacttgggaggctgaggcaggagaattgcttgaacccgggaggcggaggttgcsgtgagctgagattgtgccactgtactccagcctgggcaacaagagtgagactttgtctcaaaaaaaaaaaaaaaattttacaagttttctaaagcaaattttctaagaaaagagagggtggagaagtctcttcccttactttcaacatggagaactaagcctttaattttttttttttttgagatagagtcttgctctgttgcctagacgggagtgcaatggcgctaccttggctcactgcaatctccacatcctaggttcaagcgattctcctgtctcagtctcctgagtagctgggattacaggcacgcaccaccatgcctggctaatttttgtatttttggtagagatggggttttaccatgttggccaggctggtctcgaactcctgacctcaggtrattcccgccccccttggcctcccaaagttctgagattacaggcgtgagccaccgcgcctggccagtgttttgttatagtagcccaaactgactagcagccttttgttttgttttgtttttagacagggtctcactctgtcacccagactggagtgcaaaggcgccatcacggctcactgcagccttgatctcccaggttcaggtgattgattatactgcctcagcctccccagtagctgggactacaggcccgtgccaacatgccygactaatttttgtattttttgtagagatggggttttgccatgttgcccaagctggtctcaaactcttgggctcaagtgatccgctggccttggcctccctcccaaagtgctgggattacaggggtgagccactgcacctggccattttatttttaaattttgatttgtccctaacaactaccattttgttcttatgtatgccacaggaaggatcaggggcttgattttgtcagcaccctttgcagtaggaaaggccacgtgggcacacgtgtatgccaaatgtaaatcttctttcaaactcccgattccctgctgtctgtgccagtagccaagccaactcccacattcccattacctctctttgcagaacaatttaccttckgtgtgtgttttttttttttgagatagaatcatgatcttggctcactgcaatctctacctcccaggttcaagtgattctcctgcctcagcctcctgagtagctgggattacaggcacccgccaccatgcctggctaatttttatacttttagtagagatggggttttgtcttgttgggcaggctggtctcgaactcctgacctcaggtaatctgccctcctcggcctcccaaagtactgggattacaggcgtgagccaccgtgcccgtcccaggctccacttctaattctagttctctttcaatttctactacatctgcagttagttcctccaagaagtcttgaaccccttgtagtcatccataagggttggaatcaacttcttccaaactcctgttatgttgatattttggcttcctccattgaatcatgaattttcttttttctttttcttttttctgagactgagtcttgctcttgttgcccaggctggagtacagtggcacaatctctgctcaccgcaacctccacctcctgggttcaagcgattctcctgcctcagcctcccgagtagttgggattacaggtgcccgccaccacgcctggctaatttttgtatttttagtagagatgggtttcaggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaatacaaaaattagctgggtgtggtggtgggtgcctgtaatcccagctacttgggaggctgaggcaggagaattgctttaacctgggagtggaagttgcagtgagctgagatcatgccactacactccagactgggccactcagtgagactctgtctcaggaaaaaaaaagacggggtttcaccatgttggccaagctggtctcgaactcctgacctcaggtgatccgccygcctcagcctcccaaagtgctaggattacaggcatgagccacagtgcctggcctcaatcatgaattttcttaatggcatctaaatggtgactcctttctagaaggttttcagttcattttgcccagatctatctatggcagctatatagccttatgaaatgtatttgtttctttgttactttattattattattattttaaattttagagccagagtctctgttgcccaggctagagtacagtggtgtgatcatagctcactgcaaccctgagctccttggttcgagtgggcctcctggctcagccttgtgagtagctaggactgcaggtgcacaccactgcattggctaatttttaaattttttgtagagagatgaggttgcactatgttattatgttattcagcttgttttgaatacctgggctcaagtgatcctcctgccttgacctcctaaagcactgggattacaggaatgagccaccatgtctgggcccctgtttatttttwtttatttatttatttatttagacagagtcttgctctgttgctcaggctggagtgcaatggtgtgatctcggctcactgcaacctcctcctcctggggtcaagtgattytcctgcctcagcctccccagtagctgggattacaggcacctgccatcacgcccagctaagttttgtatttttagtagagacggggtttcaccatgatggccaggctggtctctaactcctgacctcaggtgatacacctgcctcggccctgttttttaaaataattacagtgacaggtcaaaattactcctgatccttgggctgcagaatgaatgatgtgttagcagtcacgaaaacagcattaatctccctgtacatctccatcagagctcttgggtgaccaggtgcattctccatgaacagtcatttttgaaaggaatgtttttgtgagcagtaggtatgaacagtgggtttaaaatatttagtaaatcatgatgtaagcagatgtgtcatccaggctttgttgttccatgtaaagacacaggcagagtagatttagccaagttctcaagggccctaggcttttcagaatgataaatgggcactggcttcagcttaaagtcaccagctgcattagcttctcatgagagtcagcttgccctctgaagtttttttttgtgttgtttttgagacagagtctcgctttgtcacccaggctggagtgcagtggcaygattttggctgactgcaacctccgcctcccaggttcaagtgattctcctgcctcagccccccgagcagctgggactacaggcatgtgccaccatgcctggctaatttttgtatttttagtagagatggggtttcaccatgttggccaggctgatctcgaactcttgaccttgtgatccacctgcctcagcctcccaaagtgctgggattacaggtgtgagccactgcgtccagccttcctttgaagttttgaaggcaggtattgacttctcctctccagctatgaaagtcctagatggtatcttcctccaatataagactttaaactacaatgaaaatccgttgtttagtgttgccaccttcttcagtgatcttagctggatcttctggataacttgctgcagcttctccatcagcacttgctgcttcaccttgcactyttatgttatggagatggctactttccttaaacctcatgagccaactctgctagcttcctgcagcttccttatctctctcacccttaacagatttgaagaaagttcgagccttgttctggattaggcttggtttaagggaatgttgtggatggtttaatcttctatccggaccactaaaactttctccatatcagtaataaggctatctcactttctttttttttttttgagatggagtcttgctctgtcaccaggctggagtgcagtggtgccatcttggctctcggcaaccttcacctcctgggttcaagcgattctcctgcctcagcctcccaagtaggtggactacaggcgagcgccactacgcccagctaatttttgtatttttagtagataccatgtttcaccatattggccagggtggtctcgatctcttcacctcgtgatccgcccamcttggcctcccaaagtgctgggattacaggcatgagccactgcgcctggccagtgaaggcttttgtgatgagttaaaacatggtggaaaaggtcaaaggggaaatgagcacctgcgaagaggatccaaacccaaggggcaccctggctttataacaacacacactcatgggaatgaattcatttccccgagaatcaatccaggctcatgagagtgagaactcactactgtgagaagcacaccaagccactcatgaggggtccagccccatgacccaaacacctctcactaggccctacctcccaatactgctacactggggattacatttcctcttttttttttttttttttttttgagatagggtctcactctgttgcccaggctggagtgcagtggtgcagtctcaggtcgctgcagcctagacttccctgggctcaagcgatcctcccacctcagcctctttagtagctgggactacaggtgtgtgccaccatgcctggctaattttttttttttgtagagacagggtctcaccatgttgccgaggctggtctctaatgccttgactcaagcaacctgcccaccttggcctcccaaagtactgggattacaggcatgagccaccgctaccagttggggattaaatttcaacatgacatttgatggggacaaacaaaaaaaaaccatatccaaaccatagcattgactatagttaataataatgtatggtatactggaaatgtgctgaagtgttctcagcacaatggaaaaaaggtaactatgtgaggtgatgaatatatgaattagcttgattgtggcaatcatttcaaattgtaggcatatagtaaacatcacgtcatacaccctaaaatagccaacttttatttgtcagtcatacctcagtaaagttgggaaaaaggctttggctgattataaacagttctggtgaaacacatcattcagtattgctacgtcctaggcaagggctgctaatgtgctcttatgagggaatgctgggtgaaagagtatgtgtgtgtgggcacacagagtgtgtttgtgatattacagagaatagagtcagtggagagatggaggcagagtgcattttggagtgtagcatgccttttgagaaatagggctgtgaaggtaacaaacagaaggccagagctggagatgggtagtcagtagagctagtgagagggacaggttaagatgctggaggccttgggtgtaagtgatgaggggaagatcccgagggaggagataaaatctggagaatgcgtggaggaactggccttacatctgcattttcccatccaagtactaaccaggcctggccctgcttagcttctgagatccgatgagattggatgtgttcagggtgctatagccgtagacagatcgtgcattctcagagtgggcaaccacatcttagatattgcaatgattcgtggccctcgaaagggtcagagtacacaaacatatattaaggggttaaaatttcacaaggtagcaggagcggggagcaattaggaaaaaatgccttagggccaggcatggtggctcacacctgtaattctcagcactttgggaggctgaggcgggcggatcacctgaggttgggtgtttgagaccagcctggccaacatggagaaacccccgtctttactaaaaatacaaaattagtcgggcgtggtggtgcatgcctgtaatcccagctacttgggaggctgaggcaggagaatcacttgaacctgggaggcggaggttgcagtgagctgagattgtgccattgcactccagcccaggtaacaagagtgaaactctttcgcaaaaaaaaaaaaaaaaaaaaaaagtcataaaggctccataagggggcaatgatggaaaaaagtagaggaacatggcctgaagtaagagagacaattcttccttcgtaataggaaacaaagcaaaacaaatggaattggcagcaaatcaacttgaaaatgacgtgtggggaaatatcccatttgatgaattgcattttctttgtgaagtgcttggcaaggatctggcttctgagggtcaaggaagttgtaggggcatttcagagatagaaggagagtggagaaagtttgaatagactctgagggcataagagagagagctgaatgaggggctgggataggaatgcttggcatggctgagacactaggtgaaaattggtgatcatgaatttaccgcctgaacgcatgcacctgaacgtcttccattcacttattctggagctggctctactcgacatttcctttttttwatttttttttttttgagacagggtctcactgtgtcacccacactggagtgcagtggtgcgatctcggctcaccgcaacctccgcctcccaggctcaagcggttcttctgcctcagccttctgagtagctgggagtacaggcatgcaaaaccatgcccagctaatttttgtatttttagtagagacgggatttcaccatgttggccaggctggtcttgaactcctcacctcaagtgatccacctgcctcagcctcccaaagtgctgggattacaggcgtgagccaccacacccggcctctaacatttccgtaaagagattgggaggctcatcctggcacccccccttcaagcccccactgctagactagtcttcagggacacaacacccaaccctcggactctcctttcaggacccagctggaagaccagccagagtattttgtatttttcattctatctggaagaagctcagctaaaagaacagttgagctgtagggtccaacagtgggcatgaggggcagcaaaacttcaccccttctctgggatccccggcaacaccccgtcactattccatgctctgtttatttttctctttgctctaaggtttaccttgtaatccttcattgttcaaatcgctgtcactgattgatagagaattttcatgtcttgcctgctgctgatggtgtctttgttccaccctgagctgatccctatttggcagctatcattaacacagagctggtccatgtcacagacttttcctgaaggtttagaagggcagggaccagggtgaaacyagcgaggcactttccttgagtgccacatttaagggggcaccaaaaactcagtgctcaaaataaataacgatttaatgcaatatttaaaacaccaaaatgaatggaagaaatccataatgaacaaactattagaattttaaataagaacaggatcaactgtaaagcttgatattagccatctatcatcttcctaacatacttttctttctttctttctttttttttcagagacagcatctcgtatgttgcccaggctggccttgaaagcctggcctcaagccatcttcctgcctcagcctcccaagtagctgggatcacagggttgtggcatcacagctggctatattcttaacattattttgtaaccattccaacccccagaaatttctctctggctgacttgatccacagcgcctccatcgccatccctgagtgccttgttgtggaaaatcttactttatcttggttctgtttggtataatcggggaaagtctgtattctttcattatgtaaaacaacttatctctcattgtttcatctcctttctgagctctgctctgccagctctctttccaaaaccaaaatggctcttcaagttattttgtaaataataatgggccatctacttcttaacataaatgaatgattttccaaggtcaagttctctggtttcactgacttctccaccagtgtctgtaaactgaaaaatgcagattgactctcttaagattcatacattgccttcctaccctcaagaacaattggctacagtcagggctgtgtgtgtgtgtgtgtgtgtgtgtgtgtgtgtgtgtgtgtgtatgattttgatggaagcaagaaaagtaatgtgttcaatttaatcccacaaaaccctaagtagtagatattatttatctctttaacaaatgaagggatacacttcatttattccttctttagtttcttcattaatggccttgaaatcctaggctcacctgatcctcccacctgagcctcacgagttgctggcactacaggccctcaccaccatgccaggctaattatttttttatttttattttttgtagagacaaagtcaccctatgttgctcaggctggtcttgaactcctggcctcaagtgatccccctatcttggcctcccacagtgttgggattataggtgtgagccgatgtgcctgggcatatatgtttattgtgcacctagcgtacacacacatgcacgtggcattagtctttgttccagtcattttctgagaaggagtgtttaagaggtacattttttgacatcttgcatatttgaaactgtctctattcaacttaaacttgatggtaatttgcctaagactagaatcctggatgggaaataaacttctctcaaagttttgaaggtatgtttgttagtaaaggtataggctaagctctgtaacaaacctcccccaaatacagtgacttaaacatctgattaatagtttctatactggccgggccctggtggctcacacctgtaatcccagcactttgggaggccaaggcgggtggatcacgaggtcaggagttcaagatcagcctggccaagatggtgaaaccccgtctctactaaaaactacaaaaattagccaggcgcggtggtgggcccccgtaatcccagctacttgggaggctgaggcaggagaatcgcttgaacccgggaggyggaggttgcagtgagctgagatggtgccactgcactcctgcctgggctacagaaagagactccattaaaaaaaaaaagacttcctatattgtcattgtctctaataatctccacctctctctctctytctyttttttttttttaccactttcttggaaatttccacctcttctattgaattaaaacttttttttgctattgaacattttctgtcttgttctgtgattgttgctttcagaaaacatcctgcttttrtttcaaagatgctaatcttctctagtatttctgaacatagtaaatatagtttaaaaaatctgtttcttcattattcctattttctctgagtccctctttttaaatatctgttgatccttgatttttttttttttttgagactggctctgttgccaggctagagtgcaggggcgcgatctcggctcactgcaacctccatctcctgagttcaagcagttctcctgcctcagctgggattacaggcatgtgcyaccacgcccagctaattttgtatttttagtagagacggggtttcaccatggtggccaggctggtctcgaactcctgacctcaaatgatccacccgcctcagcctcccaaagtgctgggattaccggcgtgagccaccgctcccggcccctgatccttgactttatttaagagtgaggcaataaaaaaagataatccggactgttggtggggtttttcaatgtaatgagcagagatctggtcaattgataattgacacggttcctcccacagtcagtatttgtaggtcttttctattgggatgcttggtttcttcggagaccaaccttctaatttcccttttggggtgtagatgcccaaccatcagcattattggcagtatttgaagaggactggggagtcaccattcagtgtgttgcttttgttacattttcttttgttccacagggcacatttacctgatgtccgaagtccagygtccccctctgctctakcagacgataaacttctagtcttctgctggagaggagggagaattgcctgacttagtggatgataaaggaatatgggggccatttgctttttatatggactttcttttgtttgtttgtttttttgagacgaagtcttgctcttgtcccccaggctgtagtgcagtggtgcgatctctgctaactgcaacctctgcctcctgggttcaagcaattttccttccgcagcctcccgagtagccgggattacaggtgctcgccaccacgcccagctaatttttggtattttaagtacagacagagtttcaccatgttggccaggctggtctcaaactcctgacctcaggcaatccacccgccttgacctcccaaagtgctgggattacaggcgtgagccaccgcgcctggcctttatgtagactttcaatcaattctactgtgttcagcctcatgtgtacccctaccttcagtagttattggtacagtagcccccyttttctagtggggagaccttctaacttccaagatccccagtggatgcctgaagccatagacataccaaatctatagatacagtcagccctccttatccatgggggcagaacccatagatcccaacccaccgtgtatcgaaaatattagaaaaaatttgcatctgcactgaccagaattcaaaatttttgaatttttcctgtcattatttcccaaataatatagtattacaactttccatatagcatttacatcatattcggtattataagtaatctagagatggtttaaagtgtatgggatgatgtgtataagttaaatgcaaatactgcaccattttatacagcatttgaggattcagcatctgaggattttggtacaagagaggggggacttgtcttagactgtaggaggtcctgaaacagtctccgcctggatactgagggatacagtactagattttttcctatatcgtacatacatctctatgacaaggtttaatatatcaattaggcctagtaagagattaagamcattaggaataamcaaatataaatgcaaattaaaaataaagaaaaaactataaaaataattagctgggcatggtggcrggcacctgtagtcccagctacctgggaggctgaggctggagaatcgcttgaaccctggaggtggaggttgcagtgagcgagatcatgccattgcactccagcctgrgtgacagagcgagactccatctcaaaaaaaaaaaaaaaaaaaaaaaaagaagcaaaaaagaaaackgaaaaaagaggggagcaacaacaactaatataaaatagaataaaatagaatataatagaacaattgtracaatctaactataataaaagttgggtgaatgtggcctttctcaaaatatctgattgtgctgtgctcacctatttttgggctgtggctgactgcaggaaacagaaaccagggaaagcaaaaccacagatgaggggaaacggctgtactccccttcctgagtctttctaagggtttgtgcttattgcttttcctacatactgcaagcatttgacttttaactttccctggtctgctgaattgattaccccttgtttatctgctttcagcttccaaaatatagatgccatttctttctttctttytttttttttttttttcttgagacggagtttcgctcttgttgcccaggctgggatgcaatggtgtgatctcggctcattgtaacctccgcctcctgggttcaagccattctcctgcctcagcctcccaagtaggtgggattacaggcatgtgccaccacgcctggctaattttgtattttcagtagagacacggtttctccattgttggccaggctggtctcgaactcctgaactcaggtgatccacccgcctcggcctcccaaagtgctgggattacaggcatgagccaccgcgcccagccagatgccatttctcatatacttgtgtatctttgcaactctctttgtattggtgggcttatgtcttcctttttaacccatcaactggcattttagtggggagggaggagagtgaagaagggagcatttgttcattccttcatgattaactgcaaaacattatttctttaaatagtgccttccccccatttttctagtccctcctttttgaactgttggaagctgattagaacttctggacctgttctccatgtttttcaatgtttcttcctcacattacaaagccttattctatgtggtgcactttcagagaactccttagctgagtcctccaattcacaagttggctcttcagctctgtccatcctgccattgagttttaatttcaacagttatcttttttttttttttttgagacggagtcttgttctgttgcccaggctggagtgcagtggtgtgatctcggctcactgcaagctctgccttccagttcacgccattctcctgcctcagcctcacgagtagctgggactacaggcgcccgccaccacgtctggctaattttttgtatttttagcaaagacagggtttcaccgtgttaaccaggatggtcgcgatctcctgacctcgtgatccgcccgcctcggcttcccaaagtgctgggattacaggcgtgagccaccgtgcctggccaaatttcaacagttatcattttttactttgaagatcactaattgcttcatttagtaacttccagttcttgtttcatgattatactacccacacttacctcttggaagatattcattatacttatttttaaagtcatatcctgataccttattaatttattgggtgtaagttcctccaattttttgactttgtttctctcttatggtgttaggaacttctcaactgtttggtgagcctttttttggggcacagctgtttacagttgatgttatttactagactgtctgctgtcttggctttcacagctcagttggggagagggtgctgccactgctgtcagggttacaccttgtatttattttcttttttaaaaaaattaaattaagttatttgagtttctggggtacatgtgcaggatgtgcaggtttgttacatgggcaaatgtgtgccatgtcataatggtgattatttaaaagttaagaacaaatgctggtgaggttgcggagaaataggaatgcttttacactgttggtgggaatgtaaattagttaaactattgtggaagacagtgtggtgattcctcaaaggtttagaaccagaaataccatttgacccaccaatcccattactgagtatattcccaaaggaatataaatcattctgctataaagatacatacacacatatgttcattgcagcactgttcacaatagcaaagacatggagtcaacccaaatgcccatcaatgatagactggataaagaaactgtggtatatacaccacggaatactatgcagccataaaaaggaacaagatcatgtcctttgcagggacacagatgaagctggaaaccattatcctcagcaaactaactcaggaagagaaaaycaaacatcgcatgttgtcacttgtaagtggaagctcaatagtgagaacatgtggacacagggacgggaacaacacacattggggcctgtcaggagagggcggaggttgcggggagagcattaggaaaaagagcaaatgcattgctgggcataatacctaggcaatgggttgataggtatttattttctttcttttttttttgagatggagtctcgctctgtcgcccatgatggagtgcagtgacgccattcagctcactgcaagctccgcctcctaggttcacgccattctcctgcctcagcctcctgagtagctgggactacaggtgcctgccaccacgcctggctaattttttgtattttttagtagagacgaggtttcaccatgttagccaggatggtctcsatccctgacctcgtgatctgccctccttggccccacaaagtgctgggattacaggcgtgagccaccgcgcccggccgataggtatttgttttccctgaaagttgggagtgggtgggttgggctgcttgtgaggtgtatgggaggcgtgtgtgctgggtgtgacggctccatactccctgtggagtgcttcctgtggttaccacgcctcagggcatgctcttgcttcctcctgagggagaagtcttctatgtattcctgcaggtactgtaggctacagttcccctttccatctaacctagtattgatgaagggcaggatcttggctttgctcgggaaagaattcaagagcaagcyagtgctggaagaaarcaactttactgaggaggcggctgtgtcacagctctgtgaccgctcccggggagcaggactacagcggaggcaatccgagaggacagtgcagggtggtgtgcagccatatttatgcccacttttagtgacatgctaattaaaggggcacgttattcaggaatagctaggaaatgggcagtaacttctgggtgttgctgtggcaatggtacattgtcatggtgctgataggagtgtcttacggtgatgggcagtgagaggttctttcagcccctctactggtttcggtcagttttgttttgtcttttttttttttttttttgagatggactctctccgtcgctccgactggagtgtagtggtgcggtcttggcccactgcaacctccgcctcttggattcaagtgattctcctcsctcagcctcctgagtagctcggattacaggcatgaaccaccacgcctgtctcatttttgtatttttagtagacacagggtttcaccatattggccaggctggtctcgaactcctgacctcaggtgatctgcccacctcggcctcccaaagtgctgggattacaggcgtgagccaccatgcccggccttcagtcagtttcaatctggtctggagacgagtcccacctgcctcctacctcagtatgatttctgtctttcagcatgttctctctccccagtccagcaagcatttctggtttttgagcataattattaatttattaataatatgcttctgttgtttgtgtggttagaatttggtgtagaagggtagactgcagtatctattagttcatcatcttataaccagtattggatattttgttcttcttctccttttttttttttttttgagacagggtctcactctgtcacctaggctggagtgtggtgatgtgatcatagctcactgcagcctcaatctcctggcctcaagtgatcttcctggcttagcctcccaagtagctgaaaccataggcaggcatcaccacgctcagctaattttcttatttttgtagagatggggtcaacctatggttacccaggctggtctccaactcctggactcaagggatccttccgcctcagcctcccaaagtgctgggattacaggcatgagccaccgcacctggccagatattttattttacatcaaatccccttgcgttggtgacggaaaagatttattttaaaacagttttgtcattctcaaattatgaatcaaagaagcaaaaagtagtttaactcatatatcctgcttcaccagtttgttacaaaattaggttacactccttttaatatttaaacaattctgtgcctccaccctgactactagaatatgttcttttccattctccaggatccttcttccgtgatgttygctaacagctctacagtacttactttgggccagacatttttctaagtgctttttacatataataactcataacaactccggaytccttagagaggcttgttaagttttatgggttagcacttcttattatctttggaagaacaaagcctgaaaacctgctcagtcagccagagattcctgttctctttggctgttgttgcttttactcacatatgatatttccggtgaatctcagggtgtcctactatttttctgctagtctactgctaggagagtaggtccccattgaacactggtcaatgagagtatcacatcttcttggacagtgattggttcaaagatggacatatggtccaagatgggctaatcagagctaacgaggctttttctggggctttgatggaaatagaatgaaatctttgtgtttccatggtggctgccaagctggtagactacaggcctgttgactccagtgaccctcttggagaaagcctgtcagagaataaagccaacagacaggaaagcaaattgaggtcacggagagggagcaagagagtgagccttcgtcctgatgatattctttgaaccccctgatgcagccatgcctgaggtcagactaaccctgaccttttatgttataggaaccaataatttccttttatttttattgttctttttttctgtttccctccaacttaggtgagacaagaatgcctattttattttattttggtattttttatttttttgagatggagtttcactcttgttgcccaggctggagtgcagtggtgcaaccttggctcactgcaacctccgcctccctggttcaggtgattcccctgcctcagcctcctgagtagctgggattataggcatgtgctaccctgcccggctaattttgtatttttagtaaagacagggtttcgccatgttggccaggttggtctcgaacacctgacctcaggtgatccacccaccttggcctcccagacagctgggattacaggtgtaagccactgcaccagcctaaaaatgcctatttttaaaagccactttgaattcactttctgttacacgtagacaaaagagtcctgagtaaggccagaggtgaggcagaggtacggtctytaggctggagcacctgggcagctgtagactgtggctaaaaaactactgacttcaaacaatgtaccagcctgtgagtggcgttyttcctggcagtccaggatttgtgcaagtgagtttgcatgtggagtgaatttcttgctatcctcatacctgggttttttttktttttttttttttgagacagagttatgctcttgttgcccaggctagagtgcaatggtggcatctcagctcactgcaacttccacctcccaggttcaaatgattctcctgcctcagcctcccgagtagctgggattacaggcrtgcaccaccatgcctggctaattttttttttttgtatttttagtagagatggggtttctccatgttggtcaggctggtttgaactcccgacctcaggtgatccgcccacctcggcctcccaaagtgctgggattacaggcgtgagccaccgcgcccagccactgggtcctttttgtggggatattttctcgaaattgctgggaccttcaaccctcaggggtgggaagttggcatctcctaggtttttttttcatatttctatgggtgagtcagccaggataaaggtcaatgcatttgagtatgagaagactgcctagtgatggccttatagtttcatgttgactcactatttaatatttcttttaaaatttttcatgtagttggaagtagtcatcccctttttttctggakaattattattattattattattattattttattattattatcttggttcctgcctattaatcttaggagggatagaagacagttgtgttagcattagtctgctttgtgttgctattagggaatacctgaggctgggtaatttataaacaaaagaggtttatttggctcacagttctgcaggctgtgtaagaagcatagtgccagcttctgcttttggtgagggcctcaggaagcttccaatcatgttggaaggcaaagggagagcaggcatgtcatatggcaagagagcaagcaagagagagtgagcaagaaggtatcacaagctttgaaacaaccagatctygtatgaactcattaccactcattacttcaaggatggcaccaagccattcactagggatctgcgcctatgacccaaacacctcccagtaggcccacctccaacactgggggtcacatttcagcatgagatttggaggggccggatattcaaatcatatcgacagttctgtccaccagctcccagaggaggtcctttaaagtcagccaccttgatttggcatctcctattcaacttgtattttcacacggataatcttccaaatttctctatcattatgtagagatcaccctaccactggccagctagtttgtgttaatgtttttttttgaaatggagtctcgctctgtygctcaggctggagtacaatggcgtgatctcggctcactgcaacctccgccttccaggttcaagtgattctcctgcctcagcctcctgagtagccgggattacaggcgcccaccaccacacctggctaatttttgtatttttagcagagacagggtttcaccatgttggccaggctggcctcgaactcctgacctgaggtgatccacccacctcgacctcccaaagtgctgggattacaggcgtgagccaccacgcttggctctagtttgtgttaattttatagtaatatttattatcttttcagtggyttctggtatctggaggtgtttttgcaagcagcagcaatactttttttgggagtgcgtcttgggtggggtttttaaagtctccctttcataaatctactttacagcattaatctgtgaggacttgcagtctccacctaacctcaaaaagtaacatgtaaaatcggtgacatsaagattccactgatgtgtgattcagaaatgtcacaccacccgctcatgccatggtgttatcaacattaaaaaatattctgtgatttattttataaaacaatagctttaaaaaataaactttaaattttagaatggttttagatttacaggaaaattgcaaagatagtacagagaatttatcaccaacgttttgaaatttgtttaaaaatgtttaggtttggggttctctttggggttatttgtggtgaccctgtactcttgtataacggctaagtaaaatatttcaagyagtagctggatctcagtctcctgtaatctgagtacactatatcaagaaactcctctattgaagcagcatttccctcttattatatctatacaactgtggttgctttctggtttatagtgggatacacttctgcacagccagtgaagtgattgatcagtgaaaataggccgttaaggttccacctatcagattttgaggataatatgaggatgcacaatatatgactttgttttatacaaagtatcaatgttagtaaggcttttgcatatgtgtaggatatgtcttacaattggattggaccttctcaatcatcttaaacccaaatggccaaatatgccgtattttgtaacaaaaaatatacagttaaatattttactgtatcttaaattattttgttcttttctttttcataaaatgatataatttgattatctttctaatgttttgtaaagggattttaaatcaagtgtatttgaggtagagctcatgtacaatacaatgtattcatttcaaatgtgcgtttccaagtttcagcaaaygtacacacccatgtatccatcactagggaacattttcatyaccttaaatgttcttttgtgctcataccagtcagtctccctggctccaggaaacagctggtctgctttctgtcactacagatttgtcttttctaaagttgtatataartagaattayatataatatactcttctgtatctggctttatccactcagcatcatgtctttgtaatttattcacttttttgtggctatcagtaattcattacctaaaacaatttcttggctgggcatggtggctcacgcctgtaatcccagcattttgggaggccaaggcgggtggatcacacggtcaggagttcgagaccagcctgaccaacatggtgaaaccccatctctactaaaaatacaaaaattagctgggcatggtggtgcacacctgtaatcccacctactcaggtggctgcacatgtaggctgggtgcggtggctcgtgcctataatcccaacactttgggtggccaaggcaggtggatcacctgaggtcaggagttcgagactagcctggccaacatggtgaaaccccgtctctactaaaaatacaaaaattagccgggcgtggtgacaggcgcctataatctcaggtactcgggaggctgaggcagcagaatcgattgaacccgggaggcagaggttgcattgagctgaggctgagatcgggcaactgcactccagcctggcgacagagccagactctgtctcaaaaaaaaaaaaaagaaagaaacctgcatatgtatccccaaatctaaaataaaaattgaaaaaaaaaaaaagggctgggtgcagtgggtgcagtagttcactcctgtaatcccagtacttttggaggccaaggcttgtgcatcacctgaggtcaggagttcaagaccagcctggccaacatggtgaaactctgtctctactaaaaatacaaaaatgagctgggtgtggtggmgggcgcctgtaatcccagctatctgggaggctgaggcaggagaatcacttgaccctgggaggcagaggttgtggtgagccgagattgtgccactgtactccagcctgggcgacagagtgagattccgtctgaaaaataaataaatgaatgaataaataaataaataaatgtaaaaaaaattttaaatagaaaaaagcttgtgaaattaggatataaagaaaaaattcatacaagtgtaaaatatgtttgtgttttaagctaagcattactacaaatgagtcaaaaagttaaaaagaattaaagagttaaaaagaattaaagagtttataaagtaaaaaaattatagtaagctaaagttaatttattattgaagaaagaagtttttttgttttcttttgagacagagtctcactctgtcacccaggctggagtgcagtggcgcaatgcgcgatcttgactcactgcaatctccgcctcccgggttcaagtgattctcctgcctcagcctctgagtagctgggattacaggcgsgcaccaccacgcctggctacattttgtatttttagtagagacggggtttcagcatgttagtcaggttggtctcgagctcctgacctcgtgatcttcccgccttgggctcccaaagtgctgggattacggtgtgagccaccgtgcctggccaaaagaagtttttaaagataaatttagtgtaggggagatgtacaatgtttataaagtctacaggagtgtccagcaatgccctgggtcttcacgttccctcaccactcactcactgacccacctgcagcaacttccagttctgcaagttccattcatggtcagtgccctgtacaggtatgccattttgaatctttaataccatacttttactgtacattttctgtgttgagatacacaaatacttacaattgtgttgcagttgcctacaatattcagtatagtaacgtgttgtgcaggttgtttgagcaatggactatactatatagtctaggtgtgtagtgggttataccgtctaggtttaagtgcactccatgatgtatgcacaacactgaaattggctagtgatgcatttctcagagtgatgtacatctcagaatgtatccctgtggttaagtgatgtgtgactgtatttaaaaaaggctgttctacttccttgtggcctctgtgattgctgatgagaaatctgctgtcactcaaattatttcttcctgaaggtataatgttgtctgtctctcccattgttttcagaaatgttttctttgtctttagttttcagaaatttgattatgatgtgtctttggcatagatttctttgagtttactctgtttggggtttgctaaggtaggtttagatcttttgccaaatttggggacatttcatctatcatttttttgaatattttttcagctccaccccctgtctcctttccttttgtgactaaagtgatgtgattgctggatcctctgttgtagcccctcaggtccctgagattctttttattttattttattttgtttttctgcccattttctttctgttgttcagattgggcaatttctattctgtcttgcatttcgttaatttttcctctgtttcccccattcgctagtaagcccatatattgagctttttatcttggttwttctatttttcagttctaaaatttccatttggttctttttaaattttttatttctcagctgatatttttcattttctatttgtttcaagtgtgtttataattgctcaytgaaacctttttttttttttttttttttttttgagacaaagtttcggcctgtcacccagactggagtgcaatagtgtaatctcagctcactgaaaccttcgcctccctagttcaagcgattctgctgcctcagcctcctgtgtagctgggattacaagcgtgcaccatcatgstcggctaatttttttgtacttttagtagagatggggcttcaccatgttggccaggctggtcttgaactcctgacctcaagtgatctgcccccttcagcctcccaaaatgctgggattacaggtgtaagccaccacgcctggcccagcaggggaattttaagtgtgccttgtcccagccaggtaagggtagaaatccaggctgccactcagcatttgctaatgggatggcaacagggttgtggttctttccatgatgtttggcaaggatagtgtgatttttgtctaaaagttttctgtcttgccaaattagtcctttcctggtcttttggccagagagaccaggctttcttggggattttattttatttttttcgtttgcgcccattggtctttccagtggtttctccagcatccagttccagatatatgaggaagaaaagaaaacccagagaactcactgccatgccattcccaaggtcccaaggcttccaattgttctgtcttctctccaccttcaagagccttttagtgtttgttttatctataatatccatggttttagctatacttagtgggaagtataggaagaagtgcctccatttaatcttaaattcattcctttttatagctgagcaatatttcattgtatagaaatgtcacaatttgatcatccgtttcatcaacctgttgacaaacatttggattgtttccagcttttggctttaggaaacagtgckgctttgaacgtaatttaatgctgttatgaatatatgttgtcgggtctttgtgtggactgttttcacttctcttgggtaaacacctaggagtggaattgctgagtcatgtggtaattgtgtgtgtaactttatgagaaattgtcaaactgtttttcacaggagttgtaccattttactttcctaccagcaatgttccagttgctctacaacctcaccaatgtttggttttaatagtcttttaagttttagtcattctagttttaatttgcgtttctctggtgactgatgatgttgaacatcttttcatgtacgtatttgctattcatatagcttattcagtgaagtgtctgttaacaaatttggcctctttttattgggtcgccttcttgttatgaagttgtagaagttctttatatattctgaatacaatctttcattagatacgtgttttacaaatctttttctctcagtctgtgccttgtgtttttgtagtctttttaaaaagaaagatttgttggacttgaaattttcattgttttaactgtgtcttttgaagacaacaagttttaaattttgatgaagtttgttctttttttcttttgttgcttgtatttttgtgtcttatttaagaaaactttgcttcagccaaagtcacaacattactctcctatgttttttgtctaaaagttttatagctttgggaagccgaggtgggcagatcacgaggttgggagtttgagaccagcctggccaacatgrtgaaacccccgtctctactaaaaatacaaaaattagctgggcatgatggcgggtgcctgtaatcctagctactcgggaggctgaggcaggagaatcacttgaacccaggaggcagaggttgcagtgagccgagatcacaccactgcactccagcctgggcgagagggtgagactctgtctcagaaaaaaacaaaaaagttttatagcttcaattcatatactgaggtttattatttattttgaattatttttatatggcgtgagataaagttgagctctattgttttgcctatggatatctgattattccagcaccttttgcgaagattatcctctattatcttgatacctttgttgaaaatcaattaattatatacatgtaggtctatttctggactctgtcccattgatctatatgtctatcctgatgccaacactcttgctaataatatatattaccgtttcatatattaatatctattactgagctagctttatagttagctaagtcttgaaagtcagatagtatcagtcttccaactttgttcttatttttctagattgttttggatcttctagatattttgcttttctatttaaacttgaaattctgcttgtctccttctataaaatagctgtctgaggttctgatttttattgatgcctaaatcagtctaggaagaattgatgtctttttttttttttttttttgagatggagtctcgctctgttgcccaggctagagtgcaatggtgtgatctcagctcactgcaacctccacctcctgggttcaagcaactctcccgcctcagcctgtcaagaagtggattacaggcacccgccaacatgcctggctaatttttgtatttttgtagagacagggtttcaccatgttggctaggctggtcttgaactcctgatctcaggtgatccgcccgcctcggcctcccaaagtgctgggattacaggcatgagccaccacgcctggctgaaaattggtatctcaactatactgagtcttctgctccatgggcatggtgtacttctttattatttatttatgtgtcaacgtctctcagtattctgtagaatttcaattttcaattttggtcatttcttgtgactttgaaaccagttttattttctttctatcttcctctctctatccctctatccttcttttgccttcttccttctcttcctctttccctcctttctatagttttttattctttttttccttttaaaactcagccatatagtacatatcttgaatccttgttgacttttcatcgatgtattacaacttaaaatgcattctttagacaaatacatttggcaaaccttaaaatgacgttaggcagcggttgcagccaagcacgcagcactttgtgtggagaagctgttgtgcgtagagtagttgttgagagcgcagaccatggatccagaccacccgtgtttgcaattctgtctccgttattactagatgtgtcatcttgggaaagttatttcatctttgtgcctcagttgcttcatttgtaaattgtgaagaaaagtacctaccctgaatgatttttgcgaaaattaaaggtcaatacaagtgaaatgatcggaatagtaactagtaagcactggtttagtgtatgataataactactattattatgacccactgtctactgggaaaagaagccttgcagtgaaaacacaaataaaatgtgtaagaatcctgactggcatggccaggtgcggtggctcatgcctgtaatcccagcactttgggaggccgaggcgggtggatcacctgaggtcgggagtttgagaccagcctgaccaacatggagaaaccccgtctgtactaaaaatacaaaattagccgggcgtggtagtgggcgcctgtaatcccagctactcgggaggctgaggcaggagaatcacttgaacctgggaggcggaggttgtggtgagctgagattgctccattgcactccagcctgggcaacaagagcaaaactctatytcaaaaaaaaaaaaaaaaaaaaaaaaaaaaagaatcctgactgaagcctaggagcacagagattggaagagtcaggggagttttcaatgagaagttaatactgaagtctttagactacttttattcaggtatgattgatatgaaaagctattcctatttaattatcacatatcaatgaatttgcagttaaatatatgcctgtgaaaccaacactaccatcaaacccatcgtcatctcccaaagtttcctcctgtccccttctgtgataatgatgatgatgatgatgatgatgtgtggctcttttttttttttggcaagaacacttaccataaaatctactcttttagcaattttaagtacaaaatacagcatcgttagctacaggcggtatgccatataatagatttccagaacttatttatcttgcataattgaagcttcgtactctgtaattaccacttcctcattttcccctccctgcatcccttgttttttttttttttttttttttttttttttttgaaacaaagtctcactctgttgcccaagctggagtacaatggcatgatctcagcttactgcaacctctgcctcctgggttcaagcgattctcctgcctcggcttcctgagtagctgggactacaggcacccgccaccatgcccagctaatttttgtgtttttactagagacggggtttcaccatgttggccaggctggtctcgaactcctgacctcaggtaatctgcccacctcgtcttcccaaagtgctgggattacaggcgtgagccaccgcgcctgaccgacatttgttatttttgaatttttgataatactcatgctaacaggtatgagattatgtctcactgtgattttgatttgcatttccttgatgatgactgatgttcaacacctttttatatacctgttgggcatttgtatgtctcctttggaaaaatgtttattcaggtattttgcccactttaaacatcaggtttttttttttttttttgctgttgagttgtatgagttccttatacatttggaatattaaccccttatcagatacatggtatgcaaatgttttctcccattctgtggttgccttttcattttgttgattgttttctttgctgtgtagaaactttttagtttgatataattctatttatttttgctgttgttgcttgtgcttttggtaccatatccaaaaatggatatggattttgatggaccccccaaattattgtcaaaaccaatgtcatagagctttcctgtatgttttcttctaacatttttatgatttcaggtcttacatttaagtctttaatccattttgagttgacttttgtgtatgttataaataaggtctaatttcatttttttaatgtttatgttcagctcttttgtttttgctcacaatttctttagatattagaagtcttttgtagctcaatacaagttttaggatttcttttttctatttcagtgaaaaatgccattggaattttgaaaggggttgcagcgaatctttagatcactttgggtagtagagacattttgataatattgatttttcctattcatggacatgggattttgtggaataggtttactgtgcactgattaccaacttccctgagtccagtaagactgaacacacttatacgcagcaaattaaatatagtggatttattacctacagataggcagcaagggacaacagaaacccagtgttcattgcaagcattcccggagtctctggaaaactgcttgtggtggatggagtgtcatatgtgcatgctccacctgcattgcagctgagggacctcctcaaaaaaagcagcctgccctggcttttttttttttttttttttggagacagagtctcactctgttgcccagactggagtgcagtggcatgatcttggctcagtgcaacctccgcctcctgggttcaagggattctcctgcctcagcctcctgtatagctgggactacatgagtgtgccatcaggcctggttaatttttgtatttttagtaaagatggggtttcgccctgttgcccaggctggtctcaaactcctggcctcccaaagtgctgggattacaggtatgagccactgcacctggctggcttttttttaataccctggggtatgtgacatactgggctaaatcactgaaggacatcttatttctaggggagactggaatagagcctgggctattctggccaactccttatctcaggatggcgaattcccagcacattttatagttattcttgggaactacaagcaagaaaggggaagaactaagtcagtgcaagtctacctcctccctaaataactgtcctgcagatatctttccatttatttgtgactttccaatatatttcattaatgttttatagttttcagtgtataggtctttcacctccttatttaagtgtattcctaagtattttattcttcctgatgttattgtagatggaattgttatcttaatttcttttttggatagttcgttgtcagggtrtagaaatgctactgatactgtaggttggtttttgtatcctgcaactttactgaattcatttattagttttagcagtttttttggtggaatctttagggttttctacatataasatcatgttagcaaatgagacaatttaacttcttccttttctatttggatgccatttcattctttttcttgcctaattgctctggctaggccttctagtactatgttgaatagaagtggtgagaatggatatccttgtcttgttcctggtcttagaggaaaacttgactttcactgttgagtatgatgctagctgtgggcttgtcatgtatggccttcttatgttgagttacattgttcagtacttaatttgtaaaaagattttatcatgaaaagatgctaagttttgtcagatgcttttctgtatctattgagatgatcatttttatccttcattctgttactgtaatatggatcacatttattgatttgtgtattttgaaccattttcgcatcccaggaataaatctaacttgatcatggtgtattattcttttaatggattgttgaattttgtttgctagtattttgttgaggattcttgcatttgtgtttatcagggatattgtctygtatttttcttttcttgtagtgttcttatctggctttgggatcagggtaatgctggtcttgtagaaacagtttagaagtgttccctcctctttaatttttggaaaaaactgagaaagattggcattaattctttttaaaggtttgtagaattcaccagtgaagccatctagtctttgttagtgctctgttcagattttgtatttctcctgacttagtttttgtaggttgtaagttctgagaatttatccatttttttatgctacccaatttgttggtgtataattgctcacagtaacctcttctgatcctttgtattttcatggtatcagttggaatgactcatccttcatatataattttatttatatctcatctctttcttagtttagctaaaggtttgtcaattttgtgtttttcaaaaacccaactctttgtttcattgatttctctttattatttttctagtctctatttcatttatttctggtctaaattttattattccttttgctaactttgggctttgttcttatttttgtatttctttggggtgtaactttaggttgtttatgtgagawcttttcttttattaacgtaatcatttgttgctataaacttccctccaataactgcttttgctgcatcccatacatcccattttggtttttgtttgtttgtttgtttgtctcaagatatttttgtctcttcttttaatttcttctttgacccattggtttttcaggagtgtgttgcttaatttctgcatatttgtgagttttccaattttcctcctattattcctagtttcatttcattgtgattggaaaagatatttcatatgatttcaatcttcgtaaatttgttaagacttattttgttgcttaacatgtgatctatcctggagaatgttccatgtgggcttaagaagaatgtgtattttgcttctgttggatagaatgtcacgtatatgttcattggatctgtttggtatctagtgtttaattccactgtttccttatttattttctgtctggatgatccaaccattgttgagtgggggtattgatttcttctattatgtattgctgttttatgtcttcctgatgaattgacccttttgttagtatatataatgaccttctttgtctcttatgacagtttttgacctgaagtctattttgtcacatgtaagtatagccacctttgctctctttggttatcatttttatgggatgtgtttttcatccattcactttcaggctatttgtgtccttaaatctaaagtgagtctcttgtagacagtatatagttgggtcttatttttaaaagtccatttattgacccggtgcagtggctcaggcctgtaatcccagcactttgggaggccaaggcaggtggatcaccaggtcaggagttcaacaccagcctggccaagatggtgaaaccccatctctactaaaaatacaaaaattagctgggcatggtggtgggtgcctgtaatcccagctactcgggaggctgaggcagagaattgcttgaacctgggaggtggaggttgcagtgagctgagatcaggccactgcactccagcctgggtgagacagcgagactccatctcaaaaaaaaaaaaaaaaaaaattccgtttatccactgtatgcctcttaatgagagaatttagtctatatacatttaaagtaataattgataggtaaggacttactattgctattttgttaattgtagttcctttcttcctctctcgttgtcttcctttgtggctttattattattattgtttgtggtggtatgctttgattcttttctttttatcttttgtgtatctactacaggattttttttgtgattaccacgaggcttacataaaacatcttgtagttgtaatagtctattttaagctgataacaacttaatttttattacatacaaagactatatacttttactcctccccccacattttatattatttatatcacaatttacagctttttatattgtgtatcgaactatataccatcatcatggtattagagaattgtgagtttgactatatacttacctttatcagtgagtgtatgttttcatgttgctgatacatattcctttcatttcaacttgaaggtctccctttcatatttcttgtaaggcaagtccaggggtgatgaacttcctcagttttggtttgtctgggaaggtctttatctttctttcctttttgaaagatggctttgctgagtatgtttttggttggcagttttttttcttccagcactttgagtatatcattccactctatcttggtctgcagggtttttggtgagaaacccactgataatcttgtggaggtttctttgtatgtgttgagttgtttttcttttgctgctttaaaaattctctggtaaaaggaatttgaggagataaaaaataattaaaacaaaacaaaaggaagaaaattctttctttgtctttgatttttgactatttgattataatgtgtcttggtgaagacctctttattctcaatgtatatggaattctttgggcttaatggatctgagtgttttttttttctctttacagatttggaaagttttctgtcattatattttwtttatttatttatttatttwtttattattattatactttaagttttagggtacatgtgcacaatgtgcgggttagttacatatgtatacatgtgccatgctggtgcgctgcacccactaactcgtcatctagcattaggtatatctcccaatgctatccctcccccctccccccaacccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcrtcattttttatggctgcatagtattccgtggtgtatatgtgccattttcttaatccagtctatcattgttggacatttgggttggttccaagtctttgctattgtgaatagtgccgccataaacatacgtgtgcatgtgtcttcatagcagcatgatttatagtcctttgggtatatacccagtaatgggatggctgggtcaaatggtatttctagttctagatccctgaggaatcgccacactgacttccacagtggttgaaatagtttacagtcccaccaacagtgtaaaagtgttcctatttctccacatyctctccagcacctgttgtttcctgactttttaatgattgccattctaactgatgtgagatggtatctcattgtggttttgatttgcatttctctgatggccagtgatggtgagcattttttcatgtgttttttggctgcataaatatcttcttttgagaagtgtctgttcatgtccttcaataagctttctttccctttctctttctctggtccttttgggatttctataatatttatattagtttgcttgatgttttcccataagtccagcagagttgagccagctgctaagatccatgcctgttgttaatgttcatgttctctctgcagcatttaatgtgggccatgcacagtggtgtgttgggccccatacatggtggggtggggcatgcaggttgcatagactcgttgggtggagggtcctcacgtgagtcatctggtgggatttgtgggcaagtctcctgctggagtctgtgagctaagtggcagaatctgtggttggttgttgaaaccacatgctggttgctgtgcagtccattcccttctccctgttcctagatgatcagtcatgctgatcatctgtattctgggcagggagacagaagtgagcctcccgggcaatgttcttcttgctgatcatctgtattctgtattcagtgttcttcatgctcatcatctgtattctgtattcagtgttcttcatgctgatcatctgtattctgggcagggagacagaagtgagcctcctgggcaatgttattcaagtctggggaagccaggtgttgactatgcttttaccttcccctgtggagagattgaaagccaaaggagcttctctcagcacaagctgtgcctccttgggggagggctgatgcaggtaaagtggaactgcacttcttacccttttcgatgcttccactcttgggttgatttgctccagtggggtgctggaacctcagccagactccaggcctcccacataatgattctcatctgtcactgcctgccttaactggtgtttctatggggggatgagagctggaacatcctattctgccatgttactgatttcactcctggactgaattttgaagaatgaacagaactcactactagatgtatgaagagaaaatcgcatcctaaacagagggaactccaggtacaaaggcagagaaatttaatatatcaaggtgcttgtgatggacagttaagttttttgtgggacttggatgtaggtttcatggaaggagacagtgggagtatgtaattggaaagttagtcaggggccagattaccatgggctcatatgtacagtgaaaactataaaagaaaatggaaaactcgtgatgactctgcttattgaactttaccagcgaagacttttctttctatctgagcaggattttagacatggattcatcaatgcgcagttgcagtactgtacatgggagaagtcaggagtgatagttgagctaagagatagagacatccgtagaggtatgtaccgtcacagtttgtgagacaggcaataagaggagttcattcaactaattcattcaactaatatttgctaagtatctaccacaaactcccaaacttctagaaaytgaagacacagcagtaaacaaagagacaaaaatcccactcttattctgttacacaccatatatttactatatatatatatattctggagtatttaaaagcaaatcccagacatcatgtcatttcacctttgaatattttagtatatgtctctaactgataaggactttaaaaatacatagccttcatacataactaccatatcatttatcatatcataatatataataccatgatattatttaatagttattatgcatttatattttcacttatgtttaaaaatgtctttttaaaattagttactttgggccaggtgtggtggctcacacctgtgatcccagccctttgggaggcccaggcaggtggatcacttgagggccaggagtttgcatccagcctggtcaacatagtgaaaccccatctgtactaaaaatacaaaaattagccggtcgtgttggcgtgcacttgtagtcccagctactcgtgaggctgaggcaggagaatcgcttgaacccgggaggcggaggttgcagtgagcagagagtgcgccatttgcactccatcctgggcgacagagcgactctgtatcaatccatcaatcaatcaatcaatcagtcaatcaaattaggtgccttgaatccaggttcaaatccagggccacatactgtatttggtctcttgtctctattaaaatctaacagttccctagccttcctttggtatccttttatgtctcttaaatttttttttttttttttttttgagctggagtctcacgctggagtgcagtggcacaatctcagctcactgcaagctccgcctcccgggttcacgccattctcctgcctcagcctcccaggtagctgggactacaggtgcccaccaccacgcccagctaattttttgtatttttagtacagatgggatttcaccgtgttggccaggatggtctcgatctcctgacctcgtgatccacctgccttggcttcccaaagtgctgggattacaggcgtgagccacygcacctggccttcaaatttttttattttaaaattatcatacagtaaaattagctttttggtatacagttctacacattttaacacctgtatagattcatgtaaccacgaccacggtgagtatacacaacagttttttcacctgtgtgtgtggggtaggaggggatttggtggttgatcctctatgacacactgttaggcacccccttgattgttgctctatggctcacctttccacattgaacctcccagggccgagcctttccaggttctgcgggggtttagtggctcacttgccattgcgttattcttcttcagggtaaggaagattgaattgcccaagcttccacatcgtattgtggaattcagactcgaacccaggttttccatcttcaaacttctgtgtttaaaatttattgtataaaactagaaaaaaccctgagcacataagagtaccagaagaaccaatttcagaatatagatgcaggattcctaaataaaacagtaaccaactgaatctagcacaaattaatgaaaaatatgtgcatggtagataactcaatacataaatatgaagtaaaatgaggtaccatttttgtgcagaggttactaacttggcagagattttaagagaaatactaccaactataggcaatggatggagaaaataggcattcttatatgtttctggtgtgaaaccaaattggtaccacctttcaaggggtcaattttactatatataacaaaactcttaatattccatgcaacttttaatccagaagttccacctctaggaatttattttcaggaagcaatcatgatattcacaaaaatttagctatgaggatattcatttcagtgttatttataatattgaaacattaataacaatgtatctgtccactaatactgacttcataaaataaaataccagacacaaaataatgttgaagaataattttaataacatgaacatatgataatgttacattcagtgaaatacacagtttcaaaacagtatttttttgtattacaagggattctttctgttgcaagtaatgaaaactcaactaaaaatggcttaagagaaagaaaaggaagatattgattcataatactggaaagtccagggccacagtgccttcaggtaaggctgcatccagcctcatcatcagtaatctgtttccgtctcttggtttggctttactttcagatagaccctctaaaagcattgttaaagagagctaccagcagctctgggattgtgctttaccaacttgataacctaacaggacaagagaatttcctttcaaatcattctagcaaaaatcctagggctgaatctcattggccaggtctggctcatgtactcctctctttaactgagaggaggtgtgagtcccatttgaactatgtcataataatgatagctgaaatttattgaatattgattatgtgtcagattatgagtctgagtcccatgatttgatgtgtaactttgagcaatttaaccttcctaagccagaaaagaacacataatctgtgtcctctgtattatttcactaaattctcttggcaatcctagtgaaacagattctgtgtccatcctcattttatggatgaagaaactgaagctcaggcaggttaattattgtcttagtccatttagcattgctataaaggaatacctgaggctgggtaatttctaaagaaaagaggccaatttggcttatgggtctttggctttacaagaagcatggcactggcatctgcatcaggtgagggcctcaggctgcttctactaatggtggaaagtgaaggggagccagcgtgtgtggagatcacatggcgagagaggaagyaaggtgtggaggcggtgccaggctctttttaacaatcagttctcccggtaatgaacagaggaagaacttacccttgagcgaaggcactaatttattgatgagggacccacccccatgacccacatacctcccactgggcccgaccttcaacattagggatcaaatttcaatatgggatttgaaggagacaaacatccaaactaaagcaagtttattatttaagttgaaagaattagcaaatgatgcattcactcacatggattgagaatatgggaggcagcagttcttcaaagaagaatcagatgctgcttcagacattgactatgaagcccaaaacaaaagtaaagaaaaacaaaacaaccccatagaataaacaagcatacaaaaactttaaaagtctactattaatatacttggaaaggtacagaatagattgcacccatgttataagaacagaataagatcctgataattttaagagaagaaaaaagggcccttaaaaattaaagcaagagagtagacctgaaaaatgtaacagaagagttggacgataaacttgaggaaatcgcccaagaagacacggagatgaacaatagaagagaaaagatacagaagattagagattaagactggcgtgttcaggccgggtgcggtggctcacgcctgtaatcccagcactttggaaggccgagacgggcggatcacgaggttaggagatygagaccatcctggctaacayggtgaaaccctgtctctactaaaaatacaaaaaaaattagctgggcgtggtggcgggcacctgtggtcccagctactcgggaggctgaggcaggagaatggtgtgaacctgggaggcggagctggcagtgagccgagatcgcgccactgcactctagcctgggcgacagagggagactctgtctcaaaaaaaaaaaaaaacaaaaaaaaacyggtgtgttcaatatttgaataattggtgctcaagagagaaaaagaatatgtaggagaggcagtcatcaataaaaccatacagaaaagtttactcaaaactcaagaaggacatgagtttccagattgaaagggttcttcaagtgcccagagaaacggatgaaaaaagacctgtcaaggcacgttatcatggagtttcagaacaaagtccaagagatcttaaaagcttagagagcaagggagagggtacatacgaagatcaaatataaaggatcgggaatcagctttggctttgccggcttcaataaacaatggtagaggcaagagacaccagagcaatgcttttcaaaattcttaagaaaaactattcccagcctagaattctgcacccagctaaattatcaatcaaatatgagtgtaaaataagggcattttcagatatgcaagatttacttcccatgcgttctttcttaaggggctactggaggctgtgcttcttgaatgagaggacaagccaagaaagaacatatgggacacaacaggtaggaatcaaacacaggagagtggtgaagggactctagggtaagggtgatgggagagtccagaatgacagttatgcactaggtgcagaaggaaacaagtccagcctgaagaagtgggacaccaggactccagggagagacacactgagggcttccatcaccaccrtccccactgccatcatgctaacttttaaatcaaggactcaatacccagagtctggcccagatttttcctttgtactttctttattttgaccacatgctgataaagttcctgctcattcctcgagtgctctgatgcttgatctactgtgggtgtcatccagaaatgttctgccttgacctcttctgggaagtggaggagaagtcgtgatgagcagaatatacacaacagccatctccttctgactatatcctggccaaacatctaaaactcggcccattctccagcgttaccgtatgtctcacctgtgctgagcccagtgattcccagtgttactcatcatcttactcaatgattttcccataaaaagctcttataaatgcttagggaagctgaagccagacaatgaccgagaggctgttcagtttatcttctcctcctgcgccttcctcaaacagtggtaacatcaccctttccttattcttctagattggtgcttgctgctcagtgtttcaaaactaagtcrtgttgtttagggatgtatatattggtggaaaactgtaaaggaaacaggagaatgattaacataagtcatcatcgtggttatcactgcggatggagaagagaccacaatttgggagggataagcagaggcttctaaaggactggttatgttttataccttaaactgggtagatgattatttaccttattattatattaggttggtgcaaaagtaattgtggcgtttgccattacttttaaatatttctgtcgagcaaattttatccatccttctatttgtatgatgcattttacaacaaaccatttaaaaaatcaggtgctggccgggcgcggtggctcatgcctataatcccggcactttgggaggccaaggagggcggatcacgaggtcaggagatcgagaccatcctggctaacatggtgaaaccccatctctactaaaaatacaaaaaattagccgggcttggtggtgggcacctgtagtccccagctacccaggaggctgaggcaggaaaattgcttgaacccgggaggcagagcttgcagtgaggcaagatcacgccactgcactccagcctgggcatcagagcgagactctgtctcaaaaaaaaatcaggtgctgttactcaataaaaggggaagtcaatgaaacaattagaaataagagatatttattctgaatctttggataacaaaaatacctgcaaagagaaaggataagaagggacaatttatttatttaatttatttttttgagacggagtcttgctctgtcacccaggctggagtgcaatggcgcgatcttggctcactgcaacctctgcctcccaggttcaagcaattctcctgcctcagcctcccaagtagctgggattacaggcgcctgtcaccacgcctggctaatttttgtgtttttagtagagctgggggtttcaccgtgttggccagaatggtctccatctcttgacctcgtgatccgcccgccttggcttcccaaagtgctgagattacaggcgtgagccactgcgcccggccctacattttattttttttaaagtgaaagcaaatttattaagaaagtgaaggaataaaagaatggctactccataggcagagcagccaggaagagacattttttttctctggctctttttttgctgtatctcaaaaagagtaggagttgttttgagcctacgcacggaaggaaccggaatagtaaaacttagcatttcctacaggcatctctgtgtgtctgtctgctctgttctctattagctctacagacactcctctgtttatgatggggctgtatcctgataaacccattgtaagttgaaaatatcgttaagtcaaaaatgcatgtaatacacctaacctagtctaaggtagcttagcctagcctaccttaartgtgctcagaacacttacattagcctcaagttggcaaaatgatctaacgcacagcccattttataataaagtgttgcctatctcatgtaatttattgaatattatgctgaaagtgaaaaacagaatggttgtatgggtatttgaggtacagtttctgctgaatgtgtattgcttttgcaccatcctaaagttgaaaaacaccaagttgaaccatcgtgggttggggattgtctgtataacgaatctccccaaaatgtattgtcttaaaataacaaccggccgggtgcggtggctcacgcctgtaatctcagcactttgggaggcgctgaggcgggcggatcacgaggtcaggagatcgagaccatcctggctaacacggtgagaccccgtctctactaaaaatacaaaaaattagccgggcgtggtggcaggcgcctgtagtcccagctaccgggaggctgaggcaggagaatggcgtgaacctgggaggcggagcttgcaaagtgagccgagatcgcgccactgcactccagcctgggcgacagagtgagactccaaaaaagaaaacagaaacaaacaaacaaaaaaaccaaccactacttatttgttggtttacaatgctgaactttgggaagggattgacaggaacagcttggttttgtttcatgtggtgttggctgggccgccttgcctggggctggagggtccgggtggtttcactcacctgtgtggctcagcagaggtgtctagaacagcaaaagactggccagaccaatctctccagcaggcagtcggtcttcttcttattatttttttattatactttaagttctggggtacatgtgcagaacgtgcagttttgttacataggtatacacgtgccatggtggtttgctgcacccatcaaccggtcacctacattaggtatttctcctaatgctatccctcccctagccccccaccccccaacaggccccagtgtgtgatgttcccctccctgtgtccatgtgttctcattgttcagctccccgttatgagtgagaacatgcggtgtttggttttctgttcctgtgttactttgctgagaatgatggtttctagctycatccatgtccctgcaaaggacatgaaatcatccttttttatggctgcatactattccatggtgtatatgtgccacattttctttatccagtctatcattgatggacatttgggttggttccaagtcattactattgtgamtagtgctgcaatagacataggtgtgcatgtgtctttatagtagaatgatttataatcctttggggtatatacccagtaatgggattgctgagtcaaatggtatttctggttctggatccttaaggaattgccacattgtcttccacaatgattgaactaattacactcccaccaacagtgtaaaagtgttcctgtttctccacatcctctccagcatctgttgtttcctgggcagttggtcttctttatgcagtggctcagggctccaagagaaggaaagtgcaagatgtcaagcctcttcgtggtcaagaactggcaccgtgtcacctctgcattctgttggtcaaagtaagtcacaagaccagtctagaacgcagggagacatagatttcatctcatgatgggagaattgcttactagatgagaagcatctgtggcaactatttttgcaaacaatttgccatatcttttcttccacctcataattttggtgtgtacgtaattttaatttgctatagccgaactccacatgtttttctgtcacctccaactttattgctaagtagcaaattctttttgtttaggtttaaattcctaagaacagttggtttaattcatctctttacctcgtgtcagtggtcggaggtcagaggccatcctattttttttttttcctgagtttttattttgaaaagccttagggtctgggcccagtggctcatgcctgtaatcccaacactttgggaggccaaggcgggtggatcacgaggtcaggagttcaagaccagcctggccaacatggtgaaaccccgtctctactaaaaatacaaaaattagccgggtgcagtgtcaggtgcctgtaatcccagctacttgggaggctgaggcaggagaatcgcttgaaccctgcgggtagaagttgcaatgagccgagatcgtgccactgtactctagcctgggcaacagagtaagactccatctaaaaaaaaaaaaaatgcctttgggatagttgtaagaacagtaccatgaatgcctatagacgcttcacttagattcaccagttttaacgttggccacatttgtttgatcacacattctttctccaagcatatatatatggagttggttgaagacatcatgacattttacctttaaatactttagcatatatctgctgagaacaagggcattctcttacataaccacaaccaaattaccacactcaagaaatttaacatttctatacaactatcatctagtgtactaactatattcatatttccacaattgccccgtcgtgtcctttatataccattcttttttgatccaatacttaatctgtgatcacacatcaaaattagttgccatgtccccctaatattctgtttttttgaaagacaggaggatctcactcccttgcccagataggaatgcagtggcttgatcatggctcattgcagccttgacctcctgggttcaagtgatcctcccgcctcattttttgatttttcttgtatatagagatggggtctcactatgttgcccgggctggtcttgaattcctgggctcaagtgatcctcctgcctctgcctcccaaagtgttgggattacaggcgtgagcctccctaatgttatttaatttagataagttctctgtcctcttttgtcttttaggacattgacattttggagagtctaggctggttgtttagtacaatgtctttcaatatggatttgcctgattgtttcctcatgattagattcagcttaaacatttttagcaagactacgccataggtgatgtgtggccagtcacttcaggggctactcttagacaattgttggccagttgcctgtgctttgctcccatcccaccccacctcccatcatttcctttgcctgaagtcttttgggtaagtttggccacagaaagatgatagcagatgactggagggtgggaggaggggaaagcctaggatattgccccctatttctctgttttccgtgacagcttttcttgtgtgtctccaattcctcccaaccaaacgctctctctgtggttccagctcctgcgggggaaataccctctccttagttctggctctttctgtttggcctcaacttctgtgctctgatgaaactacctcatcccgttgaccctttagttccagggtggcagttgcttttggctgttgccgacctctcagtggcctcatcatctcatcctgtgtttggcttctcagcttttccatttcctgtgtaaccaatttccttattaacgttcctctttatttggtttgaaaagtctagggtggtgtctgttttcttgactaaaccttgactaatataggtagggttttcatcgtcagtgtgatttgtgtgacttgtggaatggggccacgtggcacaaaataaggcagcattagcaacaggagttatatgagtggaaattcctttataaggagaaataagcagtgtaggcctcctccctggttacacaaaaggaaatatacaaaaaagaaacatctcaaggtggtagaattttgtatggtttttatattatttttcttcttttctgttcatccaaattacctaaatttttttttacaatggatgtagatacttttgacatgaagaaaaaattgccatatttgtaaacaaatgaaggagaatggtgtacaggtgtacaagttgtatacaataaaatattatcagaggatacaaaagtggctaacccccatcaaaagacaaaagacaaaattacaacaaatttagagaccttaattggtttttatttgccattctagagtaaggtaacacctcatcctacaaaatagaatgagtgctctgagttgctgagcagaggtggtggtaggcagaaaatggctgaggaaagcagaaatagaaaataaaaggtagactggttgtttcagagttactttcctcgtaaagattaaagcagagtggacttccttattataccagctaaaattgggttgtttggggatttggctattatgtctcactctcctgatttcttggaaggtcagataaacaacttagttttgtcttgatgatgtgggcctgtagcatgagtgactccattttggtttggtctgttggacttagtataggagctcagtcaaaaccaatggcctccgatacattttatttaatacccccacaaaagcatttggctcccaaaccttttaaatagaaaaaataagaaggtcattcagtgtaagatgataaaaagagtaacaagagactactcttatgaaatttcttcatataaaatgcttatactttttggtatgtctgatatagtttataatctaataatttaaaaaaatttcacaaaaaacaaaatcgtaaaatgggaaatggtttagttgttgaggttttcacgtgatcactctagctcacaaatgggcaagtctccagtgatcaagaaaaaactacactggtacttatggaaatgtttacatttaataggtgacataacagtgattgtttataacaattaaaggcacttttttcaacgtttaattacttagctatccttaggaattttggaaagctcattagaaactgaagaatttaaaggggtaccaaagtagctgaagcatgagttagaattcatagaaaatgagtaaaaaagactaggaaatattagtgaaaagatcaaatagactgcaaggttacaataaaactgcagtaaccaagacaaacagaaataatcagagataaaatggattactggaaatgagaagtgcaaaaatgtagaggtactcagtaagtatcagatttgaaaaattaacaagaagttttcacagaagagcctaacataggaaatatgtactgtaagtgagggcatgcgaaaacctgcttccaccctacgtataatccaatataatctggtacaaaatgtcttgaagagtcaaaagaaggtagtttcctaggtgtttaactgtttcaatggctcccrtcagtaagtcatagctagcaatggacttctgacttaaacctgctcatacctgctgctatggtttgaatgtctcctccaaaacccttattgaaatttaattgccatcatgatagtattaagagatgggacctttaaagggtaattaggtcatgagggcttggcccttgtgaatagattgacgttatcatgggagtggcttagctgtcgtgggagttaggtctccattttctgtctctgttttgtgtgcttgcttgcccttctgccatgggttgatgcagcargaaggtccttgccagattctgacaccatgttcttaggctttctagcctccagaactgtgagtcaaataaattgctattctttttaaattaaattaaatttatttatatattttgagatggagtcttgcactgttgcccaggatggagcacagtggcatgatctgggctcactgcaagctccacctcctgggttcacgccattctcctgcctcagcctcccggtagctgggactacaggcacccgccaccatgcccggctaattttttgtacttttagtagagatggggtttcaccatgttagacaggatagtcttgatctcctgacctcgtgatccacccacctcggcctcccaaagtgctgggattacaggcatgagccactgcacccagcagccactgctattctttataaattaccaagttggtgacagtccattatagcagcagaaaatggactaagacatctgccaaaacatgtatttagtcagagtctgattaaggttctctcaagagtttattcattgggctcactaagtgctatatgttagaagaataagattgttaattctgtctgaaatgaagcatattaataaataaatgcattgacattttattgtgaataattatgaccttctagtattgcatatttatgttatagcttaggaacttagaagaaagtaccaagtcagagtcaagcctgtttgtctttacgacctgcactgagacaagaatctgggttgaagtagtatctctgattctgagaatctcttactttaggattttccattgacaatattggaaaacatgatctggattatgcaatatttggctcttcataggctgcaaagttttgaaaggtgctggtgtgaatcttggcagagatctctggcttaggcattcctttactttctcccaacttcatcctgcgtaaatatctcattagagcgatatctactaattcacagggctatagtgacactctattgacacatcaggaaaactttaggacacaggactgggaggagaaaacgggcttgggataccttcttatagctatgtacctaacactaccaaaataataaaaaacccaatggcttttatgcttaaaaattgatatttattaattatataattcaagcccttttcttttaagtctccccccactctgtttgtagaagttcgaggtcatgattacctttccaatttccagagacactataaaataaccatcattagatttttagctgtaggtaataaatagaagagttattataacattctgagcataatagctggtgttcctagaaatatccaggacaactgtcatttgtcatttctggcaatgtctaaggccttgaggcatcaaacaggcatctaaatggaaaatctgtctgaactgtggtcagtggagggttgagattcttttgaaagctattgatgtgcagttatgtgaaatacaaccgccatttatgcctgtaatctgcttgagagtaatcatgtacatagttaatactccaaactacttttctttttttttttcttttattattatcctttaagttttagggtacctgtgcacattgtgcaggttagttacatatgtatacatgtgccatgctggtgcgctgcacccactaactcgtcatctagcattaggtatatctcccagtgctatccctcccccstccccccaccccacaacagtccccagagtgtgatgttccccttcctgtgtccatgtgatctcattgttcagttcccacctatgagcgagaatatgyggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacgtacgtgtgcatgtgtctttatagcagcatgatttacagtcctttgggtatatacccagtaatgggatggctgggtcgaatggtatttctagttctagatctctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgttttttttttgtaaatttgtttgagttcattgtagattctggatattagccctttgtcagatgagtaggttgcgaaaattttctcccattttgtaggttgcctgttcatcactctgatggtagtttcttttgctgtacagaagctctttaatttaattagatcccatttgtcaattttgtcttttgttgccattgcttttggtgttttagacatgaagtccttgcccatgcctrtgtcctgaatggtattgcctaggttttcttctagggtttttatggttttaagtctaacgtttaagtctttaatccatcttgaattgatttttgtatgaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtaaactacttttccattcagatcattttagtttggttaattatgtaaaagcaaatatttgtttagagtaatgcygctgctccattaatgaattattgcctggttccctcgttattgtacatctcagtcactttcaattatgctcaaaaggcgcatctctcaaaggaatctttttttttttcttcccacactcactcagtttaacttcctctcctggtttatctaaacaggaattcatcttcattttaggaagtacttacttcacaaattagctttccttacattctttctaaagcaaaacaaatctagttttgtttctaagaatcgaaatcagaaatgctataacttaaattttgtaactgcttaacaacaaacacaccgactacaagtttttcttaaagacaacattgcccatttccagagtatatattttttcaattaatagacttcattttaagagaaattttagatttacggaaaaattaagcagaaagtgagaatctattttttgagcagaaatttttgagagctcacaaaatttcagggtctgttgtaatagttgggtttctgttycaatgagcttgtggatacaccaatagcttatagccaagtgcatatcagtacccatcaaatccatgagtgagatatttttctttaaatcacatggctctaaatgacaggttttacatatacttagccctctataatggcagaggtggaatctgtggatacagagggccgactgttacctggaaagccagggtttgtttgcctggtgagtaacaagcgaccctccgtgagaatgcaggttatgatgaataggagtgttcttagttggcacaagaaaggcaggtactgggagtattctcgaaaacagcgtcttctcaagggaaagtgacaggaggctgtcgacaaaaagggctaaagtgtaacatagttaaaaaggtttattctgagtgaaatgagtgaccaaggcccacgacacagccccaggaggtcctgtgaacatgggcccaaggtgctcgggccacagcttgattttatacgttttagggtgacagaagttacacagataccaatcaatacgtgtcaggtgtgcgtcaattcagcctgaaaaggtgggacaactcaaggcagcagcttccaggtcataggtggattgaaagattttctgactggaaattggttgaaagagttatgttatcttttttatttatttatttttttgagacagagcctcactttgtcacccaggctggagtgcaatggcactatctgggctcactgcaacctccgcctcccgggttcaagtgattctcctgccgcagcctcctgattagctgggattacaggcacacaccatgcctggctaatttttgtacttttagtagagacgaggtttcaccatgttggccaggttggtattgaagcaccagtgtaccagcagcagcggaggtcctcctccttgcagaccagggttaccgcataggcagtgtgcccagagtagcagctcagaggcaggtctgcactcatacccacttctaattatatgcaaattaaaggagttatgcagaaatttctagaatgagggtgatagcttcccagttgtcaggtcgttgccatggaaaggggcagtaacctccaggtgttgccatggcaatggtcaactgacttggcacactggtgggtgtgtcttatgagaaggtgcttctgccccccaccccaccccgcaccccgacctgtttttagctagccttcaactggtctagtgtcctagccccacctctggagtcaagtcctgcctcccacctcagaatcttggtctccacaaccccttatcttaacccagacaattcctttctattgatttcaggtccttagataataacaacttggctgggcacagtggctcacgcctgtaatcccagcactttgggaggccaaggcgggcggatcacctgaggtggggagttcgagaccagcctgatcaacatggagagactccatttctactaaaaatacaaaattagccgggcattgtggcgcctgcctgtaatcccagctactcaggaggctgaggcaggagaatcgcttgaaccggggaaacggaggttgtggtgagctgagattgtgccactgcactccagcctgggcaataagagggaaactacatctcaaaaaaaaaaaaaaaaaaaaaaaaagagagagagagtgagagagagagagagagagagagagagagagagaaaatggctcaacagcaaatgcaggcatttatgtccaggataaacttatagaggkgggggaccagcttagtgtcagtgcccactgcttacaggctggggtatttataggtatgggcgggaggggcctgggcagtatggcttgctgcctgataggatattgataagatgttcctttgatcaggcggtttggcccttgttctggtggagtgtggtgttccttgcattttctcctagcagaataagataagaggcaggctgtttctcacggtccgaacccccgtggaatgttccactttgaccaaggtctgtgaaatggcgggagacttacataatggtgcagtttggactaacacttttgagggctcttgttttttttgactgtatatattttctaggaggagaacaagtttctgggtactcttaaatattacttgtgagctttaagttactcagtgatttgacttacggtggtggttatctttaaataygtcatgctttttttcttaaccatttttagtgtggactgtatagaatacacaaaaggccaccatatttatatacaatttaaaaaataatttaaagcaaattaaaaagtacccagatagctacaacccagtccaagagttagaatatggacagagtccctttccccactccatcccctacctgcaacaaacctcttcctcttcccggaagtaaccactctccaaacgtgtgacaatcacttccttgcaaatgtttatagttttacacttctatatgcattgcttaattttgccttttatgtttagacctttaatctacttgaaatttatttacgtatgatataaaggtccatttttttccatatggacacttccctgtcccaccactgtctattagaatttctacttcctcgcctgatctacactaccactgaggcaggagaatagggtctggaggcagggaagctaaggctgattcatgctgcttatgagggaaaggaggggttgaattgggcttaggttcggaacccaagcccgattcatcccttttcaacccctccttttttctgcgaggcagttgaaaaatgaaagtacctctgattggtcccctcctgcaaccaatcagactggtcgggggccaatgggaaccctctagagggtatttaaacctcagaaaattcagtaacaggctttggagctgcttgcttgagcccactgtcctctgttggagtaaatctctgctttccctgccttgctttgtgtgttttgtccaattctcagttcaaaacgccaagaacctggccaactacccttcagctggtaacgtattttggtgagccagccaggaggtaagcccaacgtttgggatttattttcctttttgtcctctttctctctcttttcctttccaactcgggactctcggtggacagygcctaggcatggaggcaaccgcaggtttgtggttggggccactctccagggaaactgaaagggttccgtgtggaagcgcctgatcaccaccacccggtttgggtgagggacctgagtccttttcttttcagtcttgcagcagctgtttcctggcaggrcaaatggtcagaaataccatatgtacaggccttcacggccctacgccaaaacctaatcatctccgcaaagaaagtccaaagacaggactagatagtatagatgacccccttttataagggccacctgtctctcagggtgaacataaccgcccccacgtagccccttgccaagtgctcctgaggctaaaacccaaaccctggacaccctactaggtccccctcacgctcggaggggacactacattccactctccctccagccctgctaccccttcaggaagtagcaggagccgaggggccagtcctagtgcaggccaccttctctataactgatatacaacggtgtcagggaaagctaggaagctcttctaagaatcccaggaaattagcagatgggttccaaactttgacctcagccttcgatctctcacagagaaatgttcaattcattctagcaacctcttgcaccccctttgaaaaggaatgaatcttttgaggctgcccactgggaagcagacgatttatttgcccaaaaccctcagggcaatcacctgggcccagacacagtccccacaactgatcctaattgagactctaatgctctcgtgggaacgaaaaactgggctaaatttcttgaggctctccttggaggaatgagaaagggaataactaaggcagtaagtgatgatgaagtaagggaggttccaccggaccaggtaacccttgccatgctcatgctacaatctggaaaggaagagggctgctaactagcaaacactcccctgtaaagcataggcctgaaattctgcagcttttggaagcaatacacctgccaaaggctgtagctgtaattcattgcagggagcatcaaagggccttaacccttatagcacaaggaaacagaaaggctgatagagaagcgaaagctgtagttctcagggtgcaatcccaacagattccagctctacttcttttctgtgattccccaatggagcctgaatacacaccacaggaagaacagttaataaaggagcaagggggacaaaacccaggatgctggtggtacatggcatcaaaaccacatctccctcaagcagcctgatggagaattagaaaaactctgcatgactctttgcatatggggagagaagccaccctggccgtggttaacaggctcttcattgagcctaacttagcttctgtggttaagcatgtctgtcaaacctgctcactgtgtgcactgaacagcccaggaaacagaatgcctcctgtaatagaaccagtccagaggggagttgtattagaggacgctgatagaacatacccaggaaaagatgggcgattagacttcacacatatgccagctggcagaggttataagtttttgttagtgctaatagatatctttactggttgggtcgaagcttatcctaccagatcagagaaggctactgtggttataaggttctcttaaaagaaataatcccccagtttgggttacttcagcgtctccaaagtgataacggcccatactttatctcccagataactcaagtagttgctaaggctctcagaatcaaatactatttacattcagcatggaggcctcaatcctctgggaaagtagaaagggctaatcaacctctaaaaggatcgttagctaagttcgatcaggaaacatcagaagcttgggtcagcttactgcccatagctctcttaaaaatctgtaatacccctagagcaaaatttaatataagcctatacgaagsctattagtttgtttttakgtgtgtgtgtgtgtgtttttttttttttttttgagacggagtctctctctatcgcctaggctggagtgcagtggcrcgatcttggctcactgcaagctccgcctcccgggttcacgccattctcctgcctcagcctcccgagtagctgggactacaggcgcccgccagcacgcccagctaatattttgtatttttagtagagacggggtttcaccgtgttagccaggatggtctcgatctcctgaccttgtgatctgcccgcctcggcctcccaaagtgctgggattacaggcctgagccactgtgcccggccttgtttttttggacatggaattttcgctcttgttgcccaggctggagtacaatgccttgatcttggctcactgcaayctctgccttccgggttcaagcgattctcctgcctcggcctcccgagtagctggaattacaggcatgaaccaccatgcccggctaattttgtatttttagtagagayggggtttctccacgttggtcaggctggtcttgaactcctaacctcaggtgatctgcccgccttggcctcccaaagtgctgggattacagaaggctattcttaactgatgatgtaattactgattcagaaacagctggtttagtaaaatacctagttaacctaggacaatgtcagcaggtttatacagaagtttggaactcaaaggcttccggtactggaagctaaccagccacctcaaatcaggccagcagataaggtgcttgttaaagcatggacggaggggtcacctcctcaacaattacaaccccaatggaaggcaccgttttcagtgatactggccacgccttctgcggtcaaagtactgggattagatagttggatacacctttcaaggatcaagtctgtgatacctgaagccccggacctggaacctgaagttcccatcagccmctgcacctgtgaacctgtggcagccctgaagtacctgtttagaagacagccaaaararaaatgcctaccaacgttccttggtgtttttgttgcatagttactgtaggstggataatagtagccatgtttktttttttttttttttttttgcagattaattaccttctttcaaacagttggaatcacttccttcatagtaattaagtagaatcttttaattcwtttctataacaaacattcctgacagcataggtgtccacctcctgaagttcccatgaaatcttttaaccattcatttcctcttgcctggagatgattgtgcagtaaggtttccagccagttccaaatgaattcaccacccctggccatcaagaaactaccctgtctccactagacagagcagggtgagagttctgtgattccaataggcagggactgtcagtcaagtcagtgtgacgcagttacagaaaaaagaccatcagtccctctgtctcacataaagacttacggggatcctgtctctcagggggggaaatgaggcaggagaatagggtctggaggcaggaaacctaaggccggttcatgctcactggatatcagaggctactcttcaacaccccctttttctgcgcgacagttgctgcccctcctttttctgcctggcggttgaaaaatgaaagtacctctgattggtcccctcctgcaaccaatcagactggtcgggggacaatgggaaactcctagagggaattgaaaccccagaaaattctgtaaccaagaatcttgagctgcttgcatgagccacccccaccctgtggagtgtactttcatttaaaacaaatctctgctcttgctgccttgctttgtccattttgtccagttctttgttcaaaacgccaagaacctggacaactaccctcagctggtaacaccacctctgtcaaaaatgaagtgtccatatatgcctgtttctgggctgtccattcttctattccaattgttctacttgtcaatccctgtgttaataccatgccatcttcaaaacaggtcatttctattgatgtctggcttgtttgctcatactagccatagcatgtcttgcctgattgcaatctcctaattttgttgagacttactttatcgtccagcgtgattcactttgtaaaggtcctgtgagttctcgaaaagagtgtgtggtatgcagtgttgggtgctgtgttgtgtgaatgtccacttgatcaagtctgttaattgtgttcaaatctatgttcttactgatttttcatctacttgttctatcaattattttccttccataggtcccccttttctggggatttcctcctcaatttccagcttctctgggagccccaaatcgaatctctagctccacatcccctaaaattgcttctttctgtttgagatctcttccgctgtgtgcagcagcagcaagctgggaagtccctcaggagaaaaatcttggtaaatgtggagctcatctcacgtgcttccttcattttgaggactgtctgttccctgctcagtttctgcctgctaaggtttatctccagtcccttcaaagacctgtttgttatattttgcccagagtttataaataattttggcagaggggttaatctgataccgtctagtcctccaaaacaagaactagaactctggccacatctgttttcatccagtcttttgatgctcaaattataacggccgtgaccccttagttaaaagaagcttcatctttcctctgcagtatcttcttgtgatagtctaaagggattagtctttattaatactgactgtgagggaagaaacaagaaaggctgatttttcctctaaatgtcccatcctctcacaccagtcagaataggtattattaaaaagctgaaaaataacagatgctggccgggcgtggtggctcatgcctgtaatcccagcactttgggaggccgagacgggtggatcatgaggtcaggagatcgagaccatcctggctaacacggtgaaaccccatctctactaaaaatacaaaaaaaattagctgggcgtggtggcgggcgcctgtagtcccagctactcgggaggctgaggcaggagaatggcrtgaacctgagagtcagagtttgcagtgagccragatcgcgccactgcacyccagcctgggcgacacagcgagactctgtctcaaacaacaacaacaacaacaacaacaacaacaacaaacatgctggtgagattgcagagaaaagggaatgcttattcactgttggtggaaatgtaaattagttcagtcattgtgcaaagcattgtggagccttctcaaagagcttcaaacagaactaccatttgacccagtaatctccttattgggtatatacctgcagtagaccacactgctataaggacatatgcaagactgggtaatttataaagaaaaagaggtttaatggactcacagttccacatggccagggaggcctcacaatcatggcggaaggtrgagaggagcaaaggcacatcttacatggcagcaagcaagagagtgtgtataggggaactgccctttataaaaccatcatatcttgtgagacttattcactatcatgagaacagcttgggaagaaccygcccccatgattcaattacctttcactgggttcctcccatgatacatggggattatgagagctacaattcaagatgagatttgggtggagacacagccaaaccataccaatacccaaaggaaaataaattgttctaccataaagacacacgcactcatatgttcattgcagcactactcacmatagcaaagacacggaatcaacctaaatgcccatcatcaatacaccagataaagaaaaggtggcacatatacatcgtggaatactgtgcatccataaaaaagaacaagatcatgttctttgcagcaacatggaaggagctgggggccattatcttaagtgaactaatgcaggaacaggaaaccaaatactgcatgttctcacttagaagtaggacctaaacattgagtacacatggacacaaagaagggaacagtagacactgaggcctttgtgagggtggagagtgggaggaggctaaggatcaaaaactacctattgggtactatgcttatcagctgggtgacaaaacagtttgtacaccaaacccccatgatactcaatttacctgtacaacaaacctgcatgtgtaccctgaacctaaaataaaagttaaaaaaagagataaaatttgtaatcaacagcaacaaccacaaaagcttttgtttcacaaagcattcattacaatatgtaaaatagtaatacttaggacagttggcaactcattaagaatccaaaatgatggtgattatttgacaaattcccactctatgccagctctaagtcctagttcctgactacacggtgcagagtgggcttaaattagtcagggaccttaacatttttaaaatcacggtgaagttttaacaattttaaagtgtacaattcagtggcattaagcctgttcacccatgttatgcagccatcacctctatctcggtccagaactttaaaaaatcaccctaaacagaaatgctaactaagcagtcactctccatttctctctcttctcagcacttggcaaccactaatctgctttctgtctctatggatttgcctattctggacatttcwtataaatggaatcattcaatatgtggtcttcggtgtctggcttcctttatttagcataattttgtttgtttgtttgtttgtttgtttttgagacagatcctcactctgtctcccaggctggagtgcagtggcacgatctcagctcactgcaacctccgcctcctgggttcaagtgattctcctgcctcagcctcccaagtagctgggactacaggcgtgcgccaccatgcccaggtaatttttgtatttytagtagagatgaggttccaccatgttggtcaggctggtctcgaactcctgacctcatgatctgcccacctcatcctcccaaagtgctgggattacaggcatgagccactgcacccggccagcttagcatagtgtttttgagggtcatccatgttgtatttttcgttcattcctttttatggatgaagaacatttaactttatggtatcaaaacacattttttttattcatctgttggtggacagttagattgttttaaccttttggctattgtgaatagagctgctgtgttcactggtgtataacattttgtaaacaaatggaaacgtttttatttgaacacctgcttttacttctcttgggtacatatttaggagtggaattgctaggtcatgtgataattctgtgtttattgaagaatcaccaaactgttttccacagtggttgtaccatttttcatccccaccagcaatgtatgaaggttccaatttctccacagctttaccaacatttattctctatttttaagaaatggctatcctagtgggtgtaaaatggtatatctcattgtgcttttgacttgcctttctctaatgactaatgacattgaatatctttttgtgtgctttttggccatttatatatcttcagagaaatgtctattcaagtcttttgtccctttttaaattgggttgtgttttgttgttgagttggatttttaaagctttaaattgcagaaaacactagcttacacaaaaaatgattttcttttttttgaggaggaggcttacacagctggaaggtaaaaggagtgatttgtttagttccaggaattctaacaatgtgaggagggctctgtgtcctctttacatctgtcagctgtgatttcctcaaattcgttgcagaggtttcttttactacagagtggcaaggcgaccttcagtagcaccacatccatctcattcctgaccgacagtggaaagaaatcttcctaataccttccattttaaaggaataacattaggagaaatatctaacgtagatgacgggttgatgggtgcagcaaaccaccatgggacgtgtatacctatgttaacaaacctgcacgttctccacatatatcccagaacttaatgtataataaaaaattacttttawatttatttatttatttagagacagggtcttgctctgttgcccaggctggagtatagtggtgcaatcacagctcaccacagccttgaccacccaggctcaagtgatccacccacctcagcctcctgagtagctgggactgcaggtgtgcatcaccatgcctggctaatttttttttttttttttttttttttaagatggagtctcgctctgtcacccaggctggagtgcagtggcgagatctcagctcactgtaagctccgcctcccgggttcacaccattctcctgcctcagcctaccgagtagctaggattacaggcgcccaccaccatgcccagctaacttttttgtatttttagtagagacgggtttcaccatattagccaggatggtctcgatctcctgacctcatgatccgtccgcctcggcctccagctaatttttttgtttttcatagagacaaggtctccctatgttgcccagtctggtcttgaactcctgggctcaagcaatcctcccacctcagcctcccaaaatgttggaattacaggtgtgagccactacacccactctctaatacctttcagaaaatgtccagggagaacctagtttagatttcatgtccagatcttaaatgatcatggtagccgatgttatgggtagcataatttgctgagtctaggtcatgtacccactgatgtcgtcatggtggcaagtcagtgttggccctgtcctaaccacagggaaggggttctctacagaaaagtagagtttagatctgagaaggtagttgagaatgagtgccgtatagtgaataatagtagatttttaccccattttacccctttgtctttggttgtatatatattcacataccattctaattatacatatagtttcaaaaatgcctctgcttctccaaacacaactatactttatatatattttcaaaaacagttctacctccttcttccaaagataaatatctgtgttttgtgtcctccatggccacccctaagagaggtgcaaggaggatttcattcctgggaattacctactttaatagcctgggtatttactgaaggactgaagaattacaggcacctatttccaggcttggcatttttaagcagtatttaaaacctcagttgacatttgatgattctgtggcataataaccacatccagagatcttgtctaaacctggaccttgactcttgatcctcatcttgtggtttctatttcttgccaataatctattctggcttttccccatctcccaaaataatgctttcactttgctgtctgctttgaacaatgtgaaagacttgaaggggaaaatgaagctaaataatgtggcatttcccccaagattataacctactggatgcatttttataagggatatgatgcttttgtctggcaaagaatacctagaatataatatttgagagagaatcagacttcccaaattttctggctcatccaagacccaatattttatttattcatttaatcattttttcaacaatttaaaaaattgatggataataagttacatagtttcagggcacacatgataacttaatacattcatataatttgtatacatcacatcagtgtacttgggatatccatcaccttaatatttgtctttatcctagaaatgtttgaatttttctcttctaatttgaaatgtacagtatgtttttgtaaactatagtcaccctactcatctgttgaacactggagcttatttcttctctcaactttatatttgtattgatttatcaacttctttgaatcccctacttctgctacccttgctggcttctggtaaccaccaatctactctctaccttcatgagatccactttttcttagcttccacatatgagtgagaacacgtagtatttgtctctttgtgtcacttaacataatgacttctagttttatttatgttgctgcaaatgacaggattttattcctttttacagatgaataatattccattgtgtatatataccacgttttctttagccattcattcgttgatgggcacttagatcgattccatattttggctattgtgaatagtgctgcaataaacatgggcgtgcagatagctctttgatatattcatttcctttcttttggagatatacccaggagtgggattcctggatcatatggtagcacaatttttagttttttgaggaacctccaagctattctgtgtagtagctgtactaatttccattcccaccaacagtgtacaagggttccctttcttccacatcctcgctagcctgcgttattgcctgtcttcttgataaaagccattttaactggggcgagatgatatctcattgatttgcatttctctaataatttgtgatgttgaatattttttatatgcctgttggccatttgtatggcttcttttgagaaatgtctactcagatctattgcccatttttaaattggattatgttgtttttgtttgtttgtttgtttttgctattgagttgtttgagctccccataccttctggttattaaccccgtctcaggtggttagttatattttctgccattctgtgggttttctcttcactttattgattatttcctttgctatgcagaagtttttagcttgaaataatcccatttgtctatttttactttgtttgcctatgcttttgagatctgacataaaaaaatcttcacccagaccaatgtcctggagtgattcctcaatgttttcttctagtagtttcatggtttgaggatttagatttaatctttaatcaattttgatttgctttttgtatatggtaagagagaaggatccagtttcattcttctgcatatagttatctagttttcttggcaccatttattgaaaagcctatccttccccccattatatgttcttggtacctttgttgaagatgagctggccgtaaatgtgtggatttacatctgcgttctctattctgtcccattggtctattctgtctgtttttatgccagtgtcatactgatttggttactatagctttgtagtaaaatttgaagtcaggtagtgtaatgcctccagctttgttccttttgctcagattgctttggttatttggggtcttttgtggttccatatatgtcttaagatttttttctatttctgtagagaatgtaattggattgcatttaatctgtaaattgctttgagtagtattataatttaaccaatattaagtatttcagttcgtgaatctggaatatcttttcattttgttgtgtccctttcaatttctttcccaatattttagtatggtatttctttatctctttgcttttgtcttcacaaattttagcttaggatgcagaatttggccttttcaaattctgactcccagtcctcaaggattgcaaggtatgggtataaagatttttctaaaaaatgaagtttcattattccctctctgcttttagatagtatagcttggactgaacttctgcttttctcatataatattatttgaggccacaagtaatgttcaatatcttgctatttttcttggggctgagtccaaagatttaacaaatcattggatagccagttgcatttctactgtataacaaaacttttcaaatattatttagggatgggaataattatctcctctctgttttgcaccccacactatctcagctattttcatatgttagagcctgttacttaaattatctgattcttaggtataaatgactcaggactttttcctttgcagatgacagaaacccaactcaaaactgctttaacaaaattaaagtgggtggtggggagtgcagatgtgtgtttcagaggagggaagattatctccacatctacaagtacatgctagattgggcactgatggacagaatcatcagtttattagtgaagcataacttgtgtgaacgagacaagctggctcaagcatttgaagatgcttttgaggtactgaggcaacattcaactggagatcttcaaaacttacctggttttcatcagtgattgtmcccatgtcagaggagattccaactgctatggaatgttgcttacagaggaatctatttataattggagaactttaataaataatgctgcagacttctattttgaaggaaccattcattgatctttgtggaacataactgaaagccagctggtgcagtctgctgttttccagcaacagggaggacaaggcgggaagcttctctgactgtttgaataacttcacaaatctcagtataatcccaagatggcatctgcattcagtaagtagataaaaccaaaggcagtttccagtttgtatcaaaaaatgaagaaaaatttgccaaactttgaggaataagaaagggcaataggaagaccatggtctatcagaaaatggccagggaactgaggaattatggaaaaactcaggaaatcaacaaaatctggagaaagctcatttaccaatgagcttcagtggggccattctctgaagatctctccatcttgtttctctgagaaagagatcgtctactcacagtatgttcaactgatcaagaacatctcagtttaagtaattggaatgcaaactaaaattttacatatgccagttaccatgagcttagtcaccatgattgctaaatatactctcccatttcatcatcttttttggcattagaaatccctacaagcttcaggatttttctcttaaagcaaatactgaagataaaaaaattagcttcattsaggctatcttttatcaaatagcacataatttatacagacttggtgggaaattctgccagtgaacaactttgttgtttcaaatcatcaagccccatttgaaagtatggactaaatatccttgcttttactattctctatgcagccactttcttctaggttaacaatgccagtgcagatgatttgatttatgtattaatttaaacattttcctgtcttacactcaggtgaaaaatcatttggatatatatctgatggctttacaaaaattatttacaaaaagtaattgcatataatacagtgtttwtgccaaagtatgtttatgtcttaaaaactttagtggaaatgtgtattcaggtcccttgctcattttctaattgggtttcttgttttcttaatattgagttgttggagctccttctgtattttggatattaatcccttgtcagatgtatggcttgcagctgttttctcccaatctgtgagttgtttctgcatgctgttggttgtttcattggctatgcagaagctttttagtttgatgtaatctgatttgtctatttttgcttttgttgcctgtgcttttggggtcacatccaaaaaaccgttgcccagagagtgtcatgtagtttttcctccctgtgttttcttccagtaagtttagagtttctggtattacgtttgaatctttaattcattttaatttgatttttagttctatatatggtgtgagataagggtccaattttattgttctgcaggtggaaatttcattttcccaacactatttattgaagggactgtcctcttcctattgcgtattctggtacctttgttgaaaatcaattgactgtatagtagtaggttaatttccaagctctctattccactccattagtcaatgtgtctgtctttttttttttttttttttccaataccatgttgttttgattgctatagatttgtagtatactttgaaatctggtggtgtgatacctccagctttgtcctttttgttcatgattgccttggttgtttgaggtttttgttgtccatatgaatttttgttttgttttgttttttgagatggagtctcactctatggcccaaactggagtgcaagtggtgcaatcaaggctcactgcaacctccgcctcccagcttcaagtgattctcgtccctcagcctcccaagtagctgggattacaggtgagtgccaccatgcctggctgatttttgtatttttagcagagatggggttttaccatgttggctaggttggtctcgaactcctgatctcaggtgatcctcccacctcggcctcccgaagtgctgagattccaggtgtaagccaccatgtccagccccatatgaagttttggattttttttttatttctaygaaaagtgatgttgggatattcatagggattgcattgaatttgtagatcactttgggtagtataacattttagtaatattagttcttctgaaccatgaacatgaaatatctttccatttatttgtgtcttattcagtttatttcatcaacaccttatagttttcgttgtataagtcttttgtctccttggttaaatctattgccaatttctttttcttgcttaattgctctgtctagaacttccaattccatgttgagtgggcattgttgtcttgttccagatcttgggggaaaggctttcagttattcactgctgagtcactgttagctgtcagcatctctggatagcttttattgttgagctacctttcttgtatacctaatttggtgattgtttttatggttaagggatgttgaattttgtcaatttttttctgcttctgatgagataatcatatgatttttgtcatttattctgttaatgtggcatatcatttattgacttgcatatgttgaacmctccttgcattccagagataaagacatttctcaaaagaatacatataaatggctaacagatataatgaaaaatactcgatattgctaatcattagggaaatgcaaattaaagccataatgagacatcatctcatactggtcagaatggcttttatcaaaaatatgaaagataaatgttgtcaagaatgtggagaaaagggaacaattgtacaatgttggtgggaatataaattagtatagtcaatatggaaaacagtatggaggttcttcaaaaaactaaacataaaattgccatatgatcttgaaatcccacttctgggtatttaccaaaaaggtttaaaatcagtttgttgaagagatgtctataccccatgttcattgcagcactattcacaatagcaagttacagaatcaacttaactgtgcatcaacaaatgagtggataaagacaatgttgcatacttacagaaaggaatactatgaagccttaaaaaagaaagacattctcggccaggcatggtggctcacacctgtaatcctggcagtttgggaggccgagatggatggatcagttgaggtcaggagttcgagaccagcctggccaacatggtgaaaccccgtctctactaaaaatataaaaattagctgggcatggtggtgggtgcctgtaatcccagctactcaggaggctgaggcaggagaatcacttgaaccggggaggtggaggttgcagtgagccgagctcgcaccactgcactccagcctgggtgacagagtgagactcagtctcaaaaaacaaacaaacaaaaaaaacaagaacaacaacagaaaagaaagacattctgacatttgtgacaacatagatggaattagagaatattatgctaagtgaattaagtcaggttcaggaaagcaagtactgcaggttctcacatatatgtggaatctaaaacccacagaagcagaaggtagaattgtggttacagaggctgggggttgtggggaagggagagatggtgatcaaagggcatcagattttagtcagacaggaggattttaaaaatacttttgagttctattgcacagcatggtgaatatagttaataatagagtattgtacatttcaaaattgccaagagagtaaatttcaaatgttctcaccacaaaaatgttaagtatttgaggtactggatatgttaaccagcttgatttagttattccacattgtattcataaattgtaacatcactttgtatcccataaatttaattataaattatcaatttacaatttcaaaaataaagtaggaaggggatttattggctcatagagctaagtctgaggtcaataggattaaggtgtggctggatcagatgtcatcagtactctgccttcctttctattccttcttattcttttttttttttttttttttttttttttttttgagagagagtcttgctctgtcacccaggctggagtgcaatggcttgatcttggctcactgcaacttctgccccctgggctcaagtgattctcttgcctcacctcttgagtagctgggattacaggtgcccgccaccatgcccggctaatttttgtatttttagtagagacggggtttcaccatgttggccagcctgctctcgaactcctcaggtgatccgccctcaggtgatccgtccgccttggcctcccaaagtgctgggattacaggtatgagccatcatgcccggccggaaagggtttcttaatgagagctgatgggatgggatttgaactggcaggaaataaagtggcagatactcctttgggcggctgcatcagcaagaatggaatcagggagttgagacgaggtgggacaggtaggaggaagccaactctcacttcctccttctctccccatttatcttcttttttaccctgagcagatacctgtcatcctttttttcatttaatattatatcataagcattttccatgttgctaatgtattttctcaataaactttttattttggaataattttagacgcacagagaattaatgaagacaacagagagttcttgtattcccctcccccagtttgcttctcctgatgttctcatctcacatgactggtcaattgtcataactaagaaaccactcttgtatgttactatttttatttttgagacagggtctcactctgtcacccaggctggagtgcacaggcacaatttcagctcactacaacctccacctcctaggctcaagcgatcctcccacttcagcctcctgagttgccaggactacaggcaaaaattaaatgggtgtggtagcatgtgcctgtagtttcagctacttgtgaggctgagaagaagaatcgcttgaacccaggaggtggaggttacagtgagccgagatcgcgctactgcactccagcctggcgacacagtgagtctctgtctcaaaaaaaaaaaaaaaaaaaaatgctggaaacaataagtggagggaaagtaacaggtacgggaaccaccatgaacaaaacattagaggcagaaacaagctctctttttatgttggcccctgggacagtttactcttctccccacaaagagtagctgaccaacacttggaggaaactatgtcaaagagtttaaagcctggagtggaaagattaggggtgtgctgggggagagacggggtgctgagaaggagggaagaggcatggctggagagagagagagagagatgtgggagagcaaagtgacttgtcaccactgctttttggctggcgtggcagtggggataattattaaaataatcactactaattgtaaaaattcatggacaatagaagggaacatcctcagctccttttcaccacttttttgtttgctttttgttttttaactgctcctaacaatctggtgtatttcttcacatgctttcttcctgtgcatacaaaccataagaatacaaacttacaggataccaggcaacaccaacctcctaagcctcgaacctctctctgccactggctgcttcgtccctgtgctggttctcctcctaacctccaggtggkctctctattctttccccttccttctctctttttttttttttctgattgagacaaagtctcactctgtcaccagactggagtgcagtkgtgtgatctcggctcactgcaacctctgcctcccaggttcaagcgattcttgtgcttcagcctccgagtagctgggactacaggcgtgcaccaccacacctggctaatttttgtatttttttttttttttgagacagagtcttgctcctttgcccaggctggagtgcagtggtgcgatcttggctcactgcaacctctgcctcccgggttcaagcaattctcctgcctcagcctcctgagtaggtgggattacaggcacccgccaccacgcccagctaatttttttgtattttcagtrgagatggggtttcaccatgttggtcaggctggtctcaaacccctaacctcatgatccacctgccttggcctcccaaagtgctgggattataggcgtgagccaccgtgcccagccaatttttgtatttttagtagagatggagtttcaccatgttggccaggctggtctygaactcctgacctcaggtgatccatccgcctcggcctcccaaagtgctgggattacaggcatgagccacggcgcctggcccccttcctcctcctgaaaaggcggatctcaaggctcagtcctgctcttccctccacatcctttgctcttgcargtctcctcttccacgcaggtggctccctcatctcctcttcaatatctgacttctctcaaaagttccaagtctggatttgccattacttgctggacatctcttcctttatctcatacccaccactgctcataaagatttgtcgacgaccaaagtcagtcatttgtctcagtttccttctttaagctttccattttttatcactggcatttgtgtatacccaaagtcatgggctcaaaacattggccttatccttgacttttctcattaacatccagctctaactggttcttctcctgtaatatctttctcctccatcccatagtttcagtctattttaccacctagatcatgatagacttcctaccatgaatctgtccccactccaacccatctccttacagctgccacatgaacctttataaaatgctatttacgtgttaatcctcttcctcctgaacacagaattcctcaccttcttgcttacctgccactgtcccaatttctaatcctggtaattatacctcccaccgtctaccaccaaactgtcttcctagactcacctcctgctcttcccacgcccgtgttccactccagcccaaatcatttagttattggtctcttaaaacactgcatttgctgactcctgggtctttccttgagccactaactcaatctgaaattttgatctccttttttttgaacttgttgaagaacttttttcccagctcaaatcccagtcaagccctgtctctttcaagaagcattcttttagctgggcgtggtggctcatatttgtaatcccagcactctgggagtctgaggtgggaggattgcttgagccctggagttgagactagcctggacaacatagtgggaccccatcttcacacacacacacacacacacacacacacaaagcattttttgaccacctccacagtccatggaactgacccttccaaaacctgaggccaatgcttattgatagactgggttggtatttacatattatatattatctctttggcctccctgagtttcccctgtgcagagactctacctatctctatttaccttctatttctctatttatcttcagtgcctggcacaggatctggacatcatagatgttcaataactttttgaaaaaattatttatatattgagagacagggtctctctctgtcacctaggctggaatgcagtggcatgatcatagttcaccacagccttgaattccttgggtcaagggatcctccagccccagtctcccaggtagctaggactacaggtgcaggccaccacacctggctaccattttttttttttwacttttcatagagatgggggtctggctatgttgcccaagctggtcttgaacttctggccccaagcattcctcctgctttgtcctcccaaagtgctaggattacaggcatgtgccaccatgcctagtctcaatagcttttatgtagaatgattatgcttatgcataggttgaaggtttgaaggcaagaagataaagtttggggaataaacaggggacatgttataggaatggatgaaggataaaactgtggtggggacacagggttaaaggagaggcaaaattgggtttggggattaagatcgcagaagagggatacgagtatgagattgtgtgagactgtcctacatgtcattggcagtgctcatgttagagggaccatctggatgtgctcatgaagttgttgggtgagaaccagatgggcctcagggtagggaaaattaggtggagtttggcctcctcagatctacaaaggcagacaacccagtgaattacttacttaatttgactcttgtagaggctcaaagaagcccgtcctggaaggtctagctgcttgtttcacaaaggccaaagacagggaagtattttgtttactggattcattcagaaaagtatttattgagcatatactatgcaccaggcattgagaacatagagattttgttttccctcaaggagttcctagtctagtggggggaaacaaagacataaaaagtaaatgcaacagtgtgttacaatggagaaagaatcccgtgtggggtattatgggggcacaaagcagggagggataggttcacctygaggagatagaaaaggcttctcagggaggcaacttgagctgagtctttaaatctgtgtagatatctaccgggttgatgggaatgaaggacagttggggagagggtaggcattctgggcaaacagacagcaagagttgcagggagctgatgaaatttcagggaaattcatgaattttgggtcaggaagagatgagtgatgtggttgcacagaaaacaggagacccatgaggagacgtctttggtgtgctggggagagataataaaggcctgcagcaagcaggggaagcaggaatggagacgggcagggtggaagacatgcraaggaagtggagcggtcaggactccattgtttaattggtgatgacaggaagagaaagagaaagagtagactgtgtgagagagagcagaagagaaggaaagattggtcattgttactccctggttcttggctggggtaactaggtatatgatgtgtgtgtatttgctgagatgtgggacacataaggactagaagagttgcttggtttttgataaccaagtctgaggtgcttttgggaatcatggcccacttaactttccactccttttcatctgtgaaagctctgatgtctgagaaaggtcaaagggctccttggtagagaactataagcaagtacgatccaacttaaaaataacttactgaacattcactatgtgccagacacagtgtggtccacgctaatctccgagggggcagggactctgacttgttcacgtttgcattccagtgcctcatacagaggctgacacacagtggacattcaattaatatttgttgaatggatgacaagacatgaatgaatataacggttaatgggcagtaggaatatagtaatgagaatctcctgatgcctccttttgggagcaagctgtctggttggggcgacaaatgtatagacaaccagtgtccaaagagcatattaaatacttgaatagaggttggatgtaagggcaatggggactgaagagaaaggaggagtgactgagccctcgtgttggatttttaaggatatgtacaagttttctaggcaaagaggaaaagaaatcccaggaagaaggaatagaccatatcaaggcttagaggggtgtaaatgtgtggcatggttctcagaataacaaaatgtttaatgcatctgaattctacatggcgatcataatacctgccatccccttataaggaaatctgccccatccacagtcagaggtgtacttggatgggaccactccccagacaaaagagcagggtcagtttctcactatgggkgtgtgtgtgtgtgtgtgttgatctggaaaatacagagaggatcaggcagttagcaataggaacaaagacggaragaagccagaggggccaagatggccatggggaacagaagttacaaagaagtagaacctcatggtagagaaaagacatgctgagcagagggagaagccgtggttrttttttyggctgagagcagatgaactcagatggtcagcccattaatcacatctgtgtatattaaaaatcttttagtcatgttaaaatatttgcttctaaccatcaaatatattttaaagaactcattaggagagggatagtctgttatatttacccagatatttaatgtttctgttgttctcgcttgattccccgtgttccaggtttccttctcacatcacttcccttctgtctgaagaaatttcttaagcaattcttttagattacatatgctggaaattgattgtcttagtttttttttcttcttttcatctgagaatgtcatcatttcaccttcatttctcaaagatatttttttctggatatagaattctgagttgatagctcttttctttcagcactttaaaaatattattctactttctttttttaaaaaaattttctttccacaggttattggggaacaggtggtgtttggttacctgagtaagttctttagtggtgatttatgagattttggtgcacccattacctgagcagtaaacactgcacccaatttgtgttctttaatccttcaccctcttcccgccctttccccctgagtccccaaattctattgtgtcattcttatgcctttgcatcctcatagcttagctcccacttatgagtgagaatataggatatttggttttccattcctgagttacttcacttagaataatagtctccagttgcatccaggttgctgccattaactcgttgctttttatggctgagtagtattccatcgtatgtatgtgtatatgcatatcacagtttctttatccacttgttgattgatgggcattttggttggttccacagtttcgcaattgcgaattgtgctgctataaacatgygtgtgcaagtaccttttttgtataatgacttcttttcctctgggtagatgcccagtagtgggattgctggatcgaatggtagttctacttttagttctctgtgaatctccacactgttttccatagtggttgtactagtttacattcccaccagcagtgtagaagtgttccctgttcactacatccgtgccaacgtctattatgttttgatttttttgatgatggccattcttgcaggagtaaggtggtatcacattgtggttttgatttgtgttttcctgattagtgatgttgagcatttttcatatgttggtcattttgtatatcttgagaattgttgtctattcatgtccttagcccactttttgatgggattgttgttttcttgctaattcgtttgagtttgttgtagattctggatattagtgctttgtcagatgaatcttctggcctccattgtttttgatgagaaccctgcagtcattcaaattattatttctctatgggaaatacattgcttttctctgcttgctttcaagatttttttctttggctttagttttcactagtttgattgtgattatctggatgaggatttgtttgttttatcctgttggtgatttgttgagattttcgaagctgtaagttatatcttttatgaaatttgaaaaattggaagtcgttatttattttttttgtgcaccacacactcttatctttctttgactctgatgacatgaatgttagaccttttggttttgtccttcatgtccttgagactctatttacttaaacaattttttcttgatgtcattcaaattgcatagtttctattgagctatcttcaaattcactgactgtttcctttgctgtctccattctgctgcaagctcactcagtgagctaaaactttttttaaaaatttattttattattaatttattaatggggtacaggtggtttttggtgacatggatgaattatatagcggtgaagtctgagattttggtgcacccgtcacctgaatggtgtacattgtacctaatgcatagattttgttcccttggtcctcttcccaccctcctgaatctccttctgaatctctaaagtccgttatatcactctgtatgcctttgcgtattcctagcttagctctcacttataagtgagaacatacagtgtttggttttccattccattatctcctagggggttggaatggtagaggtttcttaaagcttatctccttctcccatctcatgcactttttatttatttattttcccccagtattttatttactggtttgatggttcaggtttcaggccagtagaagaggtgtccctgagtaggaatcggttgtgggtraagcaagtgggtaaatgaagacccaggcttgacagaggtggctggaggagccctcggtgagtcacagtgaggtcttatcagggagaagggttggagccaccttagctcccctgcaaggtcagcagggacgttttccacttcttagatatgctcctgtcccagcgctctggctattcagatcagacaggcacctcttttcatctgtaggtgttggtgttccaaatagagaggaattgtgactgtttcttgtgcaagcctgatcctggagggtgctcctcttgtggggatgcagtcgccttgatgtgttccagaatggccgtctatagttgcatccatgtcgagctcctgtgggagaagtcccaactgtgcatatggtggtgaacaaggggggaaagactgcctcttctccaagatccttcccatgcaccaaagctgtctgactgttgcgatagagctgaaggctttccccgctgagcctakcacttcagctgcgcctctgctcaaggaagctttccaccagcggaaggatctgatgctcaaggcctgccatcccgattctttggtcccacagggtcttcccttgatggggcgcactccccctttccctatgagtgggagtccctgtgagccacgctactgtgaatgttgttgctcctctgggtctagctgcccagtgacgttgccaccctccaggctggtgttgggaaatgccagttgtgaatgccagtttcccagaagtgggtagcaacaccagctctactgggggtagcaggggagtgacgtagactctgaaattccttggttattggtagccatagtatgttggctttcttgaatgctagttatagtagtaatgagctggtcatgtggactcaggacctcctggttagccggagtgatgcaggcagtggtaatagctgagatcatagagcctccttcttcctgggtgcaatgttattctaccaggagatgctgtaatggactgtgctggttggcctccagccaggaggtggtgcttgcaaatgaacmccggctgcggtaggtgggtgtgtggggggggggggggggaggggcgtggtggtgggggcgtggagggaggaatactctggtttcacaggcaatagtcagggccacagagctctcaagagattctgtcctttgtgttaagctaccagggcaagtggcggggcaaagcgagatgggggctgcgtcggtcaggtttgtgctctgattctccgtgtgcagggcaagcagcagctcctgtgaatgttgggggatggagtgggtctcaggccactgggttgatgttcttctgcccccgctgcgcagaagagtttgtgcagagtggggagtagcaggcagcggtgagcccccaattcccatgcactcagtgaggcagatctactaccacagcttccactggcagcggcgagctgaattccagccagtctgtaatcggaacttgccacagttataagctttccccacgggagatcgcaattgtggttttcacgccacacccttccctgtcctgcaaagccggcacccgaggttcctgcacccgcggcttccgcactcacggccccctgcactcgcagcccacttttcactctcccacgcctggccctggccaagggagttggtccccacccaaggttatgtatatatatcatgaaacccctcgggagcttcgttcaacctgcgaccgccgtctaaactttttgcctgtcctccacgggggtcccctgtgaggaacagtaaggaacggctgccctcctgtgttgggatttgggagtgcacgcaagtgtcttctgccactgctcctatttttatattccgccaccctccccgagttggtccctttgctgggtggggttagggccttcctccgtgtcctgtactttcagggtccctggtgggggtgtgtatcccagaggcaaaaactcttcccctctcacactctgggactcacagtccttcacctgactcacagtgtagactgcagcctcctgcgtccttcaaagcgtccctgggttttcctgttcaatgactgcatcgcctcttgaaaaaagttcacaaagtgaatgtctctacactattttgtccttccacgtgggagaggcgtgccagcaatgcctctcatccgccatcttgacagaaacagttaaaaaaccttattgcatttttcagttctgaaatgttcatttggttctcctttatatttttctatttagttcctgaggtcttctaccttttcaacagtgtttgccccgacttggagtattttataacttctcttcatagtcatctatgtctcttcccatgtgaactgagattttcctgtcttcttatgatgagcaattttggattgtatcctaatattttgaatggtatgttatgagacaatcttgtttatgtcctgtggagaatgctggtatttttctgaagcattgacctggttgagttcagcccacgagttcgaatgagtcttccgcggtggtttcaattctagttctgttttccaggcctttgcaatgctatttggatctagcccatgcatgtgccacccagttaggaacctggatgggaccctatctctgaattcagctctcagtctttagtagtttggtccgtgatctaatctctgtttgtgcagtttaggaatgagcccctgagcttataaacaatattttggggtttccttcctgagctcctctctccctgtgatctcctctgtgcttttcagtttcctggcattttcctttttggtccttcagccagaaatttagggcctaatttagcctaccttgctgtacacttcttgcatctgtgccctcattcggggtcaagtgataagaggaaagagagaggaaaaaaaatccacggaggtgttccccgcgctcttgggaccacacttcttctgattggagaggaagattccccttcttcagactgcacgtgcttatcggcccccgctgctgttgtcatttccaggagacccctttatcactcccttatcccagaactgagggctttccctaaagcttgatctgtccatgctgacttgcacctctaggttttaggctgccttgaagtcagtctaggagttctgcagggaaaatctagtaagctgattactagttttccttctgctttcactccaacccccgtgatactgctgcttcacgcattctgcccaggtcttcattgttacattcagtggcagagaggaaccagcatatctgcctttaaaaaaatactacaaattataaagcatgcttgtttcaacctgacactgttgcttttggtttctttacatattaccacgttcttggcatctcagataacttttatagtattatttttccttttctttctgagcacattaccaaaagtttttgtgaggcaggtctttctttagaagtaaattttctcattaaaaaatgattgaaaccattttttttagagttctgctgagttcacatttcttggttgaccrataatttttttcaatacaccgaagacctgattctgttattttctggcttccgttgttgttgggagttttgttgttgtgctaattctggttcctttgtaggtgatctttccttcctttttgcctgtattccagattatcttttgatctgcggtgttctgaagtttcactctgatgtgtctagttatagatttatgttcattttttctgcttgggatgtaccagtctgtggggtttgatgtgaagcctgcagaactgtgtaccagttaacyctcttttcttcataaattatccagcctcaagtatttctctatagcaatgcaaaaatggcctaatccaccttctttgtgtctttttacagtttttgacttgaagtttattttatctaagtgtaacttctcttactcctttttggtttccacttgcatagaatatctttttctattcctttagtttcagcctatgtgcatctttatgaagtgagtttcttgtaggcaaaatatagttggatcttgttttttttttaatccattcagccactctgtctttaatttggaaatttagtcaatttaatgttattattgataggtaagaacttactattgatattacatagttgttttctggtcattttgcaactcctctctcccttactttcttttttactgtctacctttgtgcttaagtgattttctctggtagtatgttttaatttccttgctttttatttttagtgtagctattataggtgtttgctttgtggctattgtaaggcttacagaaaacatcttataacacattattttaaacttaaccagttgtcatttaagatgaaaattaactttagtcacaaagaaaaggagaaaaactgaagaaaactttacactttaactccatctccctacattttgacttttcattgtctcaactcacattttttataatgcctatctcttaattttcaaactagagacaggagtagcttacacatcactattgcagtattagagtatttgtctatttgtctatgtacttgcttttaccagtgagttttatacatttagatgttttcttgttacatgttaggatccttttctttcagaatgaagagctccctctagcgtttcttataggatagatccgctgatgatcaaccttgtcagtttcatttgtctgggaaagtctttatctctttcatgtttcatggatagtttcttggatatagtattcatgactgaaagtttttttcctgccagttgtggtggctcatacttgtaatcccagcactttggaaagccaaggcaggaggaaaacttaagttcaggagttcaagaccagcttgggcaacattgggagaccttgtctctataaaaattgaaaattaaccaggcttggtagctcatacccgtagtcccaactactcgggaggctgaagtgggaggagcacttgggcttcaggaaaatagaggctgcagtgagccatgattgtgccactgcactccagtctgggtgacaaagtgagactctgtctcaaaaaaaaaaaaaaaaaaaaaagtttttttctttgcattttgaatatgtttcccattctgccttggcctgtatggcttctgatgaaaagtctgttgccagacaaatcagagctcctttacatgttatcatgttattgtcttcttttctcttgttgcttttaggatcctttctttgttcttttttttttttttttttttttgagatggagtctcgatctcggctcactgcaacctccacctcctgggttgaagcagttcttctgcctcagcctcctgagtagctgagattacaggtatgtgccatcatgcccagctaactttttttttgtatttttagttaaagatggggtttcaccatgttggtcaggttggtcctgaactcctgacctcatgatccacccaccttggcctcccaaagtgctgggaytacaggtgtgagccaccgcgcctggccatttctttgttcttgacccttgagagtgcgattattatatgctttggggtggtcttatttggatctgaatctatttggtgatatttgaacttcctgtacctgtatatttatttctttctctaggtttaraaagttttctgctattatttcttggaataactttctacaccttgctatttctcaactccctctcaaattccaatgactcctacatttgctctttggaggcttttccctagatctagtaggtgtttttaatttcttttcattctttttttcttttctgtgtgcattcaaacaaacagtctgagccttaacatgcaaattgctgctccaagatggcctactagatgcagccagtagaaacatctcccagtgagggaccaagacatcaggaagactggtgcactcctagcagatcttcagagggaaggcattgagagtggacagagggaaggcacagaggctgggctgaaggggaggaagctgggaaccctgaacagggatactgcacaccaggactcattctggcccccactgattcctgtggaaggggtgagtctaacaggcaaggagcagcccaccctcaccatgggcctccagaatcccaacaagaggagagctctcaaccaccagatatacttgagttggcaggaagagatgtctagagaaggggtaggggcagaaatcctgctggtgcagagcccagagagttcggtgcaacaatgtctgtactggagtacagccagggaaacccatgtccctaggcttgacttgctcccataggacactttagccctaggggcacagtcagacctgaactctgaagggtggtgttgcccatgagacaggaccagtttgacctcagcatcccttggtctgctggcgtctcacagagccccagcctggctgcacctgcctgcagtgcagctcccagatacctccttgggggcccacatcatagctcctgtgctggtggaccatgcctgaccaatatatggatccagcagagcagccttcacagatatgcaccaggctacccttgccctcccttaactatagcctcccccatgcagctttctctgtacacactcacctgtggccacccacattgctttgccactgcatgtgtttacaggcaaactttgcctttccttccccaccagtgcacatgtgtgcacaccctgccatgccactgctgctggcatgaatacactccgttctcctgcccctcaccatacctgtcagtgttggtgggcatggaacacaccagctctgctaccaacagtgccctggccctgtgccaaaactgcaactggcacaaagctaggcatggagaacagcgaatcccaccccttccctgagcagccaccaccaccgatgtgagcacacacacaactgcacacacagtcctgctcccaacaccaccctgtctccatgctaacaccaccgccacaaacacatgcatggtcactggcagaagacccttgtgccgcccaagccatgctacctcttttgctgctatgaatgcctgcatggaggctggtaccccagcacccactagcatcctgccgcagccaaggagcattcaccttaccatggtgccactgctgttgctgctggtaagtgcagatgaaaactaatccagtggccaccaccctatgagtaactggaactctagtaggaacgtaaacagatatagacactttgggaaacagtttggcagtttctacaaaagttaggcacacatataccatgtgaaccagtcatccccaagcaaattatttcccttatagatatttacccaacagaaataaaatcatatgcccatacaaagacttgttcacaaatgtccatagcagctgtattataatttatatatatgtcaatattttgactatcacaagagtcaaaaaccggaaacaactcaaatgtccatcagcaagtggcagatttttcttaagttgcagtatatacatatagtggaacactactcaacagaaaagaatagtgaactgtggacacaggtcacaacaaagataaatctcaaaataattttgccgagtgaaaaaagccaaataaaaaaccctgcatattttataattcaacttatataaaatttgaggaaatgcaaactaatttatagtgacaaaaagtagatcagtggttgcctggggtcataggtgcagaatgcagggaggaaggaaccataggaaggggtcataaaagggcacagggacactttcagagttgatggatatcatggtaggtagaaaatgtccatgtcctaatccccagcatttgtgaatgttttcttacatggtaaagagactttgcacatgtgatgaacaatcttgaggccaggggcggtggctcacgcctgtaatcctagcactttgggaggcccaggcgggtggactgcctgagctcaggagttygagaccagcctgggcaacatagtgaaaccccctctctactaaaatacaaaaaattagccaggtgtggtggcgggtgcctgtaatcccagctactctgggggctggggcaggagaatcgcttgaacccaggaggtggaggttgtagtgagtcgagatcacgccactgcactccagcctggcgacaaggtgagactctgtctcaaaaacaaacaaacaaaaaaaaccaactcaccagaaatatgttgctaaggagcaaataaaacatgtatccaaacacttccatatgagtttaaaatacttatgataaatcaagaaaagggcaaacatgtcttctagagctgggatacactcatctcctcccttagacaacagaactccaggtttgccagcctggattccaggacttacatcagcagcttcacaggttcttaggaccttggcctcacaccaagaattacacaatcagcttccctagacctgaggcctttagacttggattaagccatactaccagcatcccggagtctccagttcaccaatggcctgttgtgggacttctcagcttccataatcacatgagccaattcccataataacccccctcatatatgtgtatgtgtgtgtatatgtatctataaatctatatttatatatatatctgtgtgtgtaatctatatgtgtgtctctctatcctattgggtctgtctctctagagaactctagtacacaactattgcctgtttaataatgacaattcaggtagtagaagtacacacacatttaagaataaatttttaaaagatatcaataaaaatttggtgatgagagggaggaaatatctacaagccaatttcatcattgctcatactaagaaatattttaaatgaggagattaaggtctttatatcaaatagaaactataaagattattgctagatcaaaattataaaccttcttgaatagtctaactgcaataagaagccacagagtaaaacattataatttatatatataaaaaatcacatgaaaaacttaaaaatagagcatatcaatagatgtaaatgatgtaaatgaacatagcatgtattacaagaaaaatattttcatattagattacaaagaaaaacccaactgtctactatacacaaaaggtacatttaaaataaactaattctggaagttgaaaataaaaggatgggcaaatgtataacagacaaaaaaagtatcactcataatcttaaaattagatattataggccaggcaccgtggctgacacctgtaatcccagcactttgggaggccaaagcaggcagatcacgaggtcaagagatcgagaccatcctggtcaacatggtgaaaacccgtctctactaaaaatacaaaaattagctgggtgtggtcgtgtgcgcctgtagtcccagctacttgggaggctgaggcaggagaattgcttgcttgaacccgggaggcggaggttgcagtgagccgagatcatgccattgcactccagcctggtgacagagcaagactccatctcaaaaaaaaaaaaaaattagacattatagaattcagagcagaaagcaaggctacgtgtttttttttttttttttttttgagatggaatctcgctctgtcgcccaggctggagtatagtggcgtgatctcagctcactgcaacctccgcctctcgggtttgaagcaattctcctgcctcagcctcccgagtaactgggactacaggcacgtgccaccatgccaagctaatttttgtatttttagtagagacggggtttcaccgtgttggccaggatggtctcgatctcttaacctcgtgatctgcccgcctcggcctcccatagtgctgggatcacaggcatgagccaccacgcccagccttttgaaggctagagggaataattcacaataaaaatataacaataatccatatcaatataaaataacaatagcaatttttatggtagagaaaataaaagagatttacaaacaaacactgactttgattatgccaactgtttcctgccagggattctgattgctatgtgtgtgtcccataaaaatatcacacatgtcatcttttatgttctctcttattttgctacctaaatgttcttaagtatggtgaccacatgttaaatatgcagagccacaagatgaagggagcctgagtccctaacttagtgaaggaggactacgcaccaattaggaaccattgttttaaatttatcaggagtgaaacaaaagaacaactattgtctttgaaccattatttatttgggctgatttgttacagcagctgttaccttaacaatgtaccttctaatcaattaatgagaaacccagtcattctcctatgggcccttcccaaaagcctagagacagagtttccagcctatttgtttaaatattaagggtagcttgtgagtgaaaatcaggatgactttgggaaccagggactccctggaatgggtacctgcatggcagagaaccattaaggaaagtggacaaccaggagactatgatgtcatagaaagtaagagataaaagtatttaagcaaagtgaaagtggctgtgtcaaatgccaccaagaatccacatagactgctgttgactgtgataactatgatctatatctgaccagcagacttcctacccgttctggtaaagtatccaaataataaggtggtatggggaaaataggcatcccagtgacccagagttagtcaaggatagcctctttggccacatataagagacacagatgtagatctcctggagatgtgatgagaggccttggagatttctgtaagatttgtataatacaggacccttttgctaggtttggaaatttctctagtattcaaatatcttaaaacttcatgcagtatggaatcaggcaattctctggagcagtaaccaaagccagagatacaagcaacgaattgagccatacgggcatcagacttacccagaatgggatcaaytcctccagataccataaaagttgatgtgatattaaactgacaaatagaatcatcaaatataatcctttccgtatatttactgacatttggatgtccccatgagaaatgtatgtttaagtcttgagtatatttttttcttttttgagatggagtctcgctctgtcaccaggccggagtgcagtggcgcgatctcggctcactgcaacctctgcttcctgggttcaagcgattttcctgcctcagcctcccgagcagctgggattataggcacacatcaccatgcccagctaattattattwttttttttttggtagggacggggttttaccatgttggccaggatgatctcgatctcctgacctcatgatctgcctgcctcggcctcccaaagtgctgggattacaggcatgagccactgtgccaggccttttgtccattttttattgaactgcctatttcttcttactgatttgtagaaagtctttattctagtctggcaggtattttctttcaacacttccaagattattcattgtctctggcagctaatgtttcatttgagaaaatgctacctgtattattgatgcccatgtgaaagtaatgagatttttctccacattgaagatttctctttaatctgtggctgatgttgtctttgaaggattctcgaccatccctgtatctctctctctgtctctttctcacccactttgggttgggacctcaaagagctgcaccctagcagtaaaggtggggtggaaattcaggccttaaaggggttaaaacccagcatcaaataatcttagttcctgattgaattaaggtgatctgtgactgctagatcctcagtctagctctctgcacatcaaatattttctaaaggaaggtaagtctagttagaaagttagaccaacagacttaagctaggctttacagaactgataggttcgaagtacttctaatccaccgttgcctgaatgccatggcattttatcttttagttataatagttaactcttctcttctacaatgatatgtgatttattgtgtaatgttgcttttggctaattaaaaaaaaaaaaaactctgcctctgccctggagaagagaacatactaacaccattcattagcttagcagaaatttagagacaaccctgtgattttgaataaagatccctctatgggccagaaacgaatacaaaggacctgctgttaagccgctgtgaaatggaatgagagaaaaatgaagagatgaacttgaaactggggttctcagcctaatagaatcggcgcagctccagaactcaggatgctttcaatatcatttttacagacagctgctatattgccaaactccagaggacaccttccacatggaatacaacataaatggtaccctgtggagttttgtaatagcatgaccctacatgagtgcaggcggactagggagcgaaggaccaatcaaagccagaacactgagctttaatgattcccgaaggcaatttgagcctgttgtagaaataaggggaggtgatttcataagacatctagaggtgagcagtccacgtaggattaccacaaacatagattcagagatcacagtaagcctctcataggcacaggtgcctgaacagattatctgagtaaaagagtcgttatatcagaccctcctgagagatgaggtgggagaatttgaaagctggactgaggatatgactgtgctgtgcagagatggggacacttgctgaggaaacacacgaggatggggagtagattggggaggaaaatgggagtgaggtgacacatctagaaaatgggagagccgctgggtgyggtggctcacacctgtatgtaatcccagcactgtgggaggccgaggcgggtgggtcacctgaggtcaggagtttgagaccagcctgaccaatatgatgaaacctcatccctactaaaaatacaaaaattagccaggcttggtggcacatgcctgtaatctcagctatttgggaggctaaggcaggagaattgcttgaacctgggaggcggaggttgcggtaagccaagatcgtgccgctgcactccagcctgggcaacaagagtgaaactccatttcagaaaaaaagaaaaaagaaaaaagaaaatgagagagctcagggagacaacccagtcataggaagtgatgacagggcttccgtgacctgcatcatccagcttttcttcttacctttcaaactaggatcattctcacttcctggcttcattttcttttttctttttttgagacaagtttcgctccatcgcccaggctggagtgcagtggtgcgatctcggctcactgcaacctccaactcctgggttcaagcaattctcctgtctcagcctcccgagtagctgggactacaggcacgtgccaccacgcccagctaatttttgtacttttagtagagatggggtttcaccttgttggtcaggctggtcttgaactcctgacctcaggtgatccacctaagtcggcctcccaaagtgctgggattacaggcatgagccaccgttcctggcctcatgttcttttttatatccctaattcttgttagggccaaggacaccttggccctctgcctcttctttttcccttgttcataaattcagctcctaagtcatccaaactgtagaactcacctccatttttttttttttctcttgagacggagtttctctctgtcgcccaggctggagtgcagtggctcgatctcggctcactgcaagctccgcctcccggttcacgccattctcatgcctcagcctcccgccaccacgcccggctaattttttgtattttttttaagtagagacggggtttcaccatgttagccaggatggtctccatctcctgacctcgtgatccgcccaccttggccttccaaagtgctgggattacaggcgtgagccaccgcgcccagccagaactcacctcctttcttttttcagttcagcctctccaattacctgtttaatttcttcccataagaaccacagtattacatcaaacttaaacaaccttccttctgaatctttgtatttctcgccagttgtgccgcaactgaaaacctcagcgtgacctctgcctcttcctcatcccctccctctcttctgactctccttgctaccattccatgcaaccacaaaaacttctagcaaccaagtcagattctgtgagtctatggtctgtggctatcttaaaattctttcgtcatctactgaaaaaagtcatatgatggacggaagcaatacacagaacaggacgggacattagaaggttgagggcatcagtaggtgaatctggatggctcacacatgtctatttctaccgtattaaccgtattgtatatgttccttttaaaaatatatgggacataagtaatttgaatgcataagattctttaaaagactcaaagaatctttatctctcctttttttcccattacatcagatccatccgaggctttcattggcctctagattttatgatcagtcttttaactgttattgctatgaccacaatcctgggctttgcttccttctagcaaatggaatctgactctgctgcattttggtcccaggtcatttctgcccttatctctccaaccttcattttcctgttataagatggtgatagtgataccaacctcacagagaagttgtgaggataaatttttttttttttgagaccgagtttcactctttgytgtataggctggagtgcaatggtgcaatctcggctcactgcaacctctgcctcctgggttcaagtgattctcctgcctcagcctcccaagtagctgggattacaggcacctgccaccacacctggctagttttgtatttttagtagagaaggggtttcaccaagtcggtcaggctggtctcgaactcccaacctcagatgatctgcccccctgggcctcccaaagtgctgggattacgggcatgagccactgtgcccggtgtgataaattgagattatatatttaaaatttctaacatagagtctggcctactagttccttctttatccatttatctccagtatctaggactgtgggctagatggtatgttttaaggatgcaaggatagagcatgatgagaagagggtttatcaagagtcctgggacaggactgagaggaaggctgggatgcagctggggagggatcatgcaggagggctgtgctgggagttgcaccagaggcgttgctgcaggtagcctaagggatggcttattgaggattcagagaggcctcaagccaaaaacccttgtcaagagccaggtttcttagccccagtggactcagtcatccagaacacttgtcatttaacttagagaggttccaagatacccttggaaaaagcattgattgctagaaaaaattttcattccaggaaaacttttctttccttctttggaatctgaataaaggggcaggaaacaaagcaaggtctctcctcccaccttccaccaccacacatataatccgttttgttatttaatcatatatttttacttgtatctaagccaggtcctttggcaatgaggaggtgtgcagggatcggggtgaggaagtgcaggactggatggacatttaaggtagggcagctttgggggatgccacttccaaatgcaatggggaccatcactgtgtattccccatagttgtgtggtgagcagctctggataccctgaccacaaagctttggggacaatttgttcaccagaggatgtgaggaggacggaatactcaaaggcactcasggatggtggagctttggagctgaggcgggcaaggcctctcagatggtcacgctgttctctaccatgctgggtcaaaggtactcacagggcaggtccaggactgcattccggacctcaatctccttgtccatggaagccagttcctcctggaattgtctcagcacagcttggggctcaggaccagagaaatatttctcctcatgctgagaggcagaagacaagttggctcagccccttgggactctcagcccrgaatacttcccctcctttgagctgcctccttcccaggacccaggcatttgcttctcaccatgacaggctggcgtctgccaaggaactttgtgaaggtcttttgcatacgtgcctggtggagattgggcagtaagtccactakatccttctctgtcacatccttagagaygggygggggcttctgcatggtgcatgggccattagggatccaggrgtaccagtccagctgcagggaggagagcccagagaaatgcaggctgatgacctgggcatttgatcccccacttctccatcccaggagccsttgtgggatgatcacatrggttacctggcccaggtggttagaagcatgctgacctgtgcatgtgaagatgcacatggtgacaaagtggcagagctgagcccgggactctaaggagatgaggaacctggtgaaatgagaatcctggtgaaatgagaatcagagatctcgaaaccagaacacgaaataggtctcasgcagggaaagctatgtggagatacagaaaagaacttttctgtggttctggcctgcacaccctaggactcccaccttgtgtgtgctcaaaggttaatgcacktgggatgaaccttgagctatggggagaggggagggaagagtgagggaaaatacctaagagaagttttgtatctagttccagaggaagctcttagtgcagaggagagagaacactgtgtaggaacagggctggggagatcaggagtgcttgttagcatttctggacacactctggagaattctcagcttccttgggcaggtggggtgtctcatgatgatgtgagaagaagcagattgtttgcagrggagtrggtgttgacagggttcagtggggarggatccatgtctcacccctggtcttgggcyctctgcagtccagtctcagtcatctctctgcaccaggyctgcagctctagatcatccttcatggcttggtcactattgtagaaaagcccaaccatcccctccaygtacctattccctgggaagaagacactcagtctcaggggccaatgcaggaccttctggacctacagtcccccgcccctccgttcattgcctctctgtgccaccttcacctaccggctgatgattccccacagcctgatggcatcttagccataaaaagaagatttcacatccaggagcccacggtcagccaggtcatcaggaggacagagggaatgataggtcaaacaagccatggctctctgaagaatgtccacgtggcttccactaccagtgctcaccacctgaggataacccacagccatgccaagttgcagagggagggagatgagtatcaggaaactccaggcctatgatcctactctagcccttttaagcaggaagctcttcaggcatgaggcaggtttgggagaggccttccatggaggaaggagagcttgggggaggaatgggaaagggaaacaacccctaggattcttccaatattgaaccatcctccccttcacccatccatttccataccaggtcaaaaattccccattcggagacaagactactctgggccagcgtgttgatcgccatggtgtagcggaagtgggggatcaggagctgattatggaagaaagaaatgggacatggtcaaataagagagttcccagcatccatgagggaagaggatgttaaaggaagtgacagaaaagaagggagaggatgggtctttatgaaatggagagacttctcgttaaattggagtgggtcagggtaacatttgggaatatagagatgggaaaatgtcttctcagagcatcccgtggtgaaagttttaggagttcacttatttccacagtttcatgtccttggaagaattctaaaaatcccatatcctcgcaggtacccacatatgagcccatccctttttgccttcaccctcctataattatattccttctcctctctctgtcatacaaacatgtgcaatattggataccctaaagaaaacctgtgcttgacccccacatccttgtcttgccatctccctgtttcttgctttccctttcacagcaaatcttcactcagtgttgtctttgcttacccacctcacatttgctgctcacccccatgaatcaggcttcctccacttccctgagatggcgcatgtccatttattaaccaatgacttccatattgagaaatccaaatgtcacttctctgtaactttcttgatctctcagcagcacttgagacagataatcacgcgtccctcttgaaacgctttcttttcctggctgccatggattgcactttttgattttcctcctacctcaatgaggttccttctcttgtttcttttctcactctgctcccttctctcagtctgtaaatgttggttcaccctagagttatatctcggtcaaattctctacaaaccctagagaacttcatccagtacaatgactttgatacttttgttttctaatgactctaaaatctgtattttcaacctacacctcttctaggaactccagactcacatatccagttgccctcctgacatgtgcaaatgggtctttataggcattggaagccccacatggtcagaaaataactcttgattcttctccccgctaagtaacatggcttcttctctcatctcctcccacttcttcttcctcctcatcccaactcatgccctacactttaatctcacccaatctcagccattatccatgttcccttctttcctcgcctctttagatctttgtggctgtaatgttccacccctcacttgcccacctggaaacctcctcagccaaaatttcaactcctttgcaaaacctattctcacttctccccccaactcatagtaagtgtgtgtcctgggtgtttccatattactgtgtatgtgtacgcgtgtgtgtatgtatctgtgtatgtgtctccacatataaattgattgctgctagactgaaatgtacaaggttagactctttgtaggagtctgaaatatgaaggacagtcagatacagaatgacagagatgctgaagtaccttgtagataggatggaggctaggcaagcttctcattgtagccacagcaataacctcagcaatcaagtgtcccctcagcagatgtgactgtaactgctgcagctggaaatcagagctccggacccaggtcttggccaggagccaggccatggggggatgcgagggcagaaagagcagaggtgggggacatccgtgtcaaggtggctggagctagagcaggagagagagtgggggctgagaacttgtgtatctaagtccctaaaggagatcagtgtctggtagaaaaatacctgggccctctcacctggatgaccatgggtaagagtcctccatcaggctgaagcttcagcatgaccaaaggggctgccacgcattgctgcttaaaaatgatgacattaggcttgactccatccagcaaggagaaatccacttcaaacagagatccagcctacagggccaggggcaggaatagaaaacagggttggagttgtttctggagctgcccttctctcattttccagggtggatccttcctctacccacccaagtcttttttactttaaacaccaatcactttctgcagaaccaaaaaactgaatgcaaagttttcatgactgatgtcttccttcagacttggagctccctgcagcgaagtttctggttttccaccacataaggccactgcattcttcacgtatcccctcttctgccagctttagccaatgtagcaaaaatatttcctttagctacccatctccccccaaaaacagattcagcttttagctctccaaggctttgtttagtttttcttgctatttctctccagaagcttgcgcttttccctaaggctgatatatgttcaatgaagaaggaagagaggaatgtggagaaagaaaagaagatacaggaggagatgttgtagatcaatgttctcaatcaggggcaattcctcctctccccaaccccaggacattcagcactatctagacacatttttggttgtcacaaccggggggatgctgctggcatcaatgggtagaggccaggaatgctactaaacaccctacgatccacaggaaagccccccccccccccccccgccagccaacagagaattatgtggtgcagaatgttaatagtgccaacgttgagaaaccttgggtgtagatggaggagatgagagaaggggctggagatgggaggagaagggaggtgggggtaatggctgggatggtggatgggcagaaagcccagcagcacctggagttctttctccagctgggtcttcaagtcttccatccctggaggcagcaccaggcaggctgggagccttgaagaacacctcaggagcatggggtttgcaccattgagaaactggtacccaaagaaggcatcattcttccaagaatcataaacccgctctaggaacatcaattggggagcaccctgtgagctctgagctccgaactcctaatcccactgatctaatcctccatccccctcctttttcaaatccctgggttggaagtctgtatattggttttgggaggttgtgaaaactgaccagccaggacagtctttccatgtgggaatatttttttgaaatcttccagccttttcacacaatttatgaaatccagtgtccccttaatggccaagtccttcaacctgtggaaagaatggagtgcaagaagatcaaggaagcatcccaccttgtgccctaggaagcaagtgcccagcctctacctggtactcacccttttgctagggagacattaaagtctaaatccttatcctcgaggaatcgctcgtccctaggaaggtccggttgcctattccctgctataggcaggattaacccatctttccaggagccccacctggaggaagaacacacaggtaggggtaaggaggcaggtggcaggtttcttgggatctggtaggggatcaaagacttcctggggctcaacggtacaccttccttctttcctcgagctcctgttcccgatatttcttaaacaggttctgggggtcatcactcacggtccgggctgggggagagggacaagagcacatgccctccctggtcacccctccgcgctcgggtctccccatcagccaccctcccccttcacttctccccatctccctcatctctcattttccctcttttacagtagcctccccccacccgcttcttcctccagcctgccaggggctgtgccccttctccaccgagctcaccagtaccctcaggcaggcagataattccgtggccctgcacccagcggtagcaggggaaaaaggcctcgccttgggtccccgggccctgcactgagatccacttgcagaaccagtcgagactcaacagcacgttgtgtttgcgcagcttcaccatcaggaggcgccccaggtgcagggggacgtcgatctcaaactctgcctcctgcgcgacagtacacagctcaggttttggggtcttcagggaggacggcggggtcggtgaaccttcagagaatcctggctccgtttcccctccacagcacagccggggagaggtggaggtgaggaggagcagctggtactgcggggcgccagcctccccccgggcctgccgtgcccaccccagcgggcgtctctgtccttccgctcgggcaggaaaatgcctctcatctctcctgttcctctcgcttttcctatcaggcgcaccaagtgcacccgacctcagcccctaccccgcttcccaggtttctcatgggtggggcagcagcaccctccgaatggccccggcccccagtgacacctctgagtcccagggccccagctctcaccgcagtccgcgctcacctttccccacaccggtggcagctgcttccctaggtctgcctccccgtgctcgcccaccagccatagctgcaccaggttgggagagcccgccaggagcaaatccccggtggctacgcggaccgtgtacttgcccatcttgcccggagatccggggagaaatcagctttaaaaggatctgagacccagctcccagggaaccacgcccagcccagagtggctgttgtatttgggtttcaggctccccacctcccacccacagattcctccccgactaggaggaacgctgggactggcgccaggctagggtctctgtatccagagtttctcccggcggctctggaaagggcagcctcacccttattcacttggcaaacactccctgatgccagtttcacaccctgccatgagccaaacacagcagcctacggacgatgacagctaaacactagctcccacccaattttggtgaatacataaataagattgccacggaagtgaaatggcttgatcataggggtatttttcaatggaaagttgacactccccagacactcctgctcacccacggctcgcctctctcctggacctcctgggctatcgtgaacagaagggcttgaacagcccttccacctcctcatgttgaaagagaaataaagggccattgtgttttcattgaatgggggtccataataagagctcttctaggtctttcttgcataagctacatccagatgagttgacatttatttgaaataaatgtctagaacctaaaggttcttgtggggaaaaaaactaaatgcagcctctatttagatctttacagttttctcaaaaccttttatagttgtatggctgactcctagtcatcaaattgacagtgacttttaaaagattattgtttatgtagtcataaaatattcaacttatttttaaaaaatactggtatgtttatactcctatttcattagtttgtctataaatttcatcattacaataacaaatataactgatataaacagtttttttttcttttgagacagtcttgctctgttacccaggctggagtgcagtggcatgatctcggctcactgccacctccgcctcctgggttcaagcgattctcatgcctcagcctcctgagtagctgggattacaggcgcccgctaccacgcctggctaatttcttttttgtatttttagtagagatggggtttcaccacgttggccaggctggtctcaaactcctgacctcaagtcatctacccacatcaccctcccaaagtgctgggattacaggcgtgagccactgtgcctgccataaacagttttggaagtttacacaactattcttgataaacataaagctcaactggtggacatcaaagtgccgggcaggtcagtttttttttttggaggagatggacagtgtcagtctcctgataagttggtgatgggtaggtaatttaaaagcttctattataaaatctagtctctctgacactgccctgtccactgcagtcacatctcccaatactgaagaatcctgagaatacgagcggtcatgacacttactcacgtcattcaccagtaaaaccctctatccttcctcctcaaaatcaggaatgctctcctatcctccccattgacccccacccctcacaagcttcacctccactctgtgccctaccattatcctctagagcctcaacttctctttgaagaagatccttctaacattttggcaacatattccctccacttaacctctaattcccattttcagtttcagtcaccgaccagtgcaataacagcttagacttcatttgtcacttaaaactcacctatagtatattacccattttgtggtttatccactcagcccatgagccactctccccttcctgaaggttctgactggagagagaagaaagagagagaacaattgagtttctgagggttttccaggtcctgtgaaatccagctcaattctcttccttgggtt

SEQ ID NO: 17886 - DNA, 54016 bp, Homo sapiens
  misc_feature (1)...(54016): n = A,T,C or G, or insertion/deletion polymorphism (see Tables 1-2)
ctcctcccaacacctttcttctcctcctacccctccaggggctggggccgccacctgctggcactcctgggtactgctggaggactcgccgtactgttgccttgtctcagtaatgcccggatgccactgattatcctagggaaacagaggggtagggaagggtggcagtccccaggacacagacacttaggtagtagaggggatgctagaaccagaggcccagggcatagatgtccttatcagagaagcactgtgtctgacccaccgtgctgaggagggtacagaggccagggaaggaaaaaggccatactgtgagtcaagtggccaggcacaggctgggacacagaagcccaaactccctgttgagatgcattcctgcagcctctcaggtggataaagagttgggggcagcacggagtacgggtgtgtgtgtgtgcagtgttcagtccatgatcggccactgcagcctccacactcgtcccatgcctccctcctgccccctttcgtccatcctccacagtgcacttgggtgacctggtctcatcagtcccctgtttaaaatcctgcagtggcccctactgaccctcaggataaaagtcagactccctcgagcccacaaagccctgatgcctggccactgaccacctctccaatcttccatcccactgccggctctctgcctcaaccattcttttctctttgttcgaacccatcaagatctctctggcctccaagcttttgcagatgcttttccccctgcctcgaacactgttcctactcctgaatgtgtgtggcctcacaggcctgcttcctccccacagaagccctattgtacctgaacaagaactcccatccacccagctcattattctctttgtctctttcatcacactcatcacaatttgatattattaatttgtggtttcctcggtgtttgcttgtgaactctgtgaggacaggaggacagggcacatagtaggtcctcaattaacttctatcgcatggatggatggttggaggaacagttatcttagtgataactgggtgttagatggagaggccccaccctaggcctgctgtgtgccctcaaaaaagttctggtgctctccagaccttaggagccagtgtattcagtgagggtgagggccctgctcttctggggatctatgagccatctgcgtgtaccagatggacacactcaagttgcccacggtcctggggctgagagggaggccagcaagggggcaaggagaggctgaatgggcagtgtcttgaagcctttatctcctgggaccctggcagacctcggtggctacagtctggctcagtaagacagtcctaagaatctagggagggaatgtggcccaaggcccctgctggtcttttgcccactcagaaagccactacactgagtgtccaggaggtagggggacagttcccactctgtgcctctctggctccccagccacaggcacaaggatctacgtgctctgctcagggcatgcatgggtggaaggacactgagctggggatcaggagtcctgtattctagcttccctcagccccaccgtgaacctcagacaagtcccctccactctctgggcctcagtgtccatgccagcagaagggacatatcttagggtcctgacgtctaagatgactgtgtgagcgcctggggtatgtgtgctgcttcctcatcaccccccacccccaccccacaactctgcctggggagcctgggagtgggggcagagccaggagcgtgggagagccagatgtggtggccgctgccctgcctgagtgagggctgagcggcctcctgggaattctcccactcaggctccctttccggttccctccccctgccccactgagagcagcaacttccggctctgacaagcgtgggtgggggaggggggtcttagcacgggggtctgttcagcctggttccctcctctggggaagagcatgggcttatgagtctagacagaaagcctcggttccagtcccagtctgtggctgacacatcacaaggccttgcacaagttcctttccatcactggcctcagtcataccggctgtgtaatgagcatgttggtgagcttccctccagccctgatggtggacttctatgacagcagctcttggtaacacctgaggatcagtcacctttttttttttttttgagatggagtttcactcttgttgcccagactggagtgcaatggcgccatctcagctcaccacaacgtctgcctcccgggttcaagcaattctctggcctcagcctcccgagtagctgggattacaggcatgcaccaccacacccagctaattttgtatttttagtggagactgggtttctccatgttggccaggctggtctcaaactcctgacctcaggtgatccacccaccttggcctcccaaagtgctgggattatagacgtgagccaccgcgcccagctggatcagtcaccttttgtggcactttcttgttttgctcgaggcttgacaaaatgcctgtgggcatggcttattcaggtctctccacaaccctgtgaggtaggcacatgtgtccccatttcacagttgaaggtactgaggctcagagagctcaggtcatatcatctcccagcgtcacatggctgggaagtggtggagctgggttggagctgccaacatcagagtccagacatttaactcttgagtgtgccaccgtgctgtgggggaaggcagtgtggaaccctaaggcccagagcccccctctcccactgtaccccatcccagtccacttcaggcagggctccccacattccatgctctgcccacctactctcagcccaggcttccccaagacagcattgtccaaggctggactgggttcccagtatctgtgtaggtgtgaggatgttcatagcttgtcctgtccacagtggggctgggggccatgctgaccaccccagggtgatggtgctgcactgcccatgtgccccgtccattgccgctgaaggcagagtgcacaaggggaatccaagacccagaaaagggaggctccgcccaggaagacacagtgatggaatgctgctcgaatgaggaaactcactatttcagtaatagtgtacacttagtacacttcgaggcaatgtactaagtcctttgtacaaaccgaagagtcttatgaatcagtctttgacttgtctccattttccagaggaggaaaccaaggccaggagtttaagtgacttgcctaagctcatgtagcttgaaactggagcagctgggattcgaacccagctctatctctagctctccaacctcctctgtcaatcatgacaattttgccccttggtgagtgccctgggttgctccctgtagctctgcacctcccacccatatctcagttgagaggaggagtgacagtcctggtgcccaccaagggttaatggcagtaggggctaagtaattccagatgggcctcaggacggctgggctggccggaaactggaggccgccagcttcccaggggagccaccgccaactgcccctcccctttgtgctgcatctctggccccagctgtacccctgccctagggcccaccagcctcctctcccttgctagagtccagctctaagggaaattgcagacggaccatcccaagggccttgtagcacagtgagtccacaactgttatgtacaaatagggaaaccgaggctcaggcagggcaagggacttattcaagttctcctgataagtctgtggctgggtcttctgactcccagactagcttctttggggactagggggttggtgtgtctcgtggcctcccccaggctggcctggctgcagagggtcagccaaggattcagaggtgaatggcccaggcagatgctaggaggggagtcgtaaatttctgacggaatctttgggcacaagaaatccctgtgcaagcctgaccttgtggcctgtgggatcttttcacattcccctatttccctgttgccacaaagacctggccaggccccctctctcggggtactcttatggtccccaacccgtggctgggaaccagtctgagaacacttctccttctatgtggtccagcccagatgctctgctgggcaatcccgattgggactagaccaagaaatgcaagatagttgactgtggtgggcatggaatcccagctcacgcaaatcctctgctctgtgaacaggggtctgggggaagctgaggaggaaagacttagcggcgcagagggaaggagggcagagccagcctctacctgtgtcacctgggacagctttcttcaccctctggaattcagttgccctgtgggtgcagtagtgggagcaggggtggtaagcccactctatatgcccttctaaaataatgccctttgccatctgagggctaggagtctgtaactggagatgtcttctgatctgagaagctgagggtggaagaagagacccagctgggggaactggaggagtcttggcagaccctggtaggaaaggagagccagagaatggaaatggaacaaaacggatacttgaaagtatcttgttgaggctgggtgcggtggctcaagcctgtaatcccagcactttgggaggctgaggtgggtggatcatgaagtcaggggtttgagaccagcctggccaacatagtgaaacccggtctctacaaaaaatacaaaaatagccaggtgtggtggtgtgcgcctgtaatcccagctacttgggagtctgaggcaggagagtcacttgaacctgggaggcggaggttgcagtgagcctagactgcgccattgcactccagcctgggagacagagcaagactccatctcaaaaaaaaaaaaaaaaaaaaaaaagaaagtatcttgttgagtgactgaatgaaagagccacagggggaacctaggaagaaagcagggcagggggttcatctacactggaataggggtctcgggtgggggtcagatgacttgtgtctcttccatcatgtgtctcatgagacctagttctgccccagctctgccattgctgcgtaagcttgggaagcttattttgctcctctgggcctcagtgtccccatctataaaatggggcaaataatcctctccttgcaccccaggggctttgagacgtgaaaaggaatgtatctgtcaatatccagagatatccaatctgtgctggatgaccttgaccaaatcacattccctctctgtgccaattcacccctgggccttggtttgtccttctgaaaaacggctgatcatcttggaggatctttccatctcctccatgtcacctcttctcagcagtgctctctgattctctcaggcttccgttaggggtccttctaaatgcactctcagcctcctgtctgccgaccgggcacctgcttgcccaatgaatatcttgctcactagcctggtgcttctgaggtcaggaccacgtcttgctactgtcccctgcacccagtacagtgttagaatgtagtaaatgctcagtatgcttgttcaatgaatgaaggttgactgaatcaaccacagagatgatcagagtctcctttacagatggggaaactgaggcactgagaaatgatctccctgggtgccatggcaaggggaggccgccacccgacatgggcatcgggaaagtggggccgaggccactctttgacaaaagtgactcagcagctggcggctggcgtgggctgtggaatttctaagcatcccctcacatcctgagcgaacgggcgatgggagggagtaagcagagggaaaagaagaaaaacaagaaacttgggggaaaagaaagagagagggggaaaaaaactgaaattgaaaacagacgcacgcgtccaccctccctgccccgccgcccccccttctcccagctgggccaatcagaagccaccctgcagcctttcccccaaagtggcgggggaagtgggggggcatggaagcccatagtggtgtgagctcctgaggctgccagcagccagcagtgactgcccgccctatctgggacccaggatcgctctgtgagcaacttggagccagagaggagatcaacaaggaggaggagagagcyggcccctcagccctgctgcccagcagcagcctgtgctcgccctgcccaacgcagayagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaaaaaaaaaaaaaaaaaaagggaagatatttttaacaaaacaagatgagaggaggctgggagactgtgggtgatgtcagggatggaggagccagttttctcctttcccctgctctggggtgagtggcctccacctcatcatccctgctgytcctgccttcatcaaacaatcctcaggggtttctgggtgctgactgggggcctccaaagcacagcacagtcaatggggagtggggagagctgggaagagcgggagaggggaattgggagaaggtaggcagggtacacagaaagcaggggactggggacctcaggaccatagccgctgttccttggcccaagccttgtttctaagaatcagtctggctttaggccagtcagccgccaggcaacctctggggatttaaatggatttgcaaattttctagattcttaagatatccttctaaacccccagcagctagaaaagtttgagggctaggaaagttcgagggtgatgggcggccatggcaaccccctagcggtcatgctgctgggtctgggggctgggacctggctgtcagatctgggggctcctctgtgaagaaggggtcagccactgggccatttcctttggtcccaggcagctgctcaggcctcctcgttgtctccctccttctggactctaccccttctccatgccattctaaagcataaatccaatcacaccacctccctgcccaggatccgcctatggctccccagtgcctggagaaagtcccarctcctaacagaggctgccactgcttgacacttactgcacgccgcaactgtgctgagtgctttatgagactgatctcatgtaatgctcaccagcaaccccagaggcagtgactgtttttacctccgttttatacatgaggaamttgaggctcacgcagccacmtaactgtagccacacagctagtaagtggcacagcctggagaggttggaatctccccgtgccccattactccaaacttgggccttttgttcccgccagtcagatcccaraattcccagaaggaatgcgcaccatcctgcttgtgggcatttgccctccctcttccccctttctggaatgcccttcctcatcacttttctttcagggatattccatacaccacctcttccaggcagccttcctaggttcttcctgtcttccaagtgctagccatgcactttgtgctgaagccatgttacttggccctcccctgttggtgatctgtttatgttctgtttgttcatcagagattgttcaggccccagcagtcagaactgaggccgcactttctgctggggaaaggtttaaggtttccccatcctgtgctcttcccccagtgcccagccctggataggcagtgcggctgaaaaaatgtcctggtgaaagggaggaggagctcactgaagaccttctgctcccaagtgtgagactagaacccaggcctccagccttctcacaggtgcccttccaggacatcgtgtggctactccaggcagcattcctccattgcaagcagggaggagtatctctgcttccctctgtgacctcccaattgcacagaggcctctagtgacaagttctgaagtcatgcagtcctcccctgtctccaagcaggagaccctgaatccacagccttcagggacatacagtccctgaacacctacctcatgcaggcatagagcctggtacttcacacaccttggagtcctcatggcaagtttttgaaatcagtgttattacctactttttgtagatgaggaagctgagatctggagaggctaagtgactttcccagggccatacggtgagttaaggtggtgtttaggctgaagtctgcctgactctaaaggcttacctcgtgctccccgggaagctcccagtcagagggaagaatctccatcctcctgcagagcctgctcctggcttcagcaccttccccagcagaaagtgcagcctcaggtctgactgctccaaggtctgcccgggccctggcttggtcttgagagaggaaagagaccatctggtcagcaccctcctcccagacagcagttatcagcagcccccctcctctgcgggaagaagagctgggacttataattgcccacacatgtggggcaggcagtggaaagcaccgtggatccagagtcaggagacccagtgcttgccctggctygatttaaatccaccgtgtggccaacctcagaccccccacatcccatctctgggctccttccgcagctgggaggcagtgagcgctgtgggtaaccagcaccaggcttgggcatcagatgactatgcattgaccccgagtcagtttctggctgactgtgtgaccccggggcagcaccttgcctctctgggcctcaatctccttctctgtgagcagcaggaccgtgtgtgggctccatgagacaacagcattggcaaggtgcttaccacagttcctgcacttcacagctggacctctggccactggctgagagaaccactgctctcctggcctcctgcattggaacacttggctgtgaaattaatctgcaacctgcaaaaggctctgcccacagaagggacctggacaccatgtatgttccaaagatccgtgtccatcctccaggcacaggccacagtctgactctgagaccagctgccttctaggctaaaggagggtgctctgggcattggctcagaacaggctgctgctgaatgcagtgggaagggagaaagggatgaaaaggtcttctgaaatgcccrcccatttcttgcatttgattcagaacccagtgggcagtgggttcttggaatgggaatctttttggtgccccctgtcttctgacccagagcgttaggagggaagggaaggggtgttgggccccttcccagggtcagggcttgtagcacctcagctgggaagcagtgtgagcatgatgatataacaggaaccaactcgttcttagcactttctgtgtctacttcaattgtgctttacatctgttacctcaaagttgctgctgtattcctcagcactyggaacatgctgggcattcaggacattcttartaaatatttactggattaatttaaccatcgaggctgggcacggtggctcacacatgttatcccagcactttgggaggccgaggcgggtggatcacccgaggtctggagtttgagaccagcctggccaacatggtgaaaccctgtctctactaaaaatacaaaaattagccagacgtggtggtgcgcacctgtatcccagctactcaggaggctgaggcactagaattgcttgaatccaggaggcggagattgcagtgagcctaagcgacagggcaagactgtctcaaaaaaaataaataaataaataaataaaccgtcacagcaacctcaaaattagatatataaactctccccacttttttttttttttttttttgagatggagtctcactctgttgcccaggctggagtgcaatggtatgatcttggctcaccgcaacctccgcttcccaagctcaagtgattctcctgcctcagcctcccaagtagctgggattacaggcgtgtgcgccaccatgcccagctaatttttatatttttagtacagatggggtttcaccgtgttggccaggctggtctcgaactacctgacctcaagtgatccgcctgcctcagactcccaaagtgctgggattacaggcgtgagccaccgcacccagctaaactctccccattttacaggtgagaaantgcgcagagtcagttgcctaaagtcccacagctcggaagtggcggagctgggatttgcacctgggtgtttctgactccagatccccttgatgagaggctggatggggcctgggatgcccctggggatccagtgtaaaccctgagaatgtgcctcagctgtgggggccctcagcattccagaggtagtcatcagaccctagaaccctatgggactgtgcacagatcgttcccttctggggcctcagttttcccatcagtcaaacgaggaggttgacccagatgatggtaaatctttcttccagccctaaaacaatttcaggattccaagccatgccagcccagattggcagctgcacaagccttgctgtgtactcagggatcatgcatatttaatttcacaatgaaagggtttttttcttaccctttttctacacattacagaaagaggtcaggatcgatgaccactaatggaaaactttaacctgcaataacaatgaggaactttctgacaattagtgtggccccttaacgtgctcagtttcttgaggagctcagagggctcctacagttcccacatgcccattttcctgagatactgagcagggagggtcggggaggaaggcccactaggggctgtgtgtggatgctgtaaccctttaggtctcttccagtgctgcgttttcaaacctcatatgctctaatttcaagaggaagcaaggctttggcccagatgagtgatgggatccagaggtgagggggggaatggacacagggacctacctctggtgggagtgggtgtgaaattcccatgcttgttgcttccagtgtggaagcccacttcacatccctcctgagccctcaggcccagatcctcaggataaagtcttcctgaacctccaagccttagccccagagcccaccctgcccccgccccctacatccaccagatgcttcctggggtagcccacccccagcctggtgcaggaggctgaaaatcaaagtgtactgctttaaccgcattaaaatcccctcctctcctcaattcagatcagggctatttgatgtctcaggtgcctgaaaccttttatctgccagaggtaccagcttctccrccctgtgatggagagggctgtcccttgggagggtcagggggtctgaaagttcctgaatgtcagagatgaaaaggacttttgggggtcacctgatccaactgctttattgtatggatgggaactaaggtccagagaggggaagggttgcacctaaggtccgtacagatcattggtgatgacgctgagcctgggacctgggctcgcctttgttccaccacaggtgctgggtctttaccatctctctgaaggcctggagagacccagctccacctctgtggttcagggctcagcctccaggtctgtctgggctatgggctgaaaaggagcaaagccgtcccaacaagaaatgggaatcttcctgggtggtttgctggacccccgagcttttggccataccacttcttcattctaatcatagtttcctcttataataaagtggggagaagccaagggagaagtttagtggcccccagaggtccatccagctctgcccttagcccctgagagttcctaccatgcttcttgtgactgttttgccacatcctcattgctgctgctctgttaccttcccttctgagaagtggaaacccaagggcagtgacaccaccagcttcttcacttctgaggctgagcctcagtggttatagggtggggcagggtttccagttagccttagaggggtagggctcagctttctaaacatgtcacagaagccctggcccctcctggcccagagcattgaaggtaaaggtgcaggtttgacctggtggactgtgggtggctcccatctcacctgtatttgtgtccttatcagtgtccaacccagggcctatctgctgaatggatagtgaaataatcactagataaataaatgcatgtagagatgcataaatggattggtgggtgggtggatggatggatggatggatggataaatcgatggagacagacagatggcctcccctttagtccagggcacagagatggcttcatgagtactcatcctcctgagggccccatgcttagaagggcctatgtttggtttaatgctctgcagtcatcattttgaaattgttaataatttttaacaaagagccctgcatttccattttgtgcttgccccacaaattatgtagcttgtcctgccagggagttcaggctgagtttgggacggcttcatccccaacactggccttgcagcctccactgtccccatcctaatccacagcctcccactaaatgccagcctgctggtgtcatcctcctgcatggaggccccctccccacagtgcctggagttacagcattgccctgccaagccagcagctactacccgccatcactatcaacaccttgaaaagttggtggtccagagaaaatcctcacayagcaccgcagacctttcctgaagtctccctgcctccttccctggcmtcctgctgcctccttcccaggccatcacctacctgtttgctgaagagccccagtttctagcccaacagatctctccctgccatttctcccagatgcctttcatctctcacagagccctggccatacctttccctggcatcatctgccaaaaaactcaagaaaccctggaggcctagctcaaggccacctccctcaggaagccatacccgctctccccactggagtaatcatatactgttgttagtyaccatttactgggcacctatgatgtgccaagtgctgtgcgtcatcatctctggccctcccagaaatggaaaaggaggtctcccatgccatttcccaggaaattgggactcagataagttaaactcagagaactggggcttggacccaggaataagtggcttccagctggaaccactgctcccagcctggcggggctcccatccctgccctggatggcatcaggcgcagcctgttggcttcagagtgccatatgtctgttctgccctcaccagctcatctccatcacctccctggaaggaaagagtcaccattgcctatccatgccagttccctagcctagtgaatcctgtgttattaggaggcagccgagggcccaggactgaagagctgaccctacagagccatttaatctctcatatcgtgtaagcgtttactgagcacctactgtaggcctaattccatattaggaagttgragagagtccagatcgttgttaggtaggtatcctgatttgtgggaagtcatattaaaggactaagacaaaagttcaggaaagaagtaattgacagacagtggtgattagatgggtctggccttaggttggccaccgaatcgccgagtgtgctaggatgagacactcctcactgagcctcaggacactgaaaagggctgttgctactgattgtaccaataatcagcagctacctcttcctgaggagcgtcttttgggagaggccttcttgcaccgtctcatttatcacatgcatcactttgctgagaagcctagtcccgtggagtcttggctgtgcgcgcaaggccgagtgagtgagtgacttcttctcccttgagtgaatgaataataataatgtggccaccaactttgcagagggctgtgtgccaggccctattctaagcattttgcttgtgttaactccttcaatagccctgacaacccagtgatgagccccaatctacagatgagaaaactgaggcacagaggggtggttaagtgaatgaccgaagacaggggtgggaggacagatgctgagacagtgagagggtcagtgaaacatgggggttctctgccctcctgctctgccgcccaggagggctctgaggggaatctcaatgtttggtaattggcactgataagtgaagggtttactcattagctagctacccctcccctatttgcaggccctgggcctgtgggggaaggctgtgtgctggtgggtcagtgtgaatggcccaaggcctgcctgtcccctgcccacttggctctgagaacccattctatttgcggcccccaccccagcccatggctgctccgggctggcagcagcccggggaacagaaggtttgcttgtctgcgcctgccgcacccccctcctcagtctcagcctgggacccctctcaggggctcctttggctgccaagggcctggcactccctgttgccatggcaccggccggagatgaggctctggggggtggggatggggagggcagcagcaggatggtggaggcctggaactctgcagctacagaggccctggccctctgcaaacagtggaagggggtgctggggcccccacaggggcaggcctggaccctgtgcacagcaggcctgtggcagagccggccacacacctgggctgattgcctggatgctgtatcccgcaggagcactgcccctgccagaccctggctttcctaagcaaaaactctctcctcagccttgtgtgctcaccctcagcctctgcagcgaaattgtggagttctatccctagtcctgggttctatccctagctcgactttaaaattattggtgacccggggcaggcctcccgcatacactgcccctcagtcagagcagaggcgggacccagatccctgaggatcttctcatccctgagatcctggattccgtatggacgccattagagggagaacgtttctctgtggacagatggacagaactgtttctggtcaggagacagacagtctggcatgacgggcaagaattcaggttttggcagttgtggtgatgcgcacctgtagtcccagctactcaggaggctgaggcgggaggatcacttgagcccaggagtttgaggctatagtgagctgtgagctatgatcatgccaccacaccactgtactccagcgtgggcaacagagcgagaccctgtctctaaaaaaaagaaagaatataggctttggagtcaggccggcctgagtttgcattcccgttcctttgcatcttacttattgtgtgaccttgggaaagttaccaaaagtctctgagactcatcattctcctctgtaaaatgggaataatgagtgtacccccctcacagggtggtcgtgaggatgaaacaaaatctccagatcatctcatttagcagagtgcctggctctaaattagtagggacttttgtttgtttccagattgggggggatcagaacaataactagaaagatgtcctgtatttggggagagggtggttggtggatagaagcaagaccaataagcagagaatacagtgagataaactgtactcagtgtaattaacaattctcaatagtctgccctctgaagattctaagctggctaagaatgaaatgggccacaggtgaggtggtgagagccctgtcatgggaggtgtgcaattgcagagaaggtgggggagatgtgaatagagggaatgtactaagactgtagggctctgtgaaaaatggagtgactgtttcccactcaaactgtcagcttcagctttacccagctcaaaagacagcgtgaaagagtgaaaggagaagttgggacaaagaaggcgaaaagataaggctgacgactttattttttaatttatttttttgagacggagtttcactcttgttgcccaggctggagtgcagtggcgcgatctcgggttcaagcaattctcctgactcagcctcccgagaagctgggattacaggctccctccaccacgcctggctaattaacttttatttttttttatttgagcttgttctgtgccaggtactgggctgtcctttttgcggggctccttatctttgcctcctgccacagaggggctgtctcatgggcattgggctgtgtgctytggagcctgtctgcccagtrttaaacactggagacaccactggcaagcttttgggcaaacaatgtaaacagtctgtgcctcagtttccacatctgtaaaatgaggaagcagtactgatgtcatgggattgttctgaggacttggtgagatcattcatataaggagcttagcatagatagtgggtgataagtacagcagacccttgaacaatgagggggctggggacagccaccaactgcaaagttgaaaattcatgtatagcttttgactccccaaaaacttaactgctaatagccagcctactgtgggccttactgataatgtaaagtcaattaacacatattttgtctgttatgtatattatatactatgttcttacaataaagtaagctagatgaaagaaaatcacaaggaagagaaaatacattcagtttatattaagtggaagtagatcactgaaaaagtcttcacccttgtctgcacgttaagtagactgggaaggaggaggaagaggaagggttggccttgctttcaggggtggcagaggcggaagaggtggaggagtggaagggtgggaaggaggtggatgtttcacatgtgtggaacattcacgtgttagtggacctgcacagttcaaacctgtgtagttcaagggtcaactgtactaaatcagaggtagctattattattattgttatttttaaggctgttggaggcccagatggggccggggtgggtggggggactcagggccaggaatccacagggccctgggggtaaccctcaaggcaccgcaggaggcaggaagtgcttgctctgcagccggtgggcaggggtgtgcagcaggcctccctccctcactgacctccttctcaggctgcttcccagccttcctggggacccaggccccctcccttgggcccccagcagccgtgaggcacacactgagcgctttcccacgcactgttccaagtagccagccgcatcgctgcccccacccccaagcacasgcactctgacgggtgagggggtgtttgctgcaggagagcggggctcgggctggggagatcagcccrttctttatcagcctggccccattccagacagatgtttcatcttattttggacttccagaaaataggtcatttctttccattgtgttccctggggaggcctcatggggagaggagcatgcagtgagtgacgagtgtgagggcctggcttgggccctggggagctggaggggcagccgccttcctccctcagttgtgagggagctgtcagggccgggccggaagattctgaaaggctgggcagagaagccagcctttgcctgagggggatggagagcagaggagggccggagaggtcacataggtatttcagaaaggtccctctggctggggtgtgaraacaggtggaggggacagattggaggtgaggagattggcggtgggatagccagaggcagccgagcctgtgctggaggagggggtgcagggggcttagcagccttccagggaaccagcgctattcttccatccagtttggacttccagagcagcgggagcacacgccaggccccatcttagtcgatttctgctgctttgttcaggggactttgtaggtacctggagaaacataaagaggaccccgggcctagaagcagcgtggcacagagaatggctccaacaccgagtgggctgcgccgggctgctctctttctgtagcccttagagtgatcccgaggctggtggggaggttcgtggtgcaggggtggagcactgagccttctccaacaactggaagtggagcgagcataggattgaagggggcgggtgggagcctcggccacttccccagtttctcccctccacctgtaactgtctcctcaccctccgatcctgctctcttctctggctcccaggatggggctccctgatcacatgacccaatcacacccacatctcagcctgcttggggacagccacatggaccagacttgccgccagacccaggctgtgctgctatccctttcctactctttagctgctggcgggaggacttcatccctggctccagatgcctcttgcccccacagactcccaggcctggaactggcagccttctctgagctgagtcatgacatgggtccctccccagcacccccaccccgagcccagcattccagctcagcacagctgccttcccagagtggagccctgagggccacagcatgtcagccctgaaagtgctcccaagacactcttgcccacccttttgcacagataaggaaactgaggctcagagagggtcaggactgtacagtagtcacccttagctgcagtttcactttctgaagtttcagttaccccagatcaactgtggtccaaaaacattaaatggaaaattccagaaataaacaacttacaagctttaaattttgtgctgttctgagtagtgtgatgaaatcttgcactgtcctgtctgtcccgcccaggagtgaatcatccctttgtccatatacgctacccacctgttagtcatcaacaaagtccactactgacatccagccatcaacaccatcatggctcggtggtccaggatcacttggagcagatgacctgatccttctgataatgtctggaggtcagtagtagcctaacgctacttcacaattcttacgccatcacctcacttcctcttatcacgtaggcaccgtgtcattccacgtcttcacaagaagagtgaamgatacagtaagatattttaagagagagaacacagtcacatgacttttattacagtatatttttatcattgttctattttattattattgttgttcatctcttactgtgccttatttataaataaaactttataataggtatgtatttgcagggaaaagaacatagtatgtatggggtttggttttatccaaagtttcaggcatctactggggccttggaatgtattccctgcagataggggggaccactatcctataagtgggtgtcacagccgggactagagccaggtcttcttacttcccaccccaacccccctccaaagtctgtcccaggcctgtaaagtgccccggtacggagaacagaagactggactgggtcaggagactggagtctgtggctcacttctcccaacaacttagcaaattacctcctctgagtctcagtcgccaatccctgcctggctgggctcgtgcagagaatgtgactttgaaacaaaggtcaatgtgtggcaggacagaggtgtgctgtggagagggcaggggcagctatagcctgaagcctggggccttgagccaccagcctcacatcttagcaggggctggaggcggggagctgcgcagccaggtgagcttcagccccaccgatcacccgagcccatcttgtctaggccaaaacaatgggccctcttgctttccttccctaagcctcagtttccccacgagcacaatggagcacaggaaggcagttagatcagatagatgatccctgagggctctggcgtgctgacattccaagactctgaccccataaccccatggccaggcctcctcctccctcaggcatttggtttattcagagcatcccaggcctgagactgcctgcccccagcacccccctctccctgcagcatggccctctctctctcatctcactgctgtttctacccggcctgttcctggcctccagactgaacatcccactgtcccctcagtgcccacagaccctccctatcctaaacctgctcagttgcagctctcactcctgctctttgacctcattctcatctcagaaaatggcatcgtcccctcagcacgtgcgcgtgtacacacacacacacatacacttctgcctcccagtattccaagccagatacagaggtgcatacctccctctccagcccctcaatattaagtcacccagtcctgttgattctcagctaagtaactctcaaatccatctgtttttttcagtccccactgccttctccccagacccaaccaaacatgcacgttggtcagagaagcggtggagctggtggcatagaacacagagtcacaccacttcactttaatctctgctctaccccttctggctctgtgttcctagcccagttattaaatgctctctgcctcagtttccccactgtaaaatggaaatgatcactgtatctacctcatagagttgayggagaatcaagtgagccaatacgtgccaaatgctcagaatggttcctggtgcagtaacacgggctttctggcttgtctgttcatgcatatggctgtgtgttcaggtgaatttggggttctatgtgcacatgttctgtgcatgttgtatgtgctgcatacacatgtgaactgttgcacacgggtgcatctccacgggtgctgggcacagtgggagctgcgcacatgtgttttgtgtgggtgtgtacatgtttagtacctgcatgagggcttggcacccacatggcctcttgcatacgtatgtgtttcagaggagtgtgcgaggaagtgcgtaggcaggcatctgtgcatctgtgctgtgtgtatgtgctgaccatgtgcaggctccccccrtcaacccccgcagcaatgcagggccccctccctggcctgcctgtgtcgtgggagcctcaggaccctgagggagggaagctgttgctggcggatgtggccaagatgggctggatttatttagattaaggcrgtgggaaaggagtgragaattgtacgtgctgggaggagggaagtctggggctctgagaatgactccccaagcatgcttgctctcctggacttggggcacccactcctctcccctggacttggggtccttactctgctcctttgacttggggtccccactctgcttccttttgacttggagttcccagtctgctcccytggacttggggtccttactccgctcccctagacttggggccccccamtcctctcccctgaacttggggttccactctgtgccccggacttggggtcctcactctgctcccctaaggggtccctctgagtcacgtgaggagctgggcatgatctccactttrggcctctgagcctacaacctggccagaataggaggaatcaggaggggttcctggcacatagcactctcttcatgggcaaaagggggacacctaggggtgccctccctctctctgctctagaggcctccctgggcaggagagtacagcagatagggggagtgcctgctctctgactgtgacatccagcttgtcctaggtggcccttccctagagtacagtcctcctaaagaggggaagttgtcacaggcaagcccactaccaccaagtcagctgcctgggcctccctgggattggctggaaccagaacagcctctgggaagcacaaagaggcctaacacatttggtggaaaatgtggggtatcagggagtcatccaggatggcctgggaagtcatgtctgggtgccctaagcccttctctgccctccctggccctccagcctcttgtccctaccactctttccttgccacctcctggggttccacgtcaccagcggaaagtcccctgaaacactgttgaaacactgttgtctaacttttttttttttttttgagacagagtctcactctgtcaccaggctggagtgtagtggcgtgatctcagctcactgcaacctccgcctcctgggttcaagcgattctcctgcctcggcctcctgagtagctgggactrcaggcacttgccaccatgtccagctaatttttgtatttttagtagagacggggtttcaccatgttggctaggttggtctcgatctctcaacctcgtgatccgcctggctcggcctcccaaagtgctgggattacaggcatgagccaccatgcccagccttkgtctaactcttaattgtatagatggggaaactgaggcccagagagggaaacaacttgtcaaagcccgcacagcaagtctgtggctgaatagtcatggaaattcctttcrtggaatgagatggctggtggattcttatgtgactctagcctcaggaatgtagccccctcctgcttactagcccccacctcctcaaaacaccccggtaagattcgtggtgactagaatcttctctttggcctgtcagaaaggcagagcttcaccatagggacagctctttgagatgacacctgccaacctctctatatggatggggacgcagagttcagagaggctggagactcgctcagtctcacagtgggtcccagggtgcttatgaggggagctgattgctctattcatagtaaagccagtccgagatccctggggtgcctacamcctccctacggcatccacactgcctgcctgtcctctccccacagcttgaatctgcctttttgctgtgtgactggggcatgcttctgtccttctctgggcctctgctgcccattcaaaaagcatacctcctagctcagagtctctaagccacccccagccccaggcccagcagaagagagcctgaaggggagaggatggagtgccacatgggaggagggtcgggggctgcatgccatgaaggcccagcccacatagccagcccagccttccagagccaggccagccccgctgcagtgacctcccttctcctggccagccrgccaaattcctcctttagaataataaacagtgtggccagccagggagactgggagaggaggggcagggaagctgaagtgaccccctcccccagcctctgctaatgattttctttggctgagatctctagcaggaagggggcagccagaggggcaccgacggaggggcagatgggcctctgtgggggctgctggctccgccttggcgctgctccctcctgaccaaggaggcctggcatccagctggaggggctggggcagaggaatggtggggagcagaggctggagggggcgtcagaagggctgggctttgagtcaggagcagttcagagaggggagaggaagaaacgaggagaccttcaggcaggcagtctgaaagggaggagggaggagaagagctgatttgctcagactgtttcttggggtgttgggaagagctaagattgggggtccataggcgggaggagccttgcctatgtcccacccctgacatgtgaatgcagccctggtaggtgaggtactcaccatcatccacttccagagctggggacttaggccacagggagagcgatggcacaagaggtggcatgctggggcctgaacccggtctgcagacctaaactgaaaactaaaaggggtgagatggggaggtaggggcaagctgggcatggccttcagaggcaggccaggctgggcagccccacagccagaggaggctccttgttgcctcatcatgccgtcacctcccaaagctcatgctctgcgacccctgtcctctggcgtccttcctgccaatgctgcaggcagactcttggcatacttggctcctggtggtctcttgggacctgaggtgtgtcttccaagatagaggagagcaagggccaccccattcagtctgtctctgtctttgtccttgcttctgtctctgtctttgtccttgcttctgtctctgtctttgtccttgcttctgtctctgtctttgtccttgcttctgtctcttagtgcctctggtgctgtctctctgggcacctcctctctgtctctgtgtctttgtctctttctacttctatcattccaggtctctttctctctgtctccctctcagacaggctctgctgtggaatcttgggtaaacttctcaccttctcagagcctcagtttccccatctgcaccctgggggtgggggtggggggagcctggcttcactggtctccaaggacctgtgaggcctggctgctcgatgggacctctcctgggcccagcccctagccgctgtcccctgggcctccctgtatgctctgggctgagtaaaggtgtccaggcccacctcccacattccacagccccggctccccggcttcccttcccacagcccacagcctcctccatttcctgttgtgcttgtggagctgcgggagttctctgggttctggcctcccccctcctcctcccatccctttcatcacactttcccaaatatttgtcctggcagataagagcctggtattggaactgtcacccggaggacaggctgtcagagctggtaggctactggataccatccagcccaacttcccctccctcactgtacagacagggaaactaaggcacagagagagtctggggacgcagccgaggccacgtgagagtcacaagcagagccaaagcaaaggccaggaccccaaggctaagtccgggatggagaggagacagcctgtggtcatgagtgccctttcaggcttgggacgtggtggcttttgacttcagcccctcggacatgaakgctgggtggcccaagctggggctcattctgcaggagccaggtggtgagatagcccctgtcgctgcctccacctgccctgggccctgactccygtttaactctgcaggacaccatgcggcttccgggtgcgatgccagctctggccctcaaaggtgggtagatgggagataaggtaggggacccgggggkctgcggagtggaaccctggagctggcaggggtgatgtgtgctggtggcagggcrtgaagcaccaggcacactgccctgcccttcagctttagttttcaggatttccagtgggctctgtggaggcctccagctgccagccyttcagctcagaaagcgtcagtgggcccctgcttgtccagaaccatcagctcaaatcctttgattggccctccagaccccatcccaccttctggcccacacccctggcctcctatcctcggtctggtggatctgtggcactcggcttggacccctcattggctgggagcttccaggtccctgctgggcttctcagcacaccccacccctcactcctgcccgttaacatgtcttcagctctgcaggggctgagcgactgacccagcaattaatgaccagccagcagcctgcccggcagctggccataagatggactggctgcctgaccgcccacctcccctcctgatctgtatcaccagggggcatggagggcgtggcctgaaaaatccttctccaggggatgtcgtggagggggaccaatcacttgacacacacacacccccaaccccagttccctccagcccaaaagggcctcagcatcttttctggcccccctctgagctacctragcccctccctcccatctctctcccacccagagccacctctgggccttgggcagaacctgggcagtcgggggagggggcagagagctgtagggaagaggctcagaaagtgacctgggaagcaatgcaggaactggaggccagggaattgcttcccgaggatttcctggccccttctggtgcctactgcctacacatggcactgctgaaggactcagaggctggggtctaacgggactgacagaggcagtccagaggaatccctggggccttggagctgggcgagcggtcctcagagccatggctggagagccccagtctgtcggataaaggagctgtgctcctcaaggacctgagggctgtgcatacgtggcctcctcgcaggctcagccttgggagaggtgctgaagcccctgtttcctgatgtctgatacctcctctcccaaaggcgagctgctgttgctgtctctcctgttacttctggaaccacagatctctcagggcctggtygtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccaggtaagggctcccagcctgtgtgcccactccttacccctcttgtyaactggaggcatcaggggaagtccrgagagtgctttagtttattgtgaaatgcagccatcctagaaaagcagacaatcatggaaccagcctggctcagtcggggagtgtgttcgcmcccactccttggtctgggtgatctgcctgctccctgccagtcaccctattcctgcctcccaagaactctatattctcagctgcttccaatctgctccctcttgaccccacatcccttcttccccattctccaagctccagatatcagctgcatttcaacttgtgacttgccttctttcttaccctggcactgtcaatatcaaacattagagctggaagggaccagctctaacatttgatttatgctcttctgggagcatccctattctgtaacggggagacagagggccagagatggcaaatgacttgccacacagcaattcaggggatggccagaaacccagttcccctgatttattcacggctccactcctggcagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgctcagcagaggcaagtataaccctccacagaggaatagccctttacagtttacaaagtgtgggactccacttcccagtggattctcaccacagccttcgaaggaagatagtgttttccccatgttacagaagagggaaactcaggcgcagagagaggatggagcttgtcccctgtcgcagaattcgatagtggcagagctggcctgtgcaacatggtcggtgagggcacaagcttcagagccagctgggtcgaaatcccagctttgctatttcctgtctgagtgactttacacaaagcacataatctctctgagcctgcttcccctcttgtaacgtggggataacaatggctgcctacctcataggatcaattgtgaagattaaataaaagatggagagtacctggcacatgttatgtgctcaatacatttctcctgtacatagatctccagagggtactttgatttccagactgttatcccttctagaacgtcagctccataagaacagagattttgtccactttgttcactactgttgctccagtgtccagaatagtacttggcatgtagtaggtattcagtaaatatttgttgaatgaatgaatcttctacatcagtcatcctttccctctctagccccctaccctatccccaagctgamgtgctagtggctggtggtgacttccccagacctaagccaatctctctctaccagtgtcatccatcaacgtctctgtgaacgcagtgcagactgtggtccgccagggtgagaacatcaccctcatgtgcattgtgatcgggaatgaggtggtcaacttcgagtggacatacccccgcaaagaagtaatgtggggccaggcaggggtcggaggaggggccaggarcgggtggatatctggcttgcaggctgatttctccccggcccctcctgatttggggggcctgcccaacctgttgctgcagagtgggcggctggtggagccggtgactgacttcctcttggatatgccttaccacatccgctccatcctgcacatccccagtgccgagttagaagactcggggacctacacctgcaatgtgmcggagagtgtgaatgaccatcaggatgaaaaggccatcaacatcaccgtggttggtgtgtgccttgggctcagcccaatccccaattccttcaacgctccccaccctcacccactttgctgggtgcagagygatggtgagagttgcatttttgatacagtgatcagggctgagctggacccagtgcctgtcacagccccggggtatagtcagccacactccagtgcagccctagctagcctctgtgccaaccaaaaccccaattccaggataaaccccaaaccaaaatgtagtgtcagccccaaatccaaccctatctcaacctagactttctgactagccagagccccagccccaacctgacttccaagcccaactgccatcccaggtccgggaagccccatccccaaattcaaccttatcactagtcccagcatcagccacagtactgacccagaacagagaactgttagtacaactctgttcccaacctgggagctggccccagcatccatattagccccarattcggccccttctccaggccctgtccccagcccaatttcaacctcagctccggaaactccatggctggcacggtccccaggcctgaagccccaccccacaggctggcctcctttgggattcagttggtgccctgcccccagggccccgcccctgacggtcaccccttgcagagagcggctaygtgcggctcctgggagaggtgggcacrctacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtgagcagctcgctctcccatcccattcttgaagttatttttctttgcagccgccaggcagccctcggctttcagccacaaacctaggcccagctttctgagagcatattaggtgccaggtgctggggatgctgcagcgaccagagctgacagttcatccctcctagagtttctagtctagtggaggaaacagtcgccggtcagatgatcacccagatgtttagttgtccttgtgatgggtggggccagcagtagcagccaagaagtaaaygggcagatgactggggaagagggtgccaggcaggccactcatggcctgtggtatccctgaggctggagatttgctggctgacagagactgtggtaggttaggatggagcagtgtccacctttctgaaggggagagaaataggactttccttcaatgctccccacccccacccacagttcatcycaaccctccctcttggcctaggggaactgcctgtgggtgaggatttacgagacctggtttgagtccyggctctgctaccaatgccgagatgaccttggcaagcccttcccctccctgggccttgttcctctttataccaggagggtggggagaactgtaagagtccttccgactctgacagctgcctttcctgctccccaggtatgtgtcagagctgacactggttcgcgtgaaggtggcagaggctggccactacaccatgcgggccttccatgaggatgctgaggtccagctctccttccagctacagatcaatggtgatgagcacgcccctcgccatgtccctgctccttcccctccctgcccccgttccctctcccttcctgcactgtccacccacccatgggaggagtgggagagggagcctggaactcaggagatggattctaggccactgacccactgccgtgtgaacctggcctctgggcctcagtttccccagctgtataaggaggccatctggctagattggtgtttccaaaacttcaggcacttaggtaccaaggccatgattttcccttctcacattccacttatactgtactattaactcgataggtatttattgagcaactaccatatgcctgtctcttcaaggttcttgaacttccctccctgcctttgtgcagcttgcatccaagtaggggaagacaaacactaacagtagggaggaaaaccccagcaaattacataggttagaaggtaactaacactgcgggagaggaaaaacaggggccgggtagggaaggttgagagtgctgggcacagagtgatggtgtgagttgcatttttgatacagtgatcagggctgaggaagtgacatttgcatgaagacctgaagaaggtgaggacattagcttagtggatatttggggaaagggtacctcgggcagtgcaaaggccagagcaatcactgaaaggcttgtgtggttggaacagggctgttggggagagtggtgggagatgaagtcagaacggggatagggcagtgggggctgggagaagggcaaatcgcataggtctttgtgggcctggtgcagactttggcttttactatgaccgaaatgaagagccatggcagggttttgagcagagaaatgacatgataatgacttaatgttttgttaattgactttctaaaaacaaatttattttgaaagacaaaatgtaacctctctattgtaggtggaaaatcggcatcacatgtcataaatataaagcaaccactaaaataaactcagagaagaccaaacaatgctattaaatgctggcttcatgagcttggtggcccagggttctgagcttgaggcctagcctccctttgttaaaagggaagattagcaagtctcagagaggtgttaaagacagactagcaccctgctgaggcgttccctttgaagtacccagaagggaacccatcggttttcacactgattcctggtatttaatgttcacctgcagtctacagccctcctcccccaagagagtctctgggccaggtcctcccckgaggacctgtcctgttaactgtcctgaccctccygcctcctaactcagtgctctctccatgcagtccctgtccgagtgctggagctaagtgagagccaccctgacagtggggaacagacagtccgctgtcgtggccggggcatgccccagccgaacatcatctggtctgcctgcagagacctcaaaaggtgagcagacctgggcctcagtctcccagtgtccccagctggctagaaaaagctcgtgaaggttatctagtcccgcccgttcttcttggcatattgttccgggcatagagttgcatcctaggaggccaggtcaccacctccttggtcctactctgtatgacctaaatggtcccttttccttacctttacccctgggcagtttggcctagcaaagtgcagggtctgagccccagagacctcacccgccctgtagatcagttctgcactcctggccaggtcgattctaatgcagtggacagaggcaggattcagtgcaggttctgcctctaccccatacgccgtgtgaccccgtgggtcaaataagaatggattttgcaatccacgttgtcagttctgggatgggagcaccccctgctgaccagtagagggagcacaggaggagcccgctcggaaacaggcagtgggacataggaactggacacgtcctgcctccttccaccagtttctcctcagtttccctgtctgcaaggggaaggggctggcagccaaccctaccggctctcctggcaggtgtccacgtgagctgccgcccacgctgctggggaacagttccgaagaggagagccagctggagactaacgtgacgtactgggaggaggagcaggagtttgaggtggtgagcacactgcgtctgcagcacgkggatcggccactgtcggtgcgctgcacgctgcgcaacgctgtgggccaggacacgcaggaggtcatcgtggtgccacactgtgagtccccagcctcagtggcccctgacgatcccaatccctaccttaaycctgcctaattggtaatgtgcccatgtacccacagcaggccaaaggagttagcatgcccaggggcaaacaggagcattgtgaaaccctgttgtgtacatgcataggaacacattctggcaaacacaatatgggtacacacgtgtacaaacacaagtctrtaagccatggatatgaatatccttcagtgtggtgtacatatactatatgtatgtcgtaagccatgtacatgagcatgcctgttccttgaacataggtgcaaatcctctgtgtgtagatatgtaaatcgtctactgaagaatgcccaatctccagtcactcctgtaaagctagagtgtatgtgtataagcatacacctgtgcactatgcctgtccatgtatgtaaacccaccacgtgtttgtaagccatgtacatgagcatgcctaattcccagacatctgtttaaaccccacagtgtatgtctgtatgcatgtaccggtgggtacacaattcctgtacatgtgtacaagcaatgcatgtacaattcctttgcatgcatgcaaactggcatagtgcatgtctgtaagcatataattggagcacacctttctagaaaagtgtacaagcataattcccgtacacatgtgcctgctgtacaatgtacatctgttagcaggtacacatacacgtgtaatttctgtgcgtatgaacaatgcctaccagtgtcttgatgcttttgtgtatctasctgcccgtccttatgcatacatgcacctgtatgagtgtgcttcatttattcacctttcttcttcattcrataaatatgaggacccaacttctcattgaagtataaaggtcaaagggctcagccctgcctggacctcctagtacccatagtccagagagagaaggcagacaaggaacttggcaattccctccgggatcaccacattaggggcaaagcctggagggagaaggggtcccatgcccagctatgggattcaggaaagtattctagaaaaggaacctttaggtgaaaacctgaaaaatgactagaagttagcctggtaaggaatggtgtcccactcagagggaatggcctgtgtaaaagcccagaggcaaaatgagttcctagaaatgaaaagagttcaactcaatctggctggaggatcgagtgtgtggatacttaggggctggaagggtggcagataaaggggaaggaagtgctatgggatggagctacaggggtcggcagatctagagcaggcagggctccaaaggccatgtgaggcatcttggtctctgtgtatgcaggtccctgggcatgttcaggcacgtgcctgtctagagctgcctcctgtcccctgccctgtggtggatgggtgggcttctttcatcccctcatttcacccatgctcccacacatgcatacacattctctgagcaagtgggtatctgggcagacagtgtggacagcctgagtggaagaccagctctgagccaaggcagatgtgacacttttgtgtgactaaagcctgagcgggaagctgagcaccagcacacagggcctaggatggctgcaagagggctccttcatgcctccagcgatggctgcctagaagatgcaggcttccttcccaggaccgagatgtgtgatgagcgggaggagggaggagaagagggatgttggtctgggaccctgaggaggaaggcatggcgaggataggtaagggtaagggagaatggataaggggtgagagacgaagttggagagggaagcagaggtagagtcatgaagcctctgccttatgtgccattttaggagtttggcctttttcctttactgataacatggggaagcatccaaagttttttttttttttttttttttttttaagatggagtctggctctgttgcccaggctggagtgcagtggtgtgatctcggctcactgcaagctctgcctcccgggttcaaacaattctcctgcctcagcctcccaaatagctgggatgacagcagtccaccaccacgcccagctattttttgtatttttagtagaaatgggatttcaccatattggccaggccggtcttgaactcctgacctcgtgatccgcccaccttggcctcccaaagtgctgggattacaggcatgagccactgcacccagcctccatccaaagattttaagcataacaatggcattcacttagtaattcaacaaatagtaccagctacctaccatgtgccaggtgtggttttagggactgaggttatagcaatggatggggaggaggaggtgggacaggactccctagggagcaaagaagcatagattggggacagaagaggagggaatgagttccataggacctcatgggtggccagcagggcagggcaggggagaggcaggtctggcggggctggatgaggagagtgggaagctgtacagcgaagaggctgaggccttgagggtggaggagactcgaggcttgtaagggccagtgtgagccccactttgttaactaccgtcaccactccaaccccaactgggccctttgggtgaagtggggagaagtggcctccgtgctgaggtctggattcatcaggctgggggtctcagccattgctccctcagtggccactcactcagtccaccggccactcggtcaggcatggagcttggagtctgaccgagctgtggcagccccagcaagggtgtggactcagaggagaggtaagccacaacccagccctcaggggctccagggctaatgggaggtccaggcaatggacaggaactcagaacaggatttgcaccccgtccagagctctggcagcaaggccagactsactggcagggctgaagggacgtggaggccagcagtgatctgagtgggggtagttactgaggggatggagtatttacaggacagtctgaacgtgtggcctagagcgagatgctgagggtctgacactgcaggctgatggggaggtgggcgcttctattctggacaggatgtgtacggagggatctatgatgccaaagatggggtgaggggagggtagctgcccagtttgctcatggcctgctctcatctctgcctccagccttgccctttaaggtggtggtgatctcagccatcctggccctggtggtgctcaccatcatctcccttatcatcctcatcatgctttggcagaaggtaagcccctccctggcccagtgggtgaagactggcacatcattattttgcataaattccacccctctgccctccttgaatgctgcgtgatctggccacatgcagggctcagcatggaactcaggtggggacttgtgacgctggctgtctcagcttcctccacccccagcagtctgggccaacctgagcctggcccgagctatccaggattcccttcccctactgtgtcattaagtccccgggtcctgctgagacaccattcctctcatcctagccatggagcatgggacctttgaggtggactgcatgggctccaggattcttccaggtctcacccatggagaacctgtgattctactgaaatgcattctgatcctattagtctgtaatttcagtgttctgctttgagattttaccattctgtgattccaacattttaagcttcctgaatcaggattrcagcacctcatgatcccatctttctaaaattccagtcctgtggttccaacaccttaagatgtcaacattctaagcttacatctttctgacttgcccagcactggggagggccatccgcatccagccgagtacccyacctggtgtcactttctggggtcacctgctctactacttccatctgaggagcagcgaaggctgggagagaagctagagaggaggttctcatgagccaggccctcagctgccagttgctcctcagtctgccaagtcctgaagcctcctctggggccccttggyccctgttccctccgagcccaygaagaccttggctcagttgagcacttgctgtgtgacttcaaatatgcccctgcccctctctgggcctcagggtctcctgccccatgtgtcctagacggacgaacctaatggggctcagggcctgagactccctctgataactaattcctggggttggtcctccagaagccacgttacgagatccgatggaaggtgattgagtctgtgagctctgacggccatgagtacatctacgtggaccccatgcagctgccctatgactccacgtgggagctgccgcgggaccagcttgtgctgggtcagtcctgagaggcctcatgtggcagtgtggggactcaagttgggtgggaagactctctgaggtctggtcccagccttgccatgactagctatgagacctagggctggtgtcttgccttctctggccctccatctcctactatgtacaatgagagcaagaccatcccccaggaactgcctagcrttgaggttctatgatcctgtgaccctgtgagacgggatccctatgtggcaaaagtggaaggattgaggacaggctgagtagcaggcctggtctggctggggaagctgaggaggtacagagaagcgtgctcccttgggagggaagaaactttccagagattaaagatggggcagaaagcaggcaggacttagatgagataccaggaaagacagggaggtattgtggttgcaggagtgtgtttagggaatatcctgagtccaaggtggtttaagtaatgtctaggttgacctaagagagtggctctttcccctcactgggcaggaagggtgatagcggccgggggtaggggagtggggggaggggggcagctgggggagcggtgcagcttcctggtaggccaggagctaatggatcatctctgcaccaggacgcaccctcggctctggggcctttgggcaggtggtggaggccacggctcatggcctgagccattctcaggccacgatgaaagtggccgtcaaratgcttaaatgtgagtagtccttggagccctccacatctgggccttcacctctccctgcccctccccacacacttagcctctcccagggtggccygatgctgatttgcaggcactagaggggccatcacactgcagcaggcrctgctcccgagtctgggtctggtttgggaaagagcgttcctcwccctggcctcctcggcctgcttccccctaccctggcctcttcccctcctcagagtgtgggtgctcacccccgccaggctgcctgggtcttgcagcacagggcggggcagaagagtcagaataggctcctgtggtggggcctccatggagcctccatgactgggcctggcctggggcccccattttcctcagccacagcccgcagcagtgagaagcaagcccttatgtcggagctgaagatcatgagtcaccttgggccccacctgaacgtggtcaacctgttgggggcctgcaccaaaggaggtaccgagcccactgccccagaggcctcagggaaagtgcccaccaccaaggccaggccccgcctacccccccctcaggccttgcacaacagcacactcctgctggagggtccgtgcccacccgctccagcgccctcactgcgyggtcccagagggcggtggggtttagaaactcacaaaatcacaacaccttcaaggctgaaggattagtcaggtcaccagtcccagcagcttccagaccatggtgttggctgacacttttttattttcccaatacattttgaaaaccaataaataacagctcacatgacattaagatgagttatatgcccaccattggagaccaccagcttgctacttgggagctaccttcatttgatcatagaagaaagtctctgtggccaactgggtctatttgaagctctgattgccagttaggctgaaaaaaaatgttatcaccatttgcagctgcttattgtgagatttgggattttcctcagcattatgcaaccaaaataaaatacagaagtatgttgggtacatagacttattcacgtttgcaatgatcgctcatttcaacattttcgtttgtgtagatatcttcaagttctcactgattgactttaagtaaatgcattgtagttgaatttaactactaaagtgatcgttgtaaacagtggcctttatctgctttctatactgggctccaaagtaagctttagtttgaaaacatatcaataagagccaacactgcgagctcgccacgtgcccagccaataaagacatcatctcattaatcctcatgacagtgctttgtggtgggtttaattagccccacttaacagctggggaaggtaaggctcagggagactaagtaccttgctctccaccacagaggcaggaaaagaatccagatttgcaaggcactaaagcctcctagccgtcatgccaaagtgtctctcccacatccagcccctgattagcctcatggccttgaagggacgcctgaggcctccatagggactgtccctgagcctgtccctctgcaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccaggtaccaggagggaggccagggactgaatctttgggatacctgaggagcaccgctccttcccctccttttgtccaggaggggaagctgaggctgtgacagggcaggggacagaatcactcctggagctagggctgttccacaagatggtccaccccagatgagggaataacactaatgccaggccctgtgctgctaagccctctacagatgtgacatgccatccctgtgtcgtgggtgtttgcccttcagtccagggcaggcagtgatggaggaaggggcagaggctgtggtgagatgagagccaagcctcccaatttgcacagtggtgctccaggctgtgttcctctctgcagcctctacacatcagcctccacactgcctctcagggagctcaactccagtctttgtcttttccaaaaagaacacttcttagttctgttgctgattacaaaaacaaagacaagagtagcttcagaaaagcgtaaaagaccttaaaacccactcatgtcctctccaatgttttgacattcagtctcccaggagccaaagggcttctcccatctttttcctgcctatagagacagatgtgtgtagagccccacagctctttggggagctgatgctacaggcataggtagcggggtgaatcctggctgcctatgctgggttgcagtcaggcactcccatggccaggtggcgctggggaggccacaggaaggcgcctctgaacacacccgtcttgtgacctttgccctggggtgctgtaatcgcctctgggtgtgagctctctgggttctaactrtcattttggtagcctcagtgcccagcttggcccagcaggttggttgaaaagkcttgatccacaggctttcctactgggatagactgaaggaagatgagtgagtgtgtgagtgagagaagaaattcatgagtggcaaggggcaggaggggaggggaaggcaaagcctgcaggctctcctgtgatgctcctttacccccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctggtgggtggacatagtgacatagtaccccacatccaaacaggctgatgctcttcacatgcccagccttgccaaaaaccctgagaagaagggagcctcgtgcccatttcatagatgtagaaattgaggctagccacctggccaaaactgatctgtagtggacccctaaacggaagccctgtttatggatccggaaacatgcgtagaaccctcagggagggagagagcagggatatgggaggacctggccttttgtcgtggtagggaaagtgatctactcagcttcagccccaggctggtctagtgtccctgagaggcaggcaggcaggccaggctgggcaaaagtggcccaagggctaatgccaaaaggccaatgagggcactgataaagcaggagaactttgagtttgatattaagaaatcattctccttttaggggagacctagacgatcagtagccacctgtcttggacattcagtctcccaggagccaaagggcaggggtcctgtgggccagaaggagatataagatagcaggtgaccctctgcttctcctctagcccctgagaggacctgccgagcaactttgatcaacgagtctccagtgctaagctacatggacctcgtgggcttcagctaccaggtggccaatggcatggagtttctggcctccaagaacgtacgtgtggtgttggtggggcagagtgggggctgtggggaggtgggtcacccagccagccagcatcctccaagagcacaccagggtggcctctcgcacatgggcagtgttgtattttcccaaagcccttgacatgaagggtctttccccacaattgtccccaaggcctcagctcccctctccccaaacccagtgcgtccacagagacctggcggctaggaacgtgctcatctgtgaaggcaagctggtcaagatctgtgactttggcctggctcgagacatcatgcgggactcgaattacatctccaaaggcagcgtgagtaccttccctggcccctgcagggcagtcacagtgcctgtgaccgcaggaacagattccctcctgaccagtgtggctgcagctcataggaaatctgtgtggggctccttgtggcctgccctgacagcagtgatgggctgtgcctgcccagctatgtgtgcagggacaggatggggagccgcccaggagtgcatggagcaagtatagcggcrgggagggctggctataatgggtccagggtgggggaagggggaacaggccgaatgtgttgttccagtggtggtgggcagaggaagaagcccaggtgacagggcaagaaagatgagcaggtcacatgcagtagcagggattggtctggttaaaacgtgatcatcctgcctgtctctcatctccccacttttccgcaaaccccagatggagggacgctaggcccagagatcaaaggcagccaggataagagcttggggggtgccttgacaagtccctggctcccacacttcactactcagaccctggggcttttccccagggacaggggctgccttgtccccagctagtgagaaaggaaacagcctctggtcctctgaccagccctgggatggacatgggaactgtgctgcgcagagaccrgggccctcacagggaatgggacggagaagtggttgtgggtgggagctgccagataccctcctcccatcccaggtgcagagtggggctgaggtccttccttgcactcagcacctgtcctgacctccctacagacctttttgcctttraagtggatggctccggagagcatcttcaacagcctctacaccaccctgagcgacgtgtggtccttcgggatcctgctctgggagatcttcaccttgggtatgcttgcttcctcctccagccctcagcatcctggcctggtgtctacctcgaccactcatgcctctggcctggtggggctatgggacgagccctgatacagggatcctggttcaggtcccagctctgctaccttctccctgctgtgtgatgttagcaaattctttgccctctctgggtctctttatctccctgtctgrgcattgacaggtttgaacagtgacatcagaaagcctgcttggctctcacattctggctgtctatcctggggagggttgtggtctctgttcagagcccatgaaggagcccacagttccaaatgccaggggcactgcccccttacccataccagggccagcatggctctccttgtcctgtagaagagggtgccctgccacttttccacccctgagcctgtgtatctcttgtctctgctccccaacaggtggcaccccttacccagagctgcccatgaacgagcagttctacaatgccatcaaacggggttaccgcatggcccagcctgcccatgcctccgacgagatgtgagtggagtctcatgcatttgggaggattttgtgctgcaaacaatagatatccaactctactggcttaaaccaaagatgagagatttgttagctcagagatctagaaagccttggtgtaactggatccagccattcaaaggatggcatcaggaacctcttgttctagccctgagctctgctttgctctgtgtggcctcattttcagrccagcattgcccaaatggctaccagcagtgccagtctcatgtcctactgcttgctccatagwgccagcaaaagtcccagagctgaccttcaagggctcaggtggggtcacatgccatcaagaaccaaccgtggaagctgcagggctgaaaactgttggcgaaggttggctcctgtgctcacccaggcgtagtcaacctgtggaaccatgtggaatgggggctctgcgagggcctcccaagggaatatccagagacaggacctctggatacacccagccaccacttccctccagctcctttccatggctcaccttgttctgagaggcagcagcctcctgctcccccagccctgccttgtcccctgaaccctgggccagaggccctgacccttctccctatccccagctatgagatcatgcagaagtgctgggaagagaagtttgagattcggccccccttctcccagctggtgctgcttctcgagagactgttgggcgaaggttacaaaaaggtatgttgaggcagggtaggggtggagcacggagagctctggtgcagaagtcagacaccgagtacaaggctctgygtgatgggctggcatttaggggaccaccctttgtcctctctgggcctcagtttccctgctggttctaggaggggatgggctggygctgtgagtttattttagcagcagagagctttatgaaatggaatcctacatggaagctgatcgattagatgcagggagggggcctagagcactgtctgtcctgctgcctccctcaggcctttacctccataccgaaccgtggggctccttcagaagtgtgaataaccccaggttacatgaccatgaaccgcctgaccacttggatcctgtcacaggattgtccaaggcccaaagagccagtagggccctgaaaccctgccccgtccaacaacacgggtccaagtgaggaggaaatacacatggcctttgacacagaggcagctccttctttgggtycatttctcacccccactgccccccrgggatggtcccagggacctgggagatggagtaaggtcatcaccacttcacagcaaaggaaactgaggccctgaagaaggacgctgaggcagcatgagagcctgtgcctgtctgctctraagtgggrgaagagttagagtcctgggtgctggtctgataactgcccctccctgggtggtcctgagctcaccatgccttgtaagattctatgtgaggtaggagggcagctcaaccatgtggcttgggcaaatccctttcccctctgagcagcgggggtcttatttatacaaagggggatgggctcggttagaagatccctgaaggcatttctggcctgaccatccctgtttctttggttctccctgccccgggagcagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccaggtarccaccctggcctggggccaaggaaattgtgcacagtgtgtgtgtgtgtgtgtgtgtgtgtgtgtgtgtgtgcgcgcgcgcgcgcgcgctgccaggtttgcctcagaggtaagttacgtagggtaagtacttatccctaccaatgaatagaagacagaatggaactcatttgaactttgatgccctgaggtggaaagggcaggctagtaaaaacaaaagtatgggctgggacttacttgcaaggtagctatttcctttaagggagcccccagaggttatctatactctcttatctctaggtcctgtcctagccccaaaaagaagaagcaaacctacttagcatccccagcaccccagctgttactcatggccagcctgaggcctatgttctgttcttcagcaccacgccctggggccagagggagcctgcttggttgtaggagtcagaggtgcctaaaggaattcaggacagaattcagactgggaaggagattcgtggttttcttttgccttgggaagtggtgaagttacagcccagagggggctttataggaggaccctgctgttgtgtggacttgatgtccacgcaggatctccccttaactggagagaagggctccccatgaggccacgcccacctccaaagcgagatccagcccaaggtgaagtggytggagccccaggctggggtactgtcccaactctgccactagccgctgagacctgggaaggcttctcctctgcgagcctcagtttctccatatgtgccaggagtgcacaccggccttagaaggctccgaaggccctcattgctctaactgttgaagaggccaaccatccaagagtcccagtggatggygcagaggagtgaagtgcagcgctcacacagcttgaggtgtgaatgctcaccctgttttgtgccctcagacaagctgcttcactgtctaaacattggtgtcctcttctttttttttttattatttttattcatttatttatttatttttgagatggagtttcgctcttgttgcccaggctggagtgcaatggcgcgatctcggctcactgcaacctccacctcccaggttcaagcaattctcctgcctcagcctcccgagtagctggaattacaggcatgcagcaccacgcctggctaattttgtatttttagtagagwtggggtttctccatgttgagactggtctcaacctcctgacctcaggtgatccgcctgcctcggcctcccaaagtgctgggattacagatgtgagccaccacgcccggccagtgtcttcttctgtaaaatacaaacagtaaaagtacttctattaggcggtcattgcaaggattaaatgagatagcatacacctttaggagtgcagaggagggagatgctggtgggtgagaaaygagctttggagccagctgaccctgctccgaagttccagctcctgcacttccctgctgtgtgaagtggggcagtgatataacctctctgagccacactttcctcacggtgcaggccttgcatagttttcacaagagttaaatgagccggagtgtgtgaagcctacggtgcaggggtggacacaccgaaggctcttcatgactgctgctggaatcctcctgggctccttcctagcccctcactcactgcctctttcctctagctccaccctgaatgaagtcaacacctcctcaaccatctcctgtgacagccccctggagccccaggacgaaccagagccagagccccagcttgagctccaggtggagccggagccrgagctggaacagttgccggattcggggtgccctgcgcctcgggcggaagcagaggatagcttcctgtagggggctggcccctaccctgccctgcctgaagctccccccctgccagcacccagcatctcctggcctggcctgrccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaaratgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggcccygcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagccccmagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccakcccagtgggcattggaggtgccaggggagtcagggttgtagccaagacgcccccgcacggggagggttgggaagggggtgcakgaagctcaacccctctgggcaccaaccctgcattgcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttragtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcatttcattcatctgtaaagtggggattttcgctctcccacccctcgctggaagctggggggcctagaccttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccagggtaaggacaggggagggaatagggtggcgaccaggctgtggctttgagggcagagaggtgtagacctggcaggacccagacccctcacggctgcagcatctcaggggttgtggggccggcatgagtcataggctctcctgccgagcccaggcctgtgggaccccggcagcaacacagggccaggggcaatagggttgctgggggcaggggacagagtgctagggccctcccacctgggcccagagtcctgtacttggctcacttgaggtggaccaggtgtcagcctcagatccatcactgtgtgtccttagcccctcccttgctctctctgagctggggaaacggcatcttcatttgagtgggtgcgggaaggacctcattttggaaccacaggcctccctggactgcctccaggagtctggggctgtggcttcaagtggggaaaagaatggagccatgggacagctctgactcacaggcccagccgccaactcaggggcagctgagccacaccagggaaaatacccgacggctataaggcctggccatacaaagcccaccatcccagggatcctggcttcagaaaacacccagagcctgtgacttctcttctagctgtggcaggagttgaatgaggtgatacccggatctgccttgtaaagaaaataactagcccacattccagacagggattatctttgctggtgcaaaagcctctgtctggaggtcagaagatctcagctccctgtgtctcaggcctgctccttatgggaacttgagtggattacaccacatcaggcctcagtttccccagggataaatggagctagatgccacactaagacaaaggttgataaaaatctgactaccactatccaacagttactatgccccagggctgtctggttgcttcacacacattagctcattttaccctcccaaaagcccagtgacctgagtcctactattatcccatgttacagatgagacaccagtccaagctgttgttgttttgtttgtttttgtttttctagttaaagaagtttattcaagggcaaagtgtgagggtagtcgtcaggaaacaggaaaaccagagaatggtgatcagtgcttccctgtgtggggcaaggtgaggatggtttatatagccagaaacgggtgggtaacacaattacattttccatacaaaggttaacgtagagctacaagatttgattggctactattgactacactttaagggggctgcttaacactcatttgtaaagaggtaatgatcaccagcgtgtcatttagtccaggtttgaataaagaatggggagcccggttaaagtataacattctcaacacaaaaatcaagaggcaatggtcagagagcagtcctgtgatgtgactcagtttccagggcttaacttttcccattggcataatgaattggggagctcctgaaattttattttattttcacaattttgatttgcattcaaaccaaatcaaatgtgcattcagggaggttttgaagtgacttgcccaagatcatctggtcagtgtggcagggatgggagaggagcccaggtcagactgactcccaagtcagcactcagggaggtaaagcacccacccaaatttgcagagctagggactggggaagcctgcgacaaaactcctatcttctgtctccagaccttctggtactgtgtttccccaagagaaaggataggaaaggactggatgagaaaggaaagctaacatcatctgagagctagagaaaaataataaaaactcatttgtgggagggcttgggcctctcaggcccctgtgcagagggcaggcagggtctggggtaaccacaggtcagcccctgctgggctcctgcctcccagtctctcccctcaggcgggcccagggaagacgggtgagctgggattttcctcccagacagatgagccacttggactgcacaattcttccgccaccccactcacggccggggttcttgttcctggaaaaagagggaaagactgaaaggagctatttctgccggggccctgacctgcagctgatgagggtctcacagctcccattcacgtcccttcttctttgaatcagggcaccgtctctaacaggccccttttattttagttataatgttcggttttgcaattaaaaattatttttaatgggcatcaggatatttccttctgtctttgaatatgccttttgtttctaatttgtgcaactataacttcacgtgaacctcatggattctggcttaggcaagtggcttctatgtaattagcagtgattccatcttaataaggtcctgtgatctgacaaaaaaaaaaaaactacttgatacaagtatttatgtcatatatgcctgtatttaaaaatccattaccaaaatacataatatagaaagagaaggtcttctttgagtatttttatatgttaaatgcagtaacattttaaatctttattctctttattcagcaactctgtggtacaaatttatcttgttgaaattctgcctctcactataaatagtttagttatatttttcaaagttgttttctttatatccatactaatatttgtatctgtacctatctacatagaatatagctataatcttcaacaaaactcccatttgtcattgtgcaactttttgtttttcacttaacaatatatcatgggcatactcataggtccatgggaaatacagatattaatgcattcattttgagagatgcacatagtttaaaagcaagcctgtgccagacattatttaaccaatgtcagaaatgcaaaatgcttgttccccagtgccacaaagaaatagcactcgaacataaatttaatttcctcagcaaggcaatttttactttctgcagagagggtgctcctggcagatggaacaatggcgagagcacaccttgacaggggaggggaagaggttcttattcctgacacaggcagcctctactgctgcattgttcccctattggctagggttggaccgcatagtctaagctaattccaattggctatttgaaaaaaaagagcaggagcatgagctggagtgccggggtgagtagtttggtgggaaaggtggatacgaacaggtggctcaggatgagtcaggatggagcaggtgactcaggtcaaagcaggtgaccaggggaacagatgtgaactgattaggactggtgggaaagttgtttactgaaaccagaagcaagggggcgaagagatccaggaagttaaactttaaaatggagaatcaaagaataagagagctgaacatattgacatactgattctttgaagagaaacttggggttcactatatttaacaccaatctcctactgaggggcatttggactatttcccattttttagagttataagttatgctacaatggccattatttataaaatatgtttgtttttgcatatttaagtatttgtttccatagcataaattcctagacattgagttgttgagtaaagagaataaacatttaaaatgtcactgaagtctaaaaattcccttttaagtacatatagtgccctgggcggctgagaaaatcaaacatacaaacaacagaaacaacgttatttaattctagctaagtactctggactggtggaggaagtatggaccctctttggtttattgagaaaagtcataagtgggtgacagagaagaattgaagacagaaatgcgccaagctgaaacattctccttggcataaccagaaacacccagaggacttggcaaggcaggaagcttcccacagtgccattcagtgctgctgcagctctactaatccatcatcccacatctagacagggcatcccacccgtcgggaaacccagccttccctcaccgccctgctctgccccagtccctcatggtgtagggtgtgctcctaccagtggtcccatcggatcctcacgattagcctgtgagaggagcctccagatgaggaggttgaggctcagagccatcaagtggcttggctacagtcactgcagggaggctcttgccttccagcctccctgctcctaccttccccgggggtgtctaggtccagttccagatctcagagtggccagcaggctgagccctggggtcaggggccagctgcctacacagaatgtggctcctggaatttcttgggtggtggggggggggcgggcttctccttgggatggggttctggggccgctctgggccatgaaagtttcccacagcttggaagaaaatctgccaccactgtgtaggggtctggcgagggaccattggcctggggcagggacctggggacatcacagaagccgaactgtctccctgtaccaccccctcccagctggctcttccctcacccacatgttcttggcatacaggtctgccctctccagcagctcccaccccccacctgctcagggctcctcgccttctcctgcagggcttcacagcaggctgcccttgcccagctcccctttgcagatccacagtctctggttttagattttgtgggtcttcactgcaggaactagaaaagtcacaaacatggggaagtaacacagtttctggaaaatcacagaattctaagtcccttttttcccctctgaagagacaagagggaagcttccacatctgaaaatttttctttttcattcttgatcttcctgaagcatagtgatggtcttggtgttcccttgctcaaacatcttcagtggctccccgtggcccagcaaagtcgagactccttcatggaatctttaaggccctccctgatctgattccaacctctcctactgcctctcccacatctgccctccaaggtccatccaccttgtgtgggccactagcttcctgacctctgcccctttttttggtgctaccgtcaccacctagaatgcccagtcttttatagctgaaggtcaaagtcttgctcaagcttccagcccagcaaaagctactttctccaagaagctttcctcattcttcagctgaaaatgatttctcttcgcattcctttgtctgtgcctcttatgggccctcacatctgttcagcattcttagcctcccataccctgtgcactcttacgcctccaggcctttactgtgctgtttctccttcttggaacattccttcctcctccctgtatctctcccccaactcctcacccttctcacttcctctcaactcagatagggccttccttgactcttctctccggtgatcccaggacatcttgcaactcccccagtggcctggttcctctcctggctctgacaataggctgtgagttgcagaagggagggaccacagctgacctgttcaccaccatgtccccagggccagggacagtgattgagaaatatctgttgcatgcccttcacctgca

SEQ ID NO: 17887 - DNA, 46156 bp, Homo sapiens
tgaggtggcaggattgcttgaggctaggagtttgagccagtctgaagaacattggaagaccagccccccatcccatcccactcctccccactgcctctacaaaacatttaaaaattagctggtcatgttgctgtgcacctgtggtcccatctacttgggaggctgattactcccctgccatcgcttgagccccgggagtggaggctgcaatgagctatggttacaccacaggctgaaaaaaacataaatgcattcaaatgcagatatcaaaatattaaagatgcaatttatgacattaacatgtgcttcttcaccctcaggtttattaaggtatgattgacaaaattgtatatatttatggtgtacagcatgatgttttgatatctgtatgtattgtgaaatgaccaagtcaagctaatttaaatataattatctcacgtacttattattattattttgagacagagtctcgctctgttgcccagactggagtgcagtgccgcaatcttggctcactacaacctccccctgccgggttcaagcaattctcctgccacagcctcctgagtagctgggattacaggcatgcgccaccatgctaggctaatttttgtatttttaatagagatggggtttcaccatgttggtcaggctggtctcaaactcctgaccttgtgatccgcctgcctcggcctcccaaagggctgggattacaggcatgagccaccgcacccggcctactttttaaaaaatttttattttagattcaagtagtacatgtgtatgtttgttacatgggaattaaatgtgtaatggtgaggactgggcttctagtgtacacatcaccaaaatattgaacattgtacccagtaggtaatttttcaccccttcctcctctcccactctccctcctttggagtccccagagtctatttgccccatctttatgtccatgtgtgccatttgtttagcttccccttgtaagtgagaacatgcactatttgatattctgcttctgtgttggttcacttaggataatggccttcagctgcatccatgttgctgcaaatgacattattttgttctttattgtgactgtgtagtattccatggtgtatcgccaccacattttctttatccaatcaactgttggtggacacttaggttggttccatgtctttgctattgcacataatgctgtgacaaacatatgtgtgcaggtgtcttttttatacaatgatttcttttcctttggatagatatacagtagtgggatagctagattgaatggtagttcccttcttagttcttggagatatctccatactgtttttttgtagaggttgtactaatttacatcctcaccaacagtgatatacttaccatttttgtgtggtgagaacatttaagatctactctcttagcaattttcaagtatataatacattattatttactatagtcaccatgctgtacaatagatctccagaactgattcatcctcaccgaaactttgtacatgttgaccaacatctttctatttctcccaccccagtccctagtagtcactattctactctctgcttctaccagctcaaattttcaagattctacacataagtgagatcatgcagtatttatctttctgtgcctggcttatttcacttagtgtaatatcctctaggtttgtccatgttgtcacaaatgaaaggatttccttctttttttaaagctgaatagtattctgttgtgcatacataccacattttctttatccattcatccactggtggacacttagttgattccatatcttggttaatgtgaagaatgctgcaatgaatttgagagcgaaggtatgccttcaacgtattgatttcagttcctttggatatatacctggaatagggattgctagatcatatggtaattctgtttttaacttttttaggaaccacttactgtttttcataatggctgtactaatttacattcccactaacagtatgcaagggtttccttttctctataccctcaccaacacttgttatctttcctgtttttgaaagtagccatcctaacaagtacgaggtgatacctcattgtggttttgatttgcctttctgtgatgattagcgatggtggacattatttttttatatccctgttggccacttgtttgttgtcttttgaaaatatttattcagatcctttgctcatttttaattgttttttttacatttattttaattttttttagctttaattttcatgggtacatagtaggtatatatatttgtggggcacatgggatgttttgatacaggcatgcaatgtgtaataatcacatcatggagaatggggtatccatcccctcaagcattaaacctttgtgttacaaatattcccattatactcttttagttatttttacttatacaattaaattattattaactatagtcagcatgttttgctatcaaatactaggtcttattcattcattcaagctattttaattgagttatttgttttctttctagtgagttgtttgagttccttacatattttggatattaaccccttatcagatatactgtttgcaaatattttctcccattctgtagattgtctctctttgttgattatttcctttgctgtgcagaagctttttagtttagtgcaattctatttgtctagttttgcttatgcttttggggtcatatccaaaaatttattgtctagaccaatgtcaagaagcttttaaattatgttttcttctagtagttttgcagtttcaggccttatgtttaagtatttaatccattttgagttttttttaatatagtataagataagggtccagtttcattcttctgcatgtggatatccagttttcccaacaccattaatttttttaactttctttctttctttctttctttctttctttctttctttctttctttctttcttctttcttctttccttctttcccttttttatgaatagagatggggtctcactatattgccaaggctggtctcaaactcctgggctcaagtaatccacctgcctcgggctcccaaagtgctgggattacaggcatgagcaccatgcctggcccccaaaatcatttattgaagagactgctgtttccccattggtacctttgttaaatatcaattgaccataaatgtgtagatttatttctggactcttattctgtttccttagtctatatgtcttttttatgccattaccatgctgttttggttactatctctctgcagtataatttgaaatcgggtaacataattcctccagttttgttctttttgttcaggatggctttggctattctgtgccttttgtggttccatgtgtatgttagtattttttattattattgctgtgaaaaatgtccttggaattttgatagggattgtattggctctatagatcactttgggtagcatggacattttaacaatattgtgtgttcttttttattaacctagcaaatagcacgatctagagcaggtctataatcatcacaatttttaaatagtgatgagcataactgatcttatgagatatttgcaacagctataatgtgatatgaaaatatttttgatatatgttggtgagaaagttgcagacactgataataagactgtaatttgttgactacattcaattagaaatgaataaaaataaaggtttaatttttcccatcaaagtccaaagagcacccctaaattctattcacagaacctcaggggaggaaatcttgtaccagagagtccattaattagtataaaggatgtaagaaataatatttcattggtgaaatgaattctgttaaaaatatgtgcaatggctagaaattttgtccatgtatgaaggtacatgcttgcatgaataaaagataaaaatctggcaagccagcccaacagttcagcatgttctggaatggcatctaggcctcagactttgtgtgatcctataaagagccagcttgccagatgtccctagtgataataaatgttattttcagccactacatgttgggggtaatttgtaacacagcaataaataaataaaataaataaatagtatcacgtaatagaagattttcctgttccaaccagaagataggttgatcctgttaccataatattaggccaactatttcatgtggattttttatgtaaaggacttgctggagttcctaaagatcagagcatgtattaggttggtgcaaaagtaactgcagttttcgtcattgcttttaatggcaaaaaccgcaattacttttgcaccaacctatacttgacccactttacaaggaaagactgtgtgactgttttggtccctgattgctaataactgtatgtgtcatagaattcagtctgacaattactttcattttaatattctacctagtaaggaggttgtaggagaggtgacttatggccctcgcctacctctaatattcagacgcttcttaaatctaccaaaaacaacgagtttaggtccatttgcaaagccctaggtaatctgacttttatctacctctctgaacttacctctccccacctaccctcacttctgtccagcaactctggttgtattcatttgctgggatgccatagcaaagtatcacaaattgagtggtttaaataccagaaatgtgttgcctcatacttctggaggcagggtttgttccttatcagggtctcactctgtcgcccaagctggagtgcagtggcacaatcatggctcactgcagtctcgacctcctggggtcaggtgatcctcccacctcagcctcccaggtagctgggaccacaggcatgcatcaccacgcccagctaatttttgtattttttgtagagatggggtttcaccatgttgcccaggctggtcccaaactcctgggctcaagctatccactcacgtcagcctctcacattgccgggattataggtgtgagccaccacatctgcctgggtttgttccttttgggggctgtgaggaagaatctgttccatgcctgtctcctatcttctggtggtttgctggctatctttggcattccttggcttatagaagcatcaccctgatctctaccttcatctttatatggtgttctccccatgtgcatgtttgcattcaaacattccccctgtttttagccaggcacagtgcctcacatctgtaatcatggctactcgcaaggctgacgcaggaagattgcttgaggctaggagttcgagaccagtctggatgatctaggaagaccctgtctctgaaaaaatttaaaaaaataaataaataaataagtaaaaaaaacttgccccctttttataaggacacagtcatattggattaggagcctaccctactccagtatgacctcatcttaactaattacatctataaggtacctattttcttttttctttttctttttcttttttttttttttttgagatagagtcttgctctgtcacccaggctgtagtgcagtggtgcgatctcagctcactgcagcctccacctcccgggttcaagcaattcctgtgtctcagccttcctagtagctgggactacaggcacgcaccaccatgcccggctaatttttgtatttttagtagagatggggtttcaccatgttggccatgactggtctcgaactcctgacctcacttgatcagcccacctcaacctcccatagtgctaggatcacaggcatgagccactgcacccagccagttccctattttcaaataaggtcatattctagggcactagaggttatgtcttcaacatatgaatttttggggagacacaattcaacatataactcttgccttcttgctgttcctctagcacactaagctgattttcatttcaggtcctttgtacatggcaagtctttctgtctagaaccctaaagaagcctggctgttcccgtctcagcatacacatgttatctcatatgccaccttctcaaaaaggacttccctgatcactctatttaaaatagcctctccagatacgtttgtcagcttgctcctttctgcctgtggatgccaacaaagaagcatcattaaagtctctcttctcccttccgtcgtgtctaagtcagagtctcctaaagagcccgaatagctgaggaagctcttcattggagagttgaggtttgaaacaaccgacgagagcctgaggagccattttgagcgatggggaatgctcacagactgtgcggtaatgagagatccaaacaccaagcgctccaggggctttgggtttgttacatacgccactgtggaggaggtggatgcagccacgaatgcaaggccacacaaggtggatggaaaagttgtggaaccaaggagaactgtctcaagagaagattatcaaagatcaggtgcccacttaactgtgaaaaagatatttgttggtggcattaaagaaaacactgaaaaacatcagctaagagattattttgaacagcatggaaaaatggaagtgattgaaatcatgactgaggcagtggcaagaaaaggggmtttgcctttgtaacctttgacgaccatgactccatggataagattgtcattccgaaataccatactgtgaatggccacaactgtgaagttaggaaagccctgtcaaagcaagagatggctagtgcttcttccagccaaagaggtcaaagtggttctggaaactttggtggtggttgtggaggtggtttctgtgggaatgacaactttggtcatggaggaaacgtcagtggtcgtggtggctttggtggcagccatggtggtggtggatatggtggcagtggggatggctataatggatttggtaatgatggargcaatttggaggtggtggaagctacaatgattttggcaattacaacagtcagtcttcaaattttggacccgtgaagggaggaaactttggggcagaagctctggcccctatggtggcggaggccaatactttgccaaaccaccaaaccacagtggctatggtggttccagtagcagcagtagctatggcagtggcagaagatgttaattaggaaacagagcttagcaggagaggagagccagagaagtgacagggaagctgcagtttacaacagattcgtgaactcagccaagcacagtggtgacagggcctagctgctacaaagaagacatattttagacaaatattcatgtgtatgggcaaaaaacttgaggactgtatttgtgactaattgtataacaggttattttagtttctgttctgtggaaagtgtaaagcatttcaacaaagggttttaatgtagatttttttccttgcacccatgttgttgattgctaaatgtaatagtctgatcgtgacgctgaataaatgtctttttttttttaatgtgctgtgtaaagttagtctactctgaagccatcttggtaaatttccccagcagtgtgaagttggaattccttcagggtgatgccaggttctatttggaatttacatacaacctgcttgggtggagaagccattgtcttcagaaaccttggtgtaattgaattgatagttactgttgtgacctgaagttcaccattaaaagggactacccaagcaaaatcatggaattattggttataaaaatgattgttggyacatcctatgcaatatatctaaattgaataatggtaccagataaaattatagatgggaatgaagcttgtgtatcatccattatcatgtgtaatcaataaacaatttaattctcttgaatgaaatgacaactctatggatttgggaatggcagagatttggactttccttacccactacccctgattatgttgaatgcttctatcacaattcaagttcaaagctctgccaggaatagaaactagctgctggctaatgctgctccataaacccacagatttgaagtgtttgggcggccttttaaaaatgaccatatcagaaagcattttaatgagcataaagataggcttccattaaaggagaaaaataaaatagcctctctacctcacacacatcattccctactccctttcctgtttcagttttcttcatagcactcattactacctgaaatacttttattttcagttgtttttatctgtccctcccaccagaatataagttccttgaggacaagaaacttgtttgtcttacttacttctgtatcattagctcctaacataatgcctgttcaaaattaaatatttaataaatgttgaatgaacattgaatgaacactcactttgttctccaattgagtctctaaaaaatccagtagaatcaagtttccactgagaaaatacagcttatttcaaactcctaaagacattcattttccccctttgaaataaactacacctatctaagagaccaattataaaacaataaaatactcctctctcccacagttgccttttttctctcttcttgtactaccaggaaactacttaatggtagcaaaaatcagagtgaagagaggttagttccaagacagaaacacattgtcaatctttactcaaagattgtccatcacctgctctctctccagcctarctagctcttttcaggcccgataggcacacattaatgggcctggctggaccacctatgagacagaaaagggtgatcccttccattagattaacaggctcagaaaagactagggaactaagctgactccttttttttttttttttttttttttgaggcggagtctggctctgtcacccaggcctaagtgcagtggtgcgatctcagctcattgcaacttccacctcccaggttcaagcaattctcgagcctcagcctcccgagtagctgggactacagggactacaggtattaaccacgtctggctaatttttgtatttttagtagagacagggtttcaccatgttagccaggctgatcatgaactcctgacctcaggtcagccacccgccttgacctccccaaagtgctggaattataggcgtgagccactgcacacagcctaagctgatttcctcttcttcttttttttttttttttgagacggagtcttgttctgtcacgcaggctggagtgcaatggcataatctcggcttactgcaacctccaccccctgggttcaagcrattctcctgcctcagcctcctgagtagctgagatcacaggcgtgccaccaccatgcccagctaatttttatatttttagtagaggcggggtttcaccatgttggccaggcaggtcttgaactcctgacctcgtgatccgcccacctcggcctcccaaagtgctgggattacaggtgtgagccaccccacccagccctaaactgacttctagctgagatttctgaatgtaagagctttaagtcagagcaatggctgttttgttcctcagaggtttttcaaaagagaattgtccacttcgagttctgacctgcctgaaaattgagtggtgaacctaatgacctcctgcctgctgcctcccagctcttatatgacttatgacaattactaagacaaattgatatctaaacaaagtctcttggggattttttgattattgtttgctttcatatcttctgaatgatcaaaagaggactctaacaggaacctttgatgtttatccaagtaaattcaggtttttcctgcaataacgaaagtaagcttgtttgtggtttgtgaagatttaagcaaaggaggagagaaaagttgatttttaaaaactgtttcttaaaagacaaatctttaaatgaacacaagaaagaatttaatttaacaattttctgagatcaggttccaacttttttctatttaatctttttccaaacctgcttaagtcagtagtttttaagcccttgtgagttgcagacaccttaggacaaagcatctcaaatttaatatgggtatgaaccacctggtggtcctactaaaatgaaaattctgattcagtaggtcaggggagggcattgttggatggatcaaatgcatctccaagcttccccacttgggcacccactttggcttcagcccacctccaaatgcccaatgcactcctgtttttcaaagtccactgctgcagtatcccattctaactattaattcttgtcagatgcccctgctacaaatctttctgtttttacctcaccttcaagtttacctctcttaggtgtgtttctctctggaccctactctcagtgaaaatataatgagcaacaggtgatcgtgggttgatgagttatttctctttctcccttggacagaagaccaagtccactcatccctccaccaccacaaggtaacaatggaatttaactatagctttcaggaacaaagcttttctcaaaggaaaaattccaaatggtaaaatttttctgccttataacacactaatggaaaggctattttttagtggtttggagaggaggaatagaatttctaatttctcagaaaaaaaaatccatacaacctacttagataactgccaatctgacctgcttacactctgctctgcctctcatctgctctggtcccattaaaagcaacattgtcttattttagaaatggaaccatgaaactgttaaacgaccagttatttcatggttatgtccaaagtggttgaaattccaaagtaagggaagcaaccaatttatctttttattttcttttttcttttttttttttttttactgagagaccttgatgacccatggttaagagcttcaaagcagcgtccaaagtcttaaccatgaaaatatttttcttaactgcaaagagggctcagtcttcacaattcaaattgtctcatcttgtactctccggaagggagggcaaatatttgcattctgttctgggagaggtcccttccgctaagaatgtgttaagtgctcctaatacaacaaaggaaaaggatttttttttaaagcagttgcatttccttatttaaaaggccaatcatttacacactgctttacttgcaaccgaaatagttccaatgcatttatccacagcacattatgctgatggtagggactgtacattgtcaacctttagctctgaaaacttgtgactttatcttcttcttcttttttttttttctcgagacggagtctcgctttgtcacccaggctggagtgcagtggcgtgatctcagctcactgcaacctccgcctccagggctcaagcaattctcctgcctcagtctcccaggtagttagctgggattacaggtgcccgccaccatgccyggctaattttttgtgtttttagtagagatggggtttcaccacgttggccaggctggtctcaaactcctgagctcaagtgactcgcccgcctcggcctcccaaaatgctgggattacaggtgtgagccactgcacccggcttatcttctttcccaggcagagtagtcagttcagagccagtaaatatggttgcaggaaagtcttttctttaccatctgtattactttcctattgctgctataacaaattactataaacttggtggcttaaagcaacacacacttattatcttatggttctggttgtcataattctgcattgggtctcactgggttaaaatcaaggtgctgacagggctgcattcctttctggaggctctgggggagaagttccagcccacattccttggctcctggcttcctttctctatcttcaaagtcagtaagagtgggtcatgttctcatatctcatcactctgacttctgtgtccctcttccatttttaaggatccttgtgattacattaggccacccatagaatccataataatctccctgctttggggtcagctgattagcaaccttaattccaccttcattcccctttgccatgcaaggtaacgtattcacaggcttaggatgtggacatctttagggggctattattctgcctaccacaccatcacatgacaaatgtttattgaacatctactgtgcatagagagctttgtgctctgccttaaggagcaatctggataagataggacttgctcagaaaagggtaaataacaatgggaggtttcacaggctatgagagaggtaagaagatgaggaactcatgctatgtcatgctataaaaattggaagacagtgtggtatgatgactgaggtggtcagagaagacttcctggaagaggcagagcttaatcggtcttcaagaaaaggcaagagttgaatattgtttctgagctgaataagtctcacatatacacttttgagggcagatttccaaagtagcagatgtaacatgaaagtactcattgctattctagtgatgtctccatgatacttactggcctaaaaatcactgttatacataccagctcatttgatgctcaccacagccctgtgatggaagtagggagaacagggaactacataaacctttccatcattgagtccccaggcccctttccaggcctagggccacccccagtgttctttcttccttatggccatggggataccacctgttttcttctttggtaattactccccaagcctagctgcagaatgagacacaaactctgcaccttcccagtttcttgctactattgaagccaagcacacaggctcatttaaaatttgctaaactctggagaaaacagggtaaaaccgacggacataaggtagtgacaaaagtttcataatcttacaaagtttgtataataatggtctctgatctatagtttctgctccccttttcaatagcaaaagaaagtaccattgagtttaggtcctctgcttatattttcttagggctcatcatcatcatcattattatagcaagcaactatggagtgctttttatatgtcaggcagtgttctcattgctttccatactttaactcatttaattcttataacaacccattttatggataatgaggcaggcttcaaacctaggtagactggctctggaatctatatctaaccagtacaccatactgctctaccatctcttccgtaccaccactttgccttctgcctatcaatataggctacaatttgaacactttctccatgagggatcagtacgctaggttacagatgaagaaactgaggctgagcaaagttagacttttccaagggagcattaatagtgagtggggagctggaggtcaaatccagctccatcataccatattgcctttacaaggtgctactttggtgaggtctggttctgctccaacatagtaaaaagaattgatttcaaataattccacatgtatcagtccctcttatcattatgggatgtttcatttttggacgctgtaatcaagaccaaattaatacctttaaaggctctaagatttaaaagaaacaaatgggccaggcgcggtggcttacgcctgtaatcccagmactktgggaggccgaggcgggtggatcacgaggtcaggagatcgacaccacagtgaaaccccgtctccactaaaaatgcaaaaaaaattagccggkcgcggtggcgggcgcctgtagtcccagctactggggaggctgaggcagcagaatggcgtgaacccgggaagcggagcttgcagtgagccgagatcgcrccactgcactccagcctgggcaacagagcaagactccgtcttaaaaaaaataaaattaaaataagtaaataaataaataaataaacgaatgtcctcccaacaccatcctctatggattcaaattaaacgtaattataaacaataaaataagtaaaacaaactatcattttccccatgactacttaaatttttgtttttgaaaaccaaccatcaaattcttttataaattcttaaaataattctcaaaacaattttttctgatgtcctaagcacatgtttaaactgttaagtaattcaacactctctgttatatattaattcctggaagaggtgtacaagagttgtaactgtaaaggcaaatttgggacaaatgaggacagacacaagtgatcagggagaagacacaacatgcaggtcaggtaagggctttgtgtttacagtttgcaagaatccacctaccatgggtgggatcaaccgtctacaggaaatctttccaaaagactgcagtctatggtaaaactgtgaataagttactgatgacatttaagtactccctagagatctccaggaagcaacctcaaatttagtcaatgcygcataatccataaacctgggaaatgcaaacattaagacaggtgaagcaatacagggtggaggggactattataatgtctagagccaacagaaggaaagcaattctgggagaatttacaaaaaagggaggttgatggtgagaagttttgtttatttattttaacttatttttattttactttaagttctgggatacatgtrctgaacgtgcaggtttgttacataggtatacatgtgccatggtggtttgctgcacctatcaacccataatctagtttttaagccctgcatgcattaggtatttgtcctcatgctctccctccccttgcctgccaccccccaacaggccccagtgtgtgatgttcccctccctgtgcccatgtgttctcattgttcaactcccacttatgagtgagaacatgcagtgtttggttttctgttcctgtgttagtttgctgaggatgatggtttccagcttcatccatgtccctgcaaakgacatgaactcattcttttttatgactgcatactattccatggtatatatgtgccacattttctttatccagtctattattkatgggcatttgggttggttccaagtctttgctattgtaaatagtgctgcagtaaacacacacgtgcatgtgtctttatagtagaatgatttctaatcctttgggtatatamccagtaatgggattgctgggtcaaatggtatttctggttctagatccttgaggaatcaccgcactgtctttcacaatggttgaactaatttacactcccaccaacagtgtaaaagcattcctatttctccacatcctcgccagcatctgttgtttccagactttttaatgatcaccattgtaactggcgtgagatggcatctcattgtggttttgatttgcatttctctaatgaccagtgatgatgagctttttttcgtatgtttgttggccacataaatgtcttgatggtgagaagtttttagtgtgtccggcattgcccaagagagggaggtttcagatttggggcatggatattttagttgaatttgctggtgtaatcttaccttgaaaagggccaagtgagtttgctgctgcagcttaatagtaatattccgttaagatcatctgactatcttagctcagattctgtgatcaccagcttatcaaaagacttcctagtactctgatattgggaatgggggtcctacctcacagacataagggtccaatcagcatggcatatataattctttagataatacataaattgtcatccagattatagatcattcttttatgaatcacaggatctcaatgttggagtatatttaagggacatttagttaaccatctacctggtgctgatattccccttataaaaagctgacaaggggttgtccatttttccttgagagtctcaagtaataggaaactcattacctctttacttctctgaatacccgtgttggaaaattctgctttatattgaaaaaaaattgtgttactttatttatttttatttttattttttgacacagaatcttattctttcgcccagtctggagtgcagtggcgtgaccttggctcaccacaaccctcgcctcctggattcaagcgattcaagtgcctcagcctcccgagtagctgggactacaggcatgcaccaccatgccaggctaatttttgtatttttggtagagatgggggtttgccatgttggccagccaggcttgtctcaaactcctgaccccaggtgatctgcccgcctcagcctcccaaagtgctgggattataggcgtgagccaccatgcccaacctaaagtgtgttactttagagcctctattccttggttgactccttgggtcacatacaaaacaatctaaatcttcttaaaaaaaatrtagataaactcatgtccccgataaacctctttccaggccaaattccctacactctttaaatcctcctaatataggatgctttcaactcattacatcatcttggtcacccttccatggacaggctttagtttctcttttaatgtgtggtcttgggcacgggcaagtgtttttgtaaaatttacaaatgtaaaatattttcattgctagtgattgactgtctcttaccactccaacttccctctgtcacacttcccctcaggtcaagtgatgctggagtggccatgagcatttctggaatacagataagaggttgttgtgttggtggtatatttagtttggatttaggagaatatatattatgtggttcactgacacttctatatctagttaactgattgatarctgccttagtgtagaaatggcttccagraaaactcctaccacccactgtgccaatttcacctggcattatgatactaaattgcaggtgtgttcagcagctaatgaaaatgttgtttttatgggttttgtgatgttgaagagatttttcagctttttacaataaatataaaatgtgctgtgcattgcgctatactccttataatgggaacatttcatggcatataaattatacctcaataaatctgttaattgtgctgtgctttcttttctgttttaaataaatatttgcttttgtgcctaaagtaaagtaaaataaaaatatgtagcagkatatctacaaaacctatacaaaacattctacttaagggtgaaatggaagaatcccctttgagattgggaattaggcaaggggatcactacttctacctttgtgcagcattgtactagaagttctagtgagtgcagtaagcgaagaaaaagaaataaaagttataagaattagaaaaaagaaggctgggcacggtggctcacgcctgtaatcccagcattttgggaggccgaggcaggcgtaycacctgaggtcaggtgtttcagacctacctggccaacatggtaaaacccagtctctactaaaaatagaaaaattagccgagcatggtggtgggcrcctgtagtcccagctactcgggaggctgaggcaggagaatcgcttgaacccgggaggcagacgttgcagtaagccattgcactccagcctgggcracaagagggaaactccgtctcaaaaaaaaaaaaaagaattagaaaaaagaaataaaactgtgtttagagcgaaaaatgtgactgtgtttatagacaatgtaagacaaaatacagaaatattattacaattaataagtgagtttagcaatgttgctgggcataaaaatcaatatgtaaaaacaaattgtatctttaacagccatcattaaaaattaaaattaaaatatataatttacaacctcatgaaaacatataaagttcttagaagtggatataacaggctgggcacggtggctcatgcctgtaatcccagyactttgggaggccgaggcaggcggatcacgaggtgaggaggtcgagaccatcctggctagcayagtgaaaccccgtctctactaaaaaatagaaaaaattagccaggcgtggtggcgggcgcctgtggtcccagctactcgggaggctgaggcaggagaatggcgtgaacccgggaggtggagcttscagtgagccgagattgcaccactgcactccagcctgggcgacagagcgagactccgtctcaaagaaaaaaaaaaaagaagaagaagtgaatataacaaaggagacgcaagaatttgattataaaatttacatgaaaatgaaaaaggccaagaataaaaacaaaacacagaaccccccctccccccaaaacaaagaaacaaacaaacaaaaagtcaagaatagccaaagcactcttgaagaacaaggtggggaaacttgtcttatcagatgtcaagacttagtaattaaggcagtggcatggaagaactgaatggagagctccggaacaaactcgtgtatatagacatttcatatataatagaactgacattttagatcagcgaagaaagtatatttttgaaagtacttttcaaaaatggctgagcgcagtggctcatgcctgtaatcccagcactttgagaggcccacgtgggtggatcacatgaggccaggaggtcaagaccagactggccagcacagcaaaaccctgtctctactaaaaatacaaaaattagccaggcatgatggcgcttgcctgtaatcccagctactcgggtggctaaggcatgagaatcacttgaacccaggaggtgaaggttgcagtgaagggagatcacaccactgtactccaacctgggtgacagagtgagaccctgtctcaaaaaaataaaaataaaaataaaaagtacttttcaaaaatgatgctggggcaattcgttttccatatttaaaagtagtaaattggataccatacatgaaaatcagctccaggtggattcaaaacataaatgtaaaatgcaaaaatataaaatttctagaagaaaatataaaagagtatcttgatatctgggtagtgatggatttctaaaacaagacataaaatgcataaatcataaaagaaatgactggtaatcagagtgcattaaaattaagaacttccatttatcagaaaacactattaagagactgaaaagacaagccataaacataagcaataaaagattagtataagattataaacagaaccctaagaatctaaaagcaaaagaaaaaccaatagaaagatagaccaaaaagtagaataggctcagaataggctcttttaaaaagagaaaactcaaatggccagcagttgaattaaaagatgctcaaactcattagtaatcagggaaatgcaaattaaaatcataatacgatagttttccacacttacttgaattataaaaacaaaaaagtctggaaaataccaagggttggtaagcatgtagaggaagtagaactctcattcataactctctgtagtatacatttaggtggtcacttcggaacgggtttggaattacacagcaaagtagaatatgtgcaaatctcaggaccctggaattttactcctgggtatataccttagagaaactgtagcatatgtgtgacatttgatcaacattgttccatcatcatatccatcagtagtaggatgaatgaatacattaatgtatattcattcatgcaatggcatattagatagcagtgtaagtgaaccgcaattacatgtacatgtatgaatctcaaaaacccaatgttgaaagaagcaaaccacagaagcatacatacacactgccaggtttcatttacaaaaagttcaaaaacaggaaaaactaaacaatatattgcttagggatgcaattatagttagtaaaaatataaagaaaaataacagaatgattaccccaaatttcaggatagtgattacatccggtggggtagaggaggggaagaagatagatgtgatcagggagggaaatacaaagagctttaagatactggagaaaaatagtctattttctttaatctgagtagtgaacacatagatacttattccttaaaattattctttaagttacatatgtatgttttatatactcttctgtgtatatttcaccattttagaaaagggaaaaaaaatcagtgcccagagctgaacacacaactctagtaaatctatcatactagaagacaatcatctccattcttttgagtgctctgcctctgtttattttgaaccaaagtgcacttttatacttgttaaattttctcttgctctatttggcccttcttttcacttgtccttccagccagtcaagttctccccaaagccatcatcatatatgtcaaccacagatcatcctccaggggaactgktatgctaaagtttctgagctagccaggctgaaatccaaatggcagccggcagatgtggcaacagtttgaaaagtgcactttgaaacagcttccttaccacacacgcttccctccctacttctcctgaagtaatctgtttacagacccagactaataatcttttttatgagaaactttagcaaatcttttatctaggaaggcaatgcttcacattaggtcatgttgataagatgatgagagagaatattttcatccaagaatgttgctatttcctgaagcagtaaaatccccacaggtaaaacccttgtggttctcatagatagggctggtctatctaagctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactrtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggygctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatrtaactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaytcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaaccyttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagagkatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctytttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcrggaratcgagaccmcggtgaaaccccatctctactaaaaatacaaaaaattagccaggcgtggtggcgggcscctgtagtcccagctactcgggagactgaggcagaagaatggcgtgaacccagaaggcggagcttgcagtgagccgagatcgcgccactgcacyccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgtaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccayagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccasctactcaggaggctgaggygggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggstgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcrcaagtgtgcagagtcttttgagatgtgggatgatcgtgactcycactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatrtctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacayggcaaaaccckatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggyaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattaygactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacrtaaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaatgaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaagtgggcaaaggacataaagaaacacttttcaaaagaagacacacacrcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtgrcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacrctgaataaatgtctttttttttttaatgtgctgtgtaaagttagtctacwctgaagccatcttggtaaatttccccaacagtgtgaagttagcattccttcagggtgatgccaggttctatttggaatttatatacaacctgcttggrtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaataccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcttcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctgtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaaagaaagaaagaaaggaaggaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcactctgtcacccaggctggaatgcagtggcgcgacctgggctcactgcgacctcctgggttcgagtgattctccttcctcagtctcccgagtgtctgggattacaggcgcccaccaccacacttggctaatttttgtatttttagcagagatggggtttcaccatgttggccaggctggtcttgaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttattttatttttttggagacagtgtcttgctctgttgcccaggctggagtgcagtggtgtgatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggagaatcgcttgaacccgggaggcagaggttgcagtgagttgaaatagcgccactacactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgtcattagagtttgctttctttggtctatgtgcttcattcacaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgggaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatccacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttcttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccacgttggtcaggctagtctcgaactcctgacctcaggtgatccacccacctcggcctcccaaagtattgggattacaggcgtgagccacgcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggc

SEQ ID NO: 17888 - DNA, 33683 bp, Homo sapiens
aatagagaatttccagtattgtgttgtgatgaaaacaaaactgatgtggtggggccagcatactgagaggccgaggtgggagggtcgcttgaggcaaggagaccaacctgggcaacaaagtgagacctcatctctacaaaaaaaaaaaaaaaattaaaaattagccatgagtggtggcatgctagttgggagcctgacccagggggttcactggagcccagttcaaggctgcagggagctatgatggtgccactgcactccagcctgggtgacagagtgagaccccatctccaaacaaaaaacaacctaggctgggccaggcacaggggctcacacctgtaatcccagcgctttgggaagctgaggtgggtggaacacttcagatcaagagtacgagaccatcctggccaacatgctgaaacactctctctactaaaaatacaacaacagccgggcgcagtggctcatgcctgtaatcccagcactttgggaagccgaggcgggcggatcacgaggtcaggagatcgagaccatcctgactaacccggtgaaaccccgtctctactaaaaatacaaaaaaattagccgggtgtggtggcgggcgcctgtagccccagctacttgggaggctgaggcaggagaatggcgtgagccattcgggaggtggagcttgctgtgagccgagatcgcgccactgcactccaaaatccagcctgggcgacagagcaagactctgtatcaaaaaaacaaacaaacaaaacaacaacaacaacaacaaaattagttagacgtggtggtgcatgcttgtaatcctagctacttgggaggctgaggcaggagaatcacttgaacctggaggtggaggttgcagtgagatggaggtgcagtggcactgcacactccagcctgggtgacagagcaagactccaaaaaaaaaaaaaaaatcctgatgtgaagcgggtgatggggttgggaacagtaatgagtggtccagaaaacccttctgagaaggtgcatttgagctgagctcatggtgcttggtgttgggtttgtagacatggcacagacctagtcttcatccctgacaaactcttccctggccccaagcctgtgtgtgtccatcctcttctaaaaaaagcttggacttgccagtctagaggtgagggtccctgggagcaacgtggaccctctggagaaggacgcttagcctgtggatctccgaagcacactttggaggtgagagatgaaaaaaaagaggccgggcacggtggctcacctctgtaatcccagcactttgggaggctgaggtgggcagatcacttgaggtcaggagatcgacaccagcgtggtgaatatggtgaaacccgtcgctactaaatatacaaaaattagccaggcatggtggcacgtgcctgtagtctcagctacttggaggctgaagcagaattgcttgaacccgggaggcggaggttgcagtaagccgagatcatgccactgcactccagcctgggcgacagagtgagattctgtctcaaaattttaaaaaattaaaaaaaaaaattgtgcttctcagtggccctgctcctgtggctgcaatatggaggaagagtacaaagggtgggtacaaagactggcctctgtcttgctgttgggaaatccagctgccacgttgtgagcttgtgtctggaattggttccttctggtgggttcttggcgtcgctgacttcaagaatgaagccatgcaccctcgcagtgagtgtcacagttcttaaagatggtgtgcctggagtttgttccttcagatgttcagatgtatctggaatttcttccttctggtgggtttgtagtctatgctgagttcaggagtgaagccacagaccttcgcggtgagtgttacagctcataaagataatgtggacctatagaatgtgcaacagcaaaatttattgcaaagagcaaaagaacaaggcttccacagcatggaaggcgccctgagccagttgcagctgctggctagggtggcctgcttttatttccttatttggtcccacccacatcctgctgattgatccattttacagatagctgattggtccattttacagagtgctgattggtctgttttacagagtctgattggtccgtttttacagagagctgattggtgcgtttacaaatctttacctagacacagagcgctgattggcgtgcttacaatcctttagctagacacagagcgctgattggtgcatttacaatcctttagctagacagaaaagttctccaagtcccctacctgattagctagacacagagcactgattggtgtgtttacaaacctttagctagacacagagtgctgattggtgcatttacaatcctttaggtagacagaaaagttctccaagtcctcaccggcccagaggcccagccatcttcacctctcaagctgtctgtagaggtccacgtgtcaagaaaactgaggacagaggccctcagtccagttcccacaagcaactgcatctccccaacagctgcctgaatgagtttggaagcagtcctcccaccattcagccttcagatgaaactgcacccctggctgacaggctgattgcagccttatagcagaccttaagcctgagacattcgacccacagaaaaggtgataattttggtctttttttttctaaacaggttcttgctctagagtgcagtggcacgatcatggctcactgcggcctctacatcctgggttcaagtggtcctcccacctcaacctcctgagtggctgggactacaggtttgtaccaccatgcacagctagtttttctctttttttcttctttttgtaggtacaagggtctccctgtgttacttaggctggtctcaaattcttaggctctagcaatcctcctgtctcagcctcccaaagtgttgggattacaggcatgagccactgcactggggcaatgttggtcttaggctaattatgcagcaggagatacatgcactgtgctttgggaattgaagtcacttctatttctttgtggcttcatcagtaatatggggcagggggcacggttcccacagctgattcttgagtgttctttctgagtatccttaatacttcacacactatcatatatctgaactttgttcattgattatctcccctttaattttcattccttgatgaatctccagggtctggattaagtcctaggatactttatgtactcatgaaatcttcaatgaatgaagaaatgattttttttttttttgagacagagtctcactctgtcacccaggctggagtgcagtggcatgatcttggctcattgcaacctccacctcccaggttcaagcaattcttctgcctcagcctcctgagtagctgggactacaggcatgcgccaccatgcctggctcatttttgtatttttcagtagtgacagggtttcaccatattggccaggctggtcttgaactcctgacctcaggtgatccacccacctcagcctcccaaagtgctgggattacaggtgtgagccactgcatccggcggatttttttttttttttttttgagacagggtctcactctctcgttcaggctggagtgcagtggcgtgatcttggctcactgcagcctccacctcccagtttcaagtgattctggttcggcctcccaagtagctgggactacaggtgtgtgccaccatgcctgtctaatttttgtattttcaccacgttggccaggctggtctcaaaactcctgacctcaagtgatccgcctgcctcagcctcccaaagtgctgggattacaagagtgagccaccatgtctggcctgaatgaagaaataattttttaaagagtgttttaaagtggggccgggtgcggtggctcacacctgtaatccccacacttttggaggccaaggtgggtgggtcacttgaggtcaggagtttgacaccagcctgaccaacatggtgaaaccccatctctactaaaaatacaaaattagctgggcatggtggcagatgcctgtaatccccgctacttgggaggctgaggcaggagaatcacttgaacccgggagggggaggtcacagtgagctaagatcgtgccattgcactccagcttgggtgacaagagcgaaacaatgtctcaaaaaaaaaaaaaaaaaaaagaaattgcatttcaaagccaggtgcagtggctcacacttatagtcacagctacttaggaggctgcggtgggagaatagcttgagcccagttgttcaaggctgagtgagctgtgattgtggcactgcactctagtctgggtgacagagtgagaccctgcctgtaaaaaaaaaaaaatctttcaggccagacgcggtgactcactcctataatcccagcactttggaacgccgaggcgggtggatcacctgaggtggggagttcgagaccagcctggccaacatggacaaaccctgtctctactaaaaatacaaaaatagccgggcatggtggcacatgcctgtaatcccagctactcgggaggctgaggcaggagaattgcttgaactcgggaggtggaggttgcagtgagctgagattgtaccactgcaatatgagactccatctcaaagaaaaaaaagaaaaaaaaaaaaagatagcatagcaatggctgtgggcctggatacaagtcttagcctctccacttctccacttcctggctctgtaagccttagacaagttccttaactccacacttccatttccatgtaacaaggggttataggccaggcattggtggctcatgcctgtaatcccagtgctttgggaggccaaggcgggaggatacttggggacaagagttcaagaccagcccaggcagcacagtaagacattggctctagaaaaataaaaataaaagaaatcatccaagaatggtgacttgcctactattctactcgagaggctgagaggggaggatttcttgagcccaggagtttgaggatgcagtgagctatgatcacatcactgtacttcagcctgagcaacagcaagatcctgtctcaaaaaattaaattaggctgggcttggtggctcatgcctgtaatcccagcactttggaaggccatggtgggcagattgcttgagcccaggagtttgagacgaggctgggcaacatgacgaaaccccggctctaccaaaaaatacaaaaaattaactgggcataatggtacatgtctgtggtcccagctactcggtaggctgaggtgggaggaatgcttgagcccaggaaataggggctacagtgaaccaggatcatgccagtgcactccaacctgggcaacagagcaagactctacctcaaaataattatttaaaaaaatggattaattgggcataggtggcttgtgcctgtagtcccagttactcaggaggctgaggtgggaggattgcctgagtctaggaggttgaggctgcagtgagccgggatggcaccattgcactccacctgggcaacagggtgagaccctgtctcaaaaaagaaaaaaaagggaggggttataatcactcctcctgacatgatacagagtatccatttgagttcataacataaatatgtacttggtgaatgctctgtaactattggcttttttattgttcccattttacatataaggaagctgaggctttgtgaggagaaatagcttagcccaggtcatccagtgggaagcgtctggtgcagaggaatagtgatcatggtgggactttgcctagcctaaggttcagcatacaatattcagtcagtactcaagggctgggctgtttctggtaatcaaagggctgccttgttctcctgccccacagcacaggaaattccaaggtggttttctttacaggctcctccgcttctgtggccagaggggacagcggaggagcccaggtacctaagccaactcaagagaagatggaattgaatatttcaaccaccttatctaggcctctgtgattgttgaggagggggctgtcactgggaaagttgtgagctgctttggaccttatctgggaatttccttgggcttacagcctttaccctatccttgaaatggttctggtttcatagcaacttctaggtggtgtgggcgaagtttgggactggtttagggcggggayaagaccaagaacacaagttyccttgtactacgggagagagggaggggaggaaattggagaccccagcacccccttgctcactctcttgctcacagtccacgatggcccggtccctggtgtgccttggtgtcatcatcttgctgtctgccttctccggacctggtgtcaggggtggtcctatgcccaagctggctgaccggaagctgtgtgcggaccaggagtgcagccgtaagaatggggaggggagaattgggggcttgggcgttagcctgtgtggagggtgctgcattcccttctattccttccctagaccctatctccatggctgtggcccttcaggactacatggccccygactgccgattcctgaccattcaccggggccaagtggtgtatgtcttctccaagctgaagggccgtgggcggctcttctggggaggcagcgtgagtcttgggagagtgaaagagggaagggtacagagctggrgtagactcattatccccatgaagggaagatttgaggggggtgaactgaaatagacattgtggggggatattgttacttactttattttatttgcttattattttttaattttttccgagacagagtcttgctctgtcacccaggctggagtgcaatggcacgatctcggctcactgtaacctccacctcttgggtttaagcgattctcctgcctcagcctcccaagtacctgggattacaggcatgcaccaccacacctggctaatttttgtatttttagtagagacagggttttaccatattggccaggctggtcttgaactcctgacctcatgatctgcccgccttggcctcccggagtgctgggattacaggtgtgagccactgccccccagcctattttcactttatttaccaattttaggacctgatatggtcccatgttctgttctagacaccaagatacaacaacaaatgatcctttttattctaatggagggaaatgaacaaaaagcaaggcataaaaaatagcagcagccgggcacagtagctcacacctgtaatcccaagtaaggccaagttgggaggatagcttgagcccaggagttcgagaccagcctgggcaacatagcaagacccccatctctataaaaaaaaatttaaaattaactgggcwtcatggcatgtgtctgtggtcccggctactcgggaggctgaggtgggaggattgcttgatcccagaagttgaggctgcagtgagccgtgatcatgctactgcacctcaacctgggcgacacaatgagaccctgtttccaaaataataataataataaaagcaaatatgcgctgctgtgagaattaacagagacttacttgggtgttcagaaagggcctctgaacaggtggcatttaagctgagattcatatgacaaggatggagcagttatgtggagatcagggagaagggagaatgcaaaggccttcagcaggcacaagcttgccatcttcccagaccctagcttttaactcctcttccccaggttcagggagattactatggagatctggctgctcgcctgggctatttccccagtagcattgtccgagaggaccagaycctgaaacctggcaaagtcgatgtgaagacagacgtgagtgtcatgggggctggcaagaaatgtggggggaggacccttaggttgtggggatgggcaaaaatgctcccacacttggctccctggcagcctaggtatgtgcgctgggagaaattctttccctgcctcaattttctcaccagtaaaatgggtccagttgggaggtgcaaagattagagggctctaggctaatttgcatagcacttgtgtggccagacctgggccctgcagctgcagcctttgctaaaaccactagatcctttgtggtgtgaccgctggttttctttccactgtttcccctttctctttttcagaaatgggatttctactgccagtgagctcagcctaccgctggccctgccgtttcccctccttggstttatgcaaatacaatcagcccagtgcaracggctcgtctccgtggtctttggggtggggtagggtagggtggggactgtacaaatgaaatgtttctctaggttgctgaatctaaccaattaacccgctgcctgtggtaacgtcagtggttgctaggcagagtttcactgatgaaagccctgtgcagtaggagcgctcctaagcttaggtttcggacacaagcaaaggaaaacctaagcagcccaactaggggattgtagtgtcctctctagaccagtgggagggagccaatcggactacgcggaggatataaatcgcacagtaaagrttttcttggaagattatctggaaagggaggtgggaagtaacctgcgcctatctgcccagttttcctccttttcgcctttgagaacagtaatcgctcccgccagctcaagatcagctcctcttccagcctctttctgtcaatcctgcccgtgcccccttctttgcatttgtatcccctcccccaagtccgctccgatccaatccggagactcgactctgccccccgtactccagactaaatccgttcctcggctcagctaagcagctctgcacgtcccttcccacttgctcagccaatcgctgggctcggcyccgcccctttgggcttggtccttctcacgccaccaatccgcgcctcttgtcccgccccctgcccgcgagtccgccaatcccgcccttcggaaagcgtcgcctggtatccagctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtrtgatggaggcaggacctaagtggatgctgggwggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggcaaagggtgggacttatgcatgagaatggagccgggttctgggcagagggagggaaggagaggtcgggaagtggaaaatcagtagggatgcaccataggaggtggtgattggaggcaggggaagtgcaggtttaggagtcagagggagccgcattcaytcaacaaatatagaagagaagggagaagagtgcaaagaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatcygggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcrgtggctcatgcctgtaatcccagcactttgggaggctgaggcaggcggatcacctgaggtcgggagtttgagaccagcctgaccaacatggagaaaccccgtctctactaaaaatacagaattagctgagtgtggtggygcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagcyrgtggggagggcagggctggccataggtacaagtccagtgctggctttttggtccttgctttgtcgtatgtcctttactaggttctcsttgacctcaagtcactccagcaaggagaatgggtttgtagagactgagagggccttggaggrtgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatagtgagaccccatctcaaagaaagaaaaagagatagagaaaagtggcttgggggtggggaaagggatggagactgagagacaccgaaacagaaagagaaggggaaacttgagagactcacactcagaaaggaaaagagcaagagagacagagactaagagagttgaagagaatgataagggaggtaaggaggcctggcacggtggcttacacctataatcccagcactgtgggaggctgaggcaggtggatcacttgaagtcaggagttcaagaccagcctgccaatatggtgaaaccgtgtctctactaaaaaaaaaaaaaaaaaaaaaaaatcaaaaaatgtagccaggctgtggtggtggatgctagctacttgggaggctgaggcaggagaattgcttgaacctgggaggcagaagttgtagtgagtcaagatcgcaccactgcaccccagccggggtgacagagcgagactctgtctctgaataaataaataaataaataaatgaataaataaataaataaataaataaataaataagggaggtgaggagacacagagaaacagaggtcagaggcagagagggagacagggtgagtcagacaggtgtagttggacgttgaatgaatgaatgcacgaatttacgggaaggcaagggtgagcatgagagccacagagatggaacagaaagagagacagtgagaaatagggaactgaagacacacacgccaaggcaggagaaccgcttgagtccaggagtttgagaccagcctgggcaacatygtgaaatcccatctttccaaaagagagatggagaaatggacgtgttgtgggagagagagagagagaaatgcgtagggctcaacacactgtaggtcttcaggaaatgcctgcagagcagaaaagttgatagacacatagaaaccttaggagaggccgggcgtggtggctcatgcctgtaatyccagcattttgggaggccgaggcgggcggatcacgaggtcaggagatcgagaccatcctggctaacatggtgaaaccccgtctctactaaaaatacaaaaaattagctgggtgtggtggcagacgctggaagtcccagctacttgggaggctgaggcaggagaatggcatgaacccagaaggcggagcttgcagtgagcccagatcgcgccactgcactccagcctgggcgacagagctaggctccgtttcaaaaaaaaaaaaaaaaaaaccttaggagagtcggagaaacagagagcagggagagaaatagagggaattcagtccacggaaaagtgtgatctatggcagcatctagtagctgctgagttaattcttgcgtatggattaactgcctgaggtgcacagagcccaaaggcagagagaggggctgaaggatagacaggtgtgtagcatgggctaggtttacggtgagtgcttagtaaatgctgtggaatgattgcatgagttccagaaggacccagactggtgagacagagaatgcagaattggctacactgggaaggagactccacctgacacagcaggagaaggataagcagatgttgtatagtgcttgggcagggccaggcaaaggggagatttgctcagaaaatgttgaatgaatgaatgcacaaatgcatgggaaggcaaaggtaagcatgagagagccacagagatgaaacaaacaaacaaaaaagacagaaatagggaattaaatagggccaggcacggtggctcacgcctgtaatcccagcactttgggaggcctaggcgggcagatcacttgaggtcaggagttcaataccacactggccaacatggcgaaaccccatctctactaaaaatacaaaaattagccgggcgtggtggtgcatgcctgtaatcccagctacttgggaggctgaggcaggagaatcacttgcatccggggggcaaaggttgcagtgagccaagatcacgccactgcacttcagcctgggcgacagagcaaaactccatctcaatcagtctcaatcaatcaatcaatcaatcaataaaagacatgtagggccgggcacagtggctcacgcctgtaatcccaacactttgggaggccaaggtgggcggatcacttgagctcaggggttcgagatcagactggccaacatggccaaccccatctctactaaaaatacaaaaattagcctgatgtggtggcgtgcatctgtaatcctggctactcgagaggctgaggtgggagaatcacttgaacccgggaggtggaggttgcagtggttgcagtgagccgagatcatgccactgcaccccagcctgggagacaagagtgagattcctactcaaaaaaaaaaaaaaaaaaaaaaawaraaaaaggaaaaagacacataggttaaggcaggagaatcacttgagcccaggagttggagaccagcctcggcaacctagcaaagccccatctttacaaaaaatattaagaaattagccaggtgtggtggtgcacacttgtagtcccagacactacataggctgaggtgggaggatctctccgttgggatactgagcctaggaggtcgaggatgcagtgagccaagatcgtaccactgcactccagcctgggctacagagcaagaccatcaaaaaaataaaaaataagacacacatgaaagagacacagagagaaaaacasacgaatggaaagatagggacacagggagagacaaaaatggagattcataaatagagacagctggccagctaagtgagatagaagctgagagaggcgaagagagagggacttcaaggatgcaagaagagagaggaattgcatggtgacccgaccaaggccaggttttgggggatgggccagcagtgaagkggggggcctccgaaccaccagtctgtctctgtagaggggggcattctcggggcagaccccagccttgggggtgactgggtccccctggccccacaggtcagtgacgcggagttattaccgaggggcggctggagccctgctggtgtacgacatcaccaggtgggtgcccrgggtgggtggggtagggcatgggtggttcctctcctgcactgcctccctcccttctcccttctccacagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatggtgagggctgtgtcgtggaccaggtggtggtgggggtggacagtccacagggaccatgggtttactggctctcagtggctgtacccagcaggggaacgtggaggttcagaagtctgggttcaaatttgagtgttggctgggtgtagtggctcacacctgtaatcccagcagtttgggaggccaaggtgggaggactgcttgagcccaggagtttgagaccagcctggacaacacagtgagatcctatctctataaaaaatttaaaaaattagctgggtgtggtggctcatggctgtagtcccagctacagtggaggctgaggcaggaggatcacctgagcctgagagtttaagactgcagtgagctgtgatcacgccattgtactccagtctgggagacagagcaagacactgtctccaaaaaaacaacaacaacaacaaaacaacaacaaaactaagtgttgccatcagtgagctatgtgattacactggttctcagtttcttcatctggaaagtgggatcacagtgtttctgccccacagtgtgctgtgatgattaagggagattgtggaaagtccttagcacccgccacagagtgggtgctagattaatgttggccgctaaggtttcgcctaccgtcaggaggccgcacagggtattggttttttaaattaattattttatttattttttcctcctaccgcaccttcctgggtattggtttaatgtagagattgcaaccctagatggccctaggtgaaaggcacttttttttttttttttctgagacggagtcttgttctgttgcccaggctggagtatagtggcgcaatctcggctcactgcaacttctgcctcagcctcccgagtagctgggactacaggtgtgcgccacaacgcctggctaatttttatatttttagtagagacggggtttcaccatattggccaggctgatctcgaactcctgaccttgtgatccgactgcctcggcctcccaaagtactgggattacaggcgtgagacactgcgcccggtgaaaggcacatttttgaatacaggagatgggatggggtagatccttgagtaacaggtactggtgttaaggggagtgcagcatactgacaacccacaccaaaargtttgcaagggccaaccacaatggctcacacctgtaatcccagcattttgggaggccaaggtaggagcatcacttgagatcaggagttttagaccagcctgtgtaacagagtgagaccctgcctctacaaaaaaaaaaaaaaaaaaaaagcctgggtgtggtggtatgtgcctgtggtctggggtactcaggaggttgaggcaggaggatcacttgtgcccagaagttcgaggctgcagtgatctgcaatcacaccactgcactccagcctgggggacagagagagactttgtctcaaagaaaaaaacaaaaaaggtttgcaagtataaactcatttgaaaacattgtgttggccaaaccacccacatctggtggcttgagatctgcctgtgttcccctgttttgcaacctccaggtttaaaggaggttttgccatcagagaggtgtgggtgtgaattcagctctgattttctgactgtggggccttgtcatgctgctgatgggtagactctggttggcctgttcctgtcctaratggtgctagagacacagtgttggagacagccctaggcccaaccttcatggagctcacagttcagtgggtgagggtggaaggacagacccacttccagacagtgacacctcaggaaggtcagggcttgatggtgaagcaccgggagacaggggtcagagccagcaggggagagccccagagggtcagggccagtactgggggggcaggcagagggatcggggtgggatggagaacacaggcagaggggtcagggctgggatagggcaggcagaggcagaggggtcagttgggatgaggggacacaggcagaggagttacatgggatggggggcaagggcagaggggttggggtgggatggggggcccaggtagaggggtcaaggccaagtttgggaggcacaggcagagcggttgcatgggatgggggagcatgggcagagggctcaggggtggaatggggcaggcctaggcagaagggtcaggggtggaatggggcaggtccaggcagaagggtcaggaaaggaatggggcaggcccaggcagaagggtcaggggtgggatggggacccaggcagagggttggggccaggatgaggaagcacaagcagwggggtcagggccaggatagggggccacaagaagctgtgggagccctaagtcggtacctgactcagcccaggaagtcagggaggacttcttggaggaggagctgtgtgagctgagctctgaaggaagagctgggtgggcatrtcgggaagcggacattagtggcagggaaatggcatgcgcagaggcctgaggtgagggtaaggggggatggaacattggargaacaggatgagagtcagcaggtgagagctcagtggagggtggggactaactggggccctgacctcagagtgtgtgcccctgcagagctgatgttcctggagaccagcgctctcacwggcgagaacgtggaggaggcgttcctcaagtgtgcccgcactatcctcaacaagattgactcaggtgaggccccraccggcccgagtgggagcgaagggcaggcccgggggtctccaggcaaccaatgctgacctctccccttccccacaggcgagctagacccggagaggatgggctctggcattcagtacggggatgcgtccctccgccagcttcggcagcctcggagtgcccaggccgtggcccctcagccgtgtggctgctgagctctgtggagccaggtgggacactgggggctttagggaggcagggcggcctcttgggcatgggggagatggtgtggagatagacactgaacatgtgatgacaagagaaacagagtgagagaaagatgcaaaaacacacaagctaaaggaggcatctggctgggcgcagtggctcacgcctgtaatcttagcactttgggagtccgaggcgggcggaggcagttcattgggtgggggtggggagacagacccacttccagacagtgacagctcagaaaggtcagggccaggcctggctcggtggcttatgcctgtaatccctgtactttggaaggccgaggcgggcggatgacctgaggtcaggagttcgagaccagcctggccaacatggtgaagccccctctctactaaacatacaaaaattagctgggcgtggtggcaggtgcctgtaatcccagctactcgggaagttgaggcaggagaatcacttgaacctgggaggtggaggttgcagtgagctgagatcacaccattgcactccagcctgggtgacaagagcaagactttgtctcaaaaaaaaaaaagaaagaaaggtcaggaccagatggggaggcactgggggagaggggtcagagccagcaggggagaggcccaggggggtcagggccagggtcrgggcacaggcagagggatcagggtgggatagggcaggcagaggcagaggggtcaggtgggatgaggggacacaggcagaggggttgcatttgatggggggtatacataaggtcaggagttctagaccagcctggccaacgtggtgaaacccctcctctactaaaaatacaaaaattagccaggcatggtggtacatgcctatagtcccagctacttgggagactgaggcaggagaatcacttgaacccaggaagctgagggtgcagtgagccaagattcagccactgcattccagcctgggcgacagagcaagactctgtctcaaaaaaaaaaaaaaaaaaaaaaaaaagagacatctgccaggccacagggaatccacctgcagccccaggccagcttcctgccctagaccttgaccctcccattcatagttctccagcgatttattgagcgcctgctgtgtgccaggccctgctcaaggcactggggatatggcagggagtacaacagactcccatcctcatggtgctgacattctctttgggggagacaggtgataaacaagagatgtaagtcgactgggcgcagtggctcacacctgtaatcccagcactttggcagggtgagatgggaagatcactttgagaccaggctgggcaacaaagcaaccttatctccacaaaaagttttttaaaattagcgaggcgtggtggtgtgcacctggagtcccagctacttgggaggctgaggtgggaggatggcttgagtccaggtgttcgaggctgcagtgagctgtgaccatgcgccactgcattccagcctgggtgacagagcgagactcttaaaaaaaaaaaaaaaaaaaaaagtaaagtatgtagtagtgagggaggtaagaactatggggaaaaataaaacaggcacagatgagtggatagggtggaggagtgtacttttttttttttctttgagatggggtattgctctgttacccaggatggagtgctgtggcgtgatctcggctcactgaaacctccgcctcctgggttcaagtgattctcctgcctcagcctcccgagtagctgagattacaggcgactaccaccatgcctggctaattttttttaatttttatagagacagggtttctttttttttttttttttttttttgagatggagtcttgctctgttgcccaggctagagtgcagtggcacgatcttggttcactgcaacttctgcctcctgagttcaagttgcctcagcctcctgagtagctggaactacaggcgcccgccaccacgcctggctaatttttatgtatttagtagagatggggttttaccatattggccaggctggtctcgatctcttgaccttgtgatctgcccgcctcggcctctcaaagtgccgggattacagtgtgagccaccgcacctggccgacacagggtttcatcatgttggccaggctggtatcaaactcctgacctcaagtgatccacccactcttggcctactaaaatgttgagattacaggcgtgagccactgcgcccggccaagaatgtacttttttttttttctgagatggagtttcactcttgttgcccaggctggagtgcaatggcgcgatctcagctcaccgcaacctctgcctcctaggttcaagcaattctcctgcctcagtctcctgagtagctgggattacaggcatgtgccaccacacccagctaattttgtatttttagtagagacggggtttctccgtgttggtcaggctggtctggaactcccgacctcaggtgatctgcccgcctcagcctcccaaagtgctgggattacaggcgggagccaccacgcccagcctttttttttttttttttttttgagacagagtctcactctgtcgccatgctagagtgcagtggcacgatctcggctcactgcaacctctgcctcctgggttcaagcaattctcctgcctcagtctcccgagtagctgggactataggtgcgtgccaccatgcccagctaatttttgtatttttagtagagacatttcaccatgttggccaggttggtctcgatctcttgacctcgtgatccgcccacctcagcctcccaaagtgctgggattacaggcgtcagccaccgcacctggccaagagtgtacatttaaacaagatgaggagggaagcctcgctgagaagatgacatttgagtgaaggaagggagatagggaggcctgtggggatctggggcaagagcactgctggagagcacagcaacgcttctagcgaggggtatgcctggtgtcggtgagggtgaccaaagcagccagtgtggtcatcatggaggacctgtgtgtgttttgtgggtacagcatgagatggggtcaggggttggaggaagcagatcagttagggcctgtgggccctggggaggsctctggcttataccctgtgtgggagccatgggaggcttctgaacagaggaaggacaggatcagattcaggggtgcagagagttcctctggctgcataaagggaaggggctgtgagggacagaggaggtcascaggacaccagagaggaagctgctgcaaagtccagggaagatggtggaggacaggacaagggggcgggaagaggagtggctgagaagggaatagggttcatgtcctccctagactctctgtcttccagtcttggcctctctcttttttttttttttggttcctgtctttttattttgagacagagtctcgctctgtcacccaggctggagtgcagtggcgcgatcttggcttactgcaagctccgcctcctgggttcatgccattctcctgcctcagcctcctgagtagctgggactacaggcacccgtcaccatgcccggctaattttttgtattttttttagtagagatggggtttcacggtgttagccaggatggtctcgatctcctgacctcgtgatcctcctgcctcggcctcccaaagtgctgggattacaggcatgagcctttcctttttttttttttttttttttaattttagagagaatctcactctgctcactctgtcacccaggctagagtgcagtggcgccatcttggctcactgcgacctccgcctcccgggttcaagtgagtctcctgcctcagcctcccaagtagctgggattacaggcatgtactgccacaaccagctaatttttgtattttttttttttttttggagatggagtctcgctttgttgcccaggctggagtgcagtggtgcagtctcggctcactgcaacctccgcctcctgggttcaggtgattcttctgcctcagcctcccgagtagctgggactacaggtgcgtgccaccacgtctggctaattttctgtatttttagtagagatggggtttcaccatgttagccaggatggtctcgatctcctgacctcgtgatccacctgcctcggcctcccaaagtgctgggatgacaggcgtgagacattgcgcccggccaatttttgtatttttaatacagacagggttttgccatgctcgtgaggctggtcttgaactcctgacttcaggtgattcacccgccttggcctcccaaagtgctgggattacaggcctgagccactgtgccctgccaatcctgtctccttttgatgcagccactgggtctttctaacacacatatctgctcctgtygctccctttttcaaaaccatccatgcatctcagggccccaggacacarmtgaactcctcagcctggtgtttgaccctctgcagggactggcccctgccagcccagccttaccggcctcagccacttgtcggtctccctacctctcaggccactccagccacactgaagttcttcccattcctctgggcccttgctcatgctgggcctctgcttggaacattcctaccctcttttccctggcaacctccttcctccaggcagcactacttgttcctccaggcttggtccaaacttttgtttttttttgagatagagtctctgtcactcaggctggagtgcagtggcgtgatttcggctcaccgcaacctccgcttccaggttcaagcaattctggtgccccagcctcctgagtagctgggactatgggcatgggccaccaacgcctggcaaagtttttatatttttagtagagacagggtttcaccacgttggccagctgctcacaaactcctggcctcaagtgatccacccacctcagcatccaaagtgctggaattataggcatgagccactgcacccggccccaaacttcttgacaggctttcaaaaccctgcaggatttggtcccatccctccttctctgggggatgtgtatgtcttgccagttctcccttctatacttcatgctaaatcccctcccagsccttggcagctccagggtgggacaggtggggaacaagtggttagaccttggatctacttggaaggcagagccaacgtgatttcctgatggaatggatgtgtaatctgaaagagagagaggaatcaaggatgatgtcttcagacagtgctctcttgtctttccaggactttgcacctgctgtgcctgagcctaagtttgctcatctgtaaaatgaggctaataatagcacctgcttctatagatgttgagaagaagaaatacattaattcacgaaagtgctcagaatggggcctgatggtcaagacttgatcgatgagggctgtttttaaagttttcttcttatccatctttgggctgagctcaaatgaatgggtgtgtcttcttcacctcagggcttagcagagactctgtcctagagagtttgccctcagtaggtgaaatgtaacaaggcaaggcaaggcyttttcacactttgctgactgcaatctacaggaggaaatatattttatgtgttaatcaaggactgactgtagcagatcccacccacatataaaactcaaacacacattttcctaccaccagtattctttcgtttcttggcactaaaatgaaagtcacataacatacatttacgtgacttttcaaagtgtacaattcagtggcattcagtacattcacagggttgtgcaatcaccacttctgtgttgttccagaatgttttctttttttttcttttcttttttttggagacagagtctcgctctgttacccaggctggagtgcagtggtgcgatcttggctcattgcaagctccacttccagggttcaagcaattctcctgcctcaacctctggagtagctggaattacaggcatgcaccaccacacccggctaattttcgtatttttagtggaaacggcatttgaccgtggccaggctggcttgaactcctgacctcaggtgatccacccgcctcggtctcccaaagtgctgggattacaggtgtgagccactgcgcccggcctcagaacgttttcattactctcagaggtgccatrcttatactgctttgtaccttatacctttgtacccatatttattaagcagtcactctccatttcccccaacccctagcaaccaccaatttgttttctgtctcttttggccaatatgatattcttttccttttccttttttttttgagaagggtctcactttgtcacccaggctggagtgcagtggcaccatctcagctcactgcagccttgacctcctgggctcaagtgtttctcccacctcagccccccaagtaactgggactactggtgtgcaccaccacgcccagctaatttttatatttgtattttttgaagagatggggtttcaccatgttgctcaggctggtctcgaactcctgagctcaagtgatccacccacctcagcctcccaaagtgctggaattacaggtgggagccaccatgcctggcctcttttccttttttcttttcttttcttttttgtttttttttttttttttttttttagatatggtctcactgtgttagcggggttggtcttaagctcctggccttgccgggcgcagtggctcacgcctgtaatcccaccactttgggaggctgaggcgggcagatcacgaggtcaggagttcgagaccagggtgaccaacatggtaaaaccccacctctactaaaaatacaaaagttagccaggcgtggtggtgtgctcctgtaatcccagctactcagggggctgaggcagaggaatagcttgatccctggaatcagaggttttagtgagccgagatcgcaccactgcactccagcctgggcgacagagctagactccgtctcacaaaaacaaaaacaaacaaaccaaaaaaaccaaamcaaaacaaaaaaactcctggcctcaagcaatcctccacctcagcctcccaaagtgctaagattacaggcatgagccaccgagcccagccaaccaatataatatatctttttaaattattattattattttttgagatggagtttcgcttatgttgcccaagctggagtgcaatggtgtggtctcggctcactgaaatctccgcctctcaagttcaagcgattctcttgcctcagcctccctagtagctgggattacaggcgcccgccaccacgcccagctaatttctttgtatttttagtagagacagggtttcaacatgttggccaggctggtctcaaactcctgacctcaggtgatccgtctgtcagcctcccaaagtgttgggattataggcatgagccactgcgcccggcctatttacaaaatttttttttttaaataatgttttaattttgtagagatggtgtctatgttgcccaggctggtcttgaactcctgggcccaagtgatcctctcttgcccttgcctcccaaagtgctaggattataggtgtgagccactgtgcctgcccaaccaatagaatattcttattatatatgatgcactctggtatttgccgttctgtgctattctgtttgaatttaaaaattggtcaagacccaccaaactgatttccccaccaaggcagtgacayacattagaatgacctggagaattttaaaagatactgatgcccaggcctcaccctagagattctgaagtggtttcaggactttttcttaattaaaagataaatagagatgaggtctcactatgttgcccaggctggtctcaaactcctggcctcaaacgatttctcccaccttggcctcccaaagtgctgggattaaagacgtgtgccaggctgggcatggtggctcacgcctgtgatcccagcactttggggggctgaggcaggcggatcacaaggtcaggagatgaagaccatcctggcttgatctgtagatcaagtgaaaccccgtctctactaaaaatacaaaaaaaaaaaaaaaaaaaaaattagccaggcgtggtggcaagtgcctgtagttccagctactcaggaggctgaggcaggagaatggcgtgaacgcaggaggcggagcttgcagtgagcctagatcgcgccactgcacttcagcccaggcaatagagcgaggctccatctccaaaaaaaaaaaaaaaaaaaaaagatgtgagccagccagttgcaggatttctggaagctcccaggtaatgctatatacaaccaaagtgagaaccactaacctaacgttgtctccccagcttggggaacagtgaaatgagacttagagccagggtgatccaggaacatagagggacacagaaagatacaaaggcaggttcattttatttatttatttatttatttatttatttatttatttaaattttttgagatggagtgtccctctgttgcccgggctggagtgcagtggtgtgatcttggctcactgcaacctccgcctcctgggttcaagtgattctcctgcctcagcctcccaagtagctgggactacaggcacctaccaccacgcctggctaatttttgtatttttagtagagacggggtttcaccattggccagggcggtctgaactcctgaccttgtgatctgcctgtctcggcctcccaaagtgctgggattacaggcgtgagccaccgtgcctggccgatttatttatttatttatttatttattttgagatggagtttcgctcttgttgcccaggttggagtgcaatagtgcaatgtcagctcaccgtaacttctgcctcctgggtttacaagattctcctgcctcagcctactgagtagctgggattacaggcatgtgccaccacacctggctaattttgtatttttagtggagatgaggtttctccatgttggtcaggctggtctggaactcccgacttcaggtgatctgcccgcctcggcctcccaaagtgctgggattacaggcatgagccaccgcgcccggcctatttatttttttgagacagtctcactctgttgcctaggctggagtgcagtggcacaatcttggctcactgcaatctccacctctcaggctcaagcgatgttcccacctcagccccccaggtagctgggactactggtgcatgccactacacctggctaatgtttgtatgtttttgtagagacggggtttcgtggtgttgcctaagctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaycgatgcagataggaggggaaggaaatacctggaaatgagatagagaccggctggacagaccccggggaccctgcaggtcaccacacccttctctttcagctcacctgttctccaggaccagccctrctggggcccaggcccaggctytgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataycccaagagctcccaaagcctgagaccagggtcatttgtccccaactccccatctggccctgctgttgctagtacctgttatttattacctggaggcctgtccagcacccaccctacccccataaagcattgtttacacctgtgtcttggcctccattattgtgagatggcagggagatggaagaggtccctgatggaagaatcatgtgtcatggtgtttgggggccttgtttctgttttttttttgttgttgttgagatggagtttccttcttgttgcccaggctggagtgcagtggcgtgatcttggctcaccacaacctccacctcccgggttcaagctattctcctgcctcagcctcccgagtagctgggattacaggcatgtgccaccacacttggctaattttgtatttttagtagagatggagtttctccatgttggtcaaggttggtctcgaactcccaacctcaggtgattcgcccgcgctggcctcccaaagtgctggaattacaggtgtgagccactgggcctggccttgggggccttgtttcctgattggacgtggtgtggggtataccaagcatgatgactcaggtgcctgttgcggagggagggaatttgttactgtgtggacagtttgtgacaatctgtgttctaagctcacgtgtgtaaacacgctgatgtccctgtgtttgtgacatgtgtacatgtttccagtacctgcatatgggatgatgtctataggatataatgtgtgctggttgtgtgtgatgctgacagccgtaactgctctgtggccttggtcattgtattggtgaggctggtattgtttgggacatcaaggccaggggatgggaatttggacctataggtgggcctccggtgtgtgcatgtctgatgcctgagagtcagaggcagtgactcactactgcgtgtgtgcctgtgcatgtgtaccccgaggtctgtgtgtgttttggtgtgaatttggctccttttaaacacccatgtgtggccaggcgtggtggctcatgcctgtaatcccagcacttcgggaggccaaggcagatggatcacttgagcccaggagttggagactatagcctgggcaacacagagagaccctatctacaaaaataaaaaacagaaaaagttagccaggtgtcgtggtacacacctgaagtcccagctattccggaggctgaggtgtgaggatcactttagttgggaggttgggcctgcagtgaactatgatcatgccacagcacttcagcctgggcaaaagggtaagaccccatctcaaaaacaaaactaaactagaaacacccttgtgtggccatgaaccctgtgtgtgccctgaggactgcgggcttttgtgcaatcctcacgcatgtgtggataccagtatgcatgcccttgtgctcacgcgaaccgccctacgccctcaggtggcctgcaggggactggtgcagccccgaggacactcccagttgctcgtcgccctcccatctccacgtcggccttcaccgacccggcgggagccttgagtcccagctctccagagcaatggtggagcgggcagggcattcaaaatgaccttatctccttagtctcctaaagtgttcccagctggccatgcaaatgtcttctctgtgtagcgttccgtggatttttttttgtttcattttttaattttgtgtaaagataaggtctcactccgttgcccagactttccctggttctttattctgattcccacaatcgtcccgagggggcaggccggagcgggtcttgaaaatacacatttgcacatcccttctagtccgcgttcccttttctcaagggcaacccgcacttttttgcctccgttataaaagatacttatgtaaattactgacgtgcgaatttacatacatttctcaactaactgcgtagccatttctccgtctctcacctccgttcctggacggcgagaaggaggaggagctgaccatgtaaatgaagtcacgcgcaccgcgctgccgaactcggtgccccgcgctgggcggggggcgggtaggcctgtccatgtaaatcacatcatttgcgtgccccgccccgccgacgccacttgattccaacatgcaagaaacgccccctcccagacccggcccctcacactgcgttccccctcccgcgcaaagggggcggggcggaggatgcaaatgaacctcgtgtaggccacggaccgctgtttcctttctccttggtaggggggttgtcccgaacttcctcgccccgctccgccccgccccgcgcggctcgggcctgcgcaggcgccgtcccctccgcggggcgcggtcacgtgcccaccgggcgaggcggggcggggcgtcgcgcgcggtgggggcggggtatggcgcgctgtgcggcgcagggcggctggcacaaacggcggcgccggggccggaggaaaaagctcggtgaggaggtcgcggggcgagaagggagcgggaggagactaagccggagccggggcgccggcgcgaaccgggcggggtgtgggggcgcgcgccggggcctgccggggcgaccccgggaagggggatgtgggtgcggcgcgggggaggggacgcgcgccggttacgttgggtgccggccgttgtgggggttggggtgggggcggggagcgcgcgccgggcggaggccgagtggagggggaggggagggggtccgagcggcccttaggccctgcccctgtcgcctactgcgctcagaaggggcctcagggcctgccccgggttgggggcgttggggtgccctggatgggggcacctttatctctcgtcctgtctccgggtgcgtgcaccctcctccgtcctttcctctgtcgccgcggaccctctccccgagggcccctcccgtcggtcagtctcgggacctcccttccgtctgggcgtgtgtccgcccccggccggcttcctcccgtcgggctcgggtcgaccccaccgtcccgctccgccccgggtcctccctcccagcttccctccggtctatttttctgtctctgggcccctcgttctctttgtttttggactccccagtttcctctgtcttttgacccccccgcccccaccctgactctccctggaacccccacgtttctcgttgtctttctggaacgccgaggcaggtccctcctattttccaaaccccctcctttcccactcctccacaccacccttttctactccagccctccttcttctgtctttggttaccgcgtcccacaacctgcaccacagtcctctgtcttagggtcatctacccagcccctggcctccagcctctccctatcactgcctcttatctgtcagcggactcccgcacctccagattctcagggtcctctccccgacttggcctcaggttttggggggcctctatagtcaagtctgtcctggtcgtcttccccactcctgcccataccatcccggctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggtaaggctaggtgggggcctctttggaggggctttgcagcaccctggtttgcagcattcagtgctctgagcacagtgggtttggagacaggcttctgggaggtcacagaaggtttaggcagttcagtggagtgggtatgcttacttgtggggacttgggggggtctttatcctccctacgggccttaatgtgtgcacctgataagctaggagtttgtcctggagccacagtggttcttttttttttttttttttttttcttttctttttttattgatcattcttgggtgtttctcgcagagggggatttggcagggtcacaggacaatagtggagggaaggtcagcagataaacaagtgaacagaggtctctggttttcctaggcagaggaccctgcggccttctgcgtgtttgtgtccctgggtacttgagattagggagtggtgatgactcttaacgagcatgctgccttcaagcatcgccacagtggttcttgactttgccaggaaccctcttaaactcatgagagctgctgacattcacagcgtggaccttggtggggttcatggcctcctggtgtcagtctgtggccccagaccaagcacggggatgtagataggcacacagttcacctggccgttctctgttgctgtctgtccctgtccacatccttccctgtgctcctgtcgtccatccctgtttgctggcccatgtttctagtccatccatcctgtctccaaggcaggagaagcagaagggggagggtggctgtgatgagtgagccctgggctgagggaaggaaaggggtgctgcccgctgggccgagtgcttggccctggactgcattgtgccctgggtccccactgtggcatctgcatcgaggacagtctcctgggggtggtactgggtggctgcctgttggcccaggtggagctcatccccatgtctcccacccttcactgtcccagtccctgccctccattccccctgtcctgtgtgtcacttcctccctacccatgtctgtctcttcctctgcctttatgtgtttgttcttagtccctttttctttttgctttagaacaatagttcttaatggtattttggagcctgggtctttttgagaatctgtcagaggccacagatcctctcttaagacaaatgctcatttgcttggagtttccgggcagttgtcaaggcctcatggcctccagctgcctgttcaggaacctggggtcaggagcccagcacaggacagtggtccatagggcctttccgggctgctgacaggatcattgtcttcatgggtggtgtgggggcctggccttgagtccaaggcttggtgtcctttggacaaggccctgtggggagtgcccactgctcaacacagtgatgcctggctggctgatggcacgggcagtgttgtgccctgcaggcgtgaggctgagctcctgatgtcctctgcctcctcctgcagatcccatcttgggttctgcttctgtgtggctttcctctcaggctggagctggct

SEQ ID NO: 17889 - DNA, 24446 bp, Homo sapiens
tgacctcaggtgatctgcccgcctcggcctcccaaagtgctgggattacaggcgtgagccaccacgcctggctgatctttctttctttcttttttttttttttttaatttttgagatggcatctcactctattgcacaggctggagtggagtgatctcatctcactgcaacctctgcctcccgagttcaagcgattcttgtgcctcagcctcctgagtagctgggattacaggcgtgcaccatcatgcccagctaatttttgtattttttggggagatggcatttcaccatgttggccaggctggtctcgaactgctgacctcagatgatccgcccgcctcagcctcccaaagtgctgggattacaggcgtgagccactgcccccagcccaacacagatcttttttccctcccagagctcacagtggggcatggtaattataaataacatttcaagtacaaattcagtaagtgccctgagggggaagtacagctaggtatgtccgtgtaacaggaattcctgatccactggggaaacctgaaggcttccgggaaaaagaggaattcatggaatgaataaaaactcttactccaggcaagaaaagggggcaggggaaagggagacccaggtagagggaacagcatgtgccataaccccggagtcagagggatgcctgggtcttaatctccacttgtcctacctcctaccccacagcctggagggacctccctcctacaagccaccgaccccaaaagcgaagctggaggcacaggagatggtgagcactttccctggagcccaagctatccccacctccacacccaccccagggctgggaggggcctggcagggagaagctggctgggtggtgggggcagttcctgacctccccgcccctctcccactacagccctcccagctcttcactctgggggcctcggagcacagcccactcaagaccccctactttgatgctggcgcctcatgcactgagcaggtaggagctcatgggaagacaaaggtgggttgggggtctgggttgaagggccaggggtcaggcctggcaaaagaggtcaaagactaaaggtcataactcaaggtcaagggtgtgtccccggttggtgcttaatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcgagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcatggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaacaaaaaaaaacagaatgaaagaaaattgattatctacatttgctggatactgtgcctgaagctgggacaagacaaatcaagtcactcccctcagtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtcctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccaggtcttgccttttctgtgggatgtgaaggggatggggtgagacatgaaggggaatgaggaaggagtctaagggcttgagagaatcagtgaactggggtcaagagagttaaagacaaaaacaaagggaccaaagatacaaaataagaattgagagagtaatgagcaaaaatgtatcaatcaaaaacaaaattttttttttttttgaggcggagtctcgctctgtcgcccaggctggagtgcagtggcatgatctcggctcactgcaagctccaccttctgagttaacgccattcctctgcctcagcctcccgagtagctgggactacaggcgcccaccaccacgcccggcttattttttgtatttttagtagagacggggtttcaccgcgttagccaagatggtctcgatctcctgacctcgtgatccacccgtctcggcctcccaaagtgctgggattacaggcgtgagccactgcgcccagccctaaaaacagaatgttgagtaatggaatggggaggggtccagggcatgctgtttaatgaacattcataattgcaacagcagtatgatgaatgggacaaagataaaaatagcaattggccagatgcagtggctcattcctgtaattccagcacttcgggaaactgaggcgggaagctcgactgagtccaggagttaagagaccagcctgggaaacacagtgagaccccgcctctacgaaagttagccgggcgtggtggcacgcacctgtagttcagctactctggaggctgaggtaggaggatcgattgaggccagaagttcaaggctgcagtaagctatgatggcgccactgcactccagcctgagtgacagagtccaaccttgtctttaaaaaaataaaaattaaaaaagcagtaacgaaagtataagaggctcaagtttaatgaataaacggcaagtaaaagtagactaaaggcaaaatcatgaataatgttgtaataggagcccaaggcatgacggataataaacctgaatgaatgggccagaggcagagtgatgaataatggaaaaatagggaccgggggcaagggaggtaacggacaggagttcatggatccaaaacatgatggctaattagagaagggccggaagaacgacgaaagtgagcaggcaggctggagctaaaagtagtctgggcaatgaagctcaaatgaatggggcagaggcatgatgggtaatgggagaggaatgaatgggccaaagatagaagccgcagtgacgcgaggaacaagaggcatgatgggtaacgaaaggggtgggtctaaggcaactgtttcgctaagaggtgatgagggcattgtgggtaacgaggagcagcgcagggttcgcagaacagattagaattctcccgaggcactctgggaagggccagcacttccggttttaggtcggctactccgaaccagaggtggggtgggggcccggctgccgcggtgcctggtgggacgcgaggcctgaccttgctgcctagccgcctctgccgcgcaacccacctttacctgtccttcgaccctggaacgttagccaatgagagtaccaagctgatacgccaccaaggtcgaccccgtacacgctggagccaatcaaaatgctgcaagggtcaaagccgaccaattatcacagcaacctcgccgcggggcggaatcaaaagagggcctcctccaggagagaggcggggcgatgcctcagcgggcgtggcaaaatgctcagcacagaccaatggcgggttagcaccggaacccgcggcgacgcgagccaataggcgcaggcgctgcgagccaatgggaagggtgggaggggcgccgtggctaccctgcgagtgagaaccaatacaaaaggacatttcagggaaagtgggcgggactttatgcacaagtccaatgggaagaccgagtcttgacgctggtgggcgggcctcagggcacactaaaccaatgggctaggtggggcggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaagggtgaggggcgaggggcccccgckgggctgcgatggcctggatctcgggggaagggggaggacactggggactctgggatttggcgcgcaccattggaattatttaacagcactaggaggtgatgttgggatcgaatggtggaacgttggacttggggcttagaatgatggaatcaaatgctggaaacgggatggaatgtcatagcagtagagaaaagcctttagggacctgaggagccccgggatcagccaagccagacttctcttgtgatcgggaaggcaactgaggcccaaggtcacggtgtcagcaaggtgtcagcaaggttccttgggtatgggacccaaagcctccggatcccagcctggagcaattagagtagtagtrgtggtggagatttatggagttctgttctggtgttcattatacgttaactcattagatccttgggacaattctgtgtggtgagggtcccatctttcagatgatgagtttgacctaaagttgctcagcttggtggcagtgagatttgagcaagcaaaggccctggccctgtctaactaggctgtactgcctctttacaggtggaatcctttgtgagatgttctgctgtgggtctctggagagagctgggggtggtagggaaggaagagatgagagttggtgtggggttggrgtggagtgtgacagcgtttctcttctccagagctgtttcccattcagatggagggtgtcaagctcacagtcaacaaagggttgagtaaccatttycaggtgagccttcctggtgtccttacccaccagagatcgtccccgccgtccccctccctgcatctgcacactcggcccaattactcctccctcaagagctgggctccctgatacttgaaaagactcggaratatagtgccagactgactactcagtttggggacctagaatccagaggtactgtctccccatagsagctaggctggagtgaaggaacaggtctgtgggcctaccggcagcacctcctttctctgagtctcttagtcaggccgtgcctcccagtcttcatcccctgcccagcccagagaccttgtccttgccctcttcagtgggcaagcctatctgtccagtatcgtcacagctctcgctttccttccaggtcaaccacacagtagccctcagcacaatcggggagtccaactaccacttyggggtcacatatgtggggacaaagcagctgagtcccacagaggtgagcttcctttttcatccattcattgtatcyttctaataacaaatttgtagccaaatgtcaagctaagacggcctcatcaggaaaaggtcacagctaccgagagcctggagatggggattgcatctctccgaggtgcactgggacacaaataattccttcatccagcaaacatccgccaaacccctgctctctgcctggccccatgctgagcagtgctggggatgtggccacagccaccctgtcaccagacagcgatgacccagggtggaaagggctggactgtagatcatgcagaactttgaatgccagactaggctttggactttctctagggggttgtggagagtcatggcatggtttggtcaagggaaagacgtggtccacaggttcccgctgtagaaatctctggggcatctctggggtggccatgtgggggctagttattaggaagggcaaaactggaggcccagacagggttggggggactgaatgaggtctctgcttctgtcatttcccttcagcaaatgtgtttattctgcaaaccttcattgcacaacacattctgtgcccagccctgtgctggcacacatgactgaaacagcatgggactcacccgtggggcaggggacagactgttcccagagagtaacaagccaggatgggcaaggctgacatgggggaacccaaaggtcggggagcctaactcagcytaggtggtcagagagcacttcgtggaggaggggacccccatccgaggctttctgaccctaggcttctcaccccggcccatctcacatacttgcacagtgcaccacctctgaccccttccgttctctctgcctcacaggcgttccctgtactggtgggtgacatggacaacagtggcagtctcaacgctcaggtcattcaccagctgggccccggtctcaggtccaagatggccatccaggtgagtggggcacggaggctgctgctcccctcggccaccgtgagcagggagccgccctcacaccccctcctctccacagacccagcagtcgaagtttgtgaactggcaggtggacggggagtatcggggctctgacttcacagcagccgtcaccctggggaacccagacgtcctcgtgggttcaggtaagaggcggagggcttggagggtggtcacaaaactgcagttctggctttgccagcaaatccaccccatttgtgaacctccttttctgccactggagaagtggctcagcaggagtgattttgaaacatcaggcaacatactacagtgggtgagacggtcacccactgaccatgagtgggtgagtcagmgcagtcttttttttttttttttttgagatggagtcttgctttatcacccaggttggagtgccgtggcacgatcttggctcactgcaacctccatctcctgggttcatgcaattctcctgcctcagcctcccgagtagctgggattacaggcatgcgctaccacgcctggctaatttttgtatttttagtagagacagggtttcaccacattggtcaggctggtcttgaactcctgacctcaagggatccacccacctcagcctcccaaagtgctgggattacaggtgtgagccaccacgcccagccagtcagcgcaattttaactgagattttcttttgtattaaaaaatgttttaagatggggtcttgctgtattggccaggctggtcttggaactcctggcttcaagcaatcctcccaccttgaccttccaaagtgctgggatgacaggcgtgagccacctcgcctggccagggaaacagcttttcagcctgcaagtagtgcagtcgggactcgtgaaaggaacttgagggaggatggtcccctggttgcataaggctttgcagagccttggccttcgctctgagtgagtctggggctttcggaaaccaaggcatagcttctcacaggaccctgcagctggcgtagagagcagactccaaagggggtaccactgggagggagtggacggggrgaggaggttggattctggatgttgtttgaaggcagagctgccaggatttgttgagacyggatggaggcgatgactctgtagtttttggctggaactggaaggatggagtttcrgattgccagctttgtgtctttgtgcagccatccactgtgtcgtggagagcaggctcttgagcgctgagtcctgagtgaatgactcgtgcaggcggggaggggagctagggttggccttggacccctgggagtgcctagggagagtcaccacttctcgctgcaggagcccagggagactcaaaagtgttgacttttgagctgccagaggaggagaaggggctaccccggctgggggacaggagcaagaagattccaggcagggagaagcaggaacaggggtgagggaagggaagggccatggcagaaaacccagsagacagggaagctggaggtgcagcaggtgcagagaggcctcctaggtgaggctgatctgtaggggccccatgaggaagaaacmtttcctgtccccaactcacctggtgacatcaccccatcttctcatacactacagttgaaccacatgagccttttttgttggtttgtttttgtttttgagayggagtcttgctctgttgcccaggctggagtgctgtggtgcaatctcggctcactgcaacctctgcctccctggttcaagcgattctcctgcctcaggctccctagtatccctagtagctgggactacaggcgcgcgccaccatgcctggctaatttttgtatttttagtagagacaggttttcgccatgtcggccaggctgatctcgaacttcttacctcaagtgatccacccgccccggcctcccaaagtgctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcgccctctgtcgtccaccattgtccccatcttgcaaggccaagaggaggttctccactaagggcacatggccagtgggactccagtgtccctgctcttcacggcgccagcaaccccgttccctgtgccgcctcgctcgcctggtcctttcgtgctccccagcactggcctcctggagcccagggccaccagtgacgctttggtctctagtcctttccagtgcctcttccttcccccagacaccagtgagaacagggcctgccgtgtgccggtcagggctgagctctcgagtctcttgccaccaacagctccgacttgacccagggtgtctctacctccaggcggctctgtgacctccggcaagtggttccagcccttctgggcttcagtctcctcatctgtcacttgggcacaatagaagcaactacctcccagtgaaggagtccatgagagggcccgacttctcggcctcagcactgggccacatgcacagtcaccacttgctccactctggcatctccatggggacaatgcccgcaggcacccccatttcacagataaggaaagcgaggcccaggggtgaaatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgccctcatgggggtcccaggtcaggcacagtggctcacacctgtaatcccagcactttgggaggctgaggtgggcggatcgcttgagatcgggagttcaagatcagcctgggcaacatagcaataccctgtctctacaaaaaaaattagaaattaggcatatggtggtacatgcctgtagtcccaactactggggacgctgagctggcagggcacatgcctatagtcccagctacttgggagcctgggaagggggagtggttctattctgaagctgaggccaagccatccaaggccttgcaggtgtgctgaggaacccatatcttctcagggcacgagggagccatggcaggttctgggcagggggtcaacagggtcaggtttgtgctttaacatgatccctctgtctgctgtctgtgaggtcacttgaagttggggcatgagactagagaggaggctgtgggtagagaaactgggggggtggcccaggagatgggaaggatggttagaaagatacttgagggtctcatggcctcagttccaacagtccctggaactcagaggccagagattctaagtcactcactctagatggctgcttttccctctgggcttcagtctcccccttgattgaatgaggggataacactgaccagagtggtaatggtagtgattttttttttcttttcttcccctgccccacctcacatacctctgccctgagacgcagtctctgttgcccaggccagagtgcagtggcacagkgtcagctcacctcaacctccaccttctgggttcaagtgattctcctgtctcagcctcccaagtagctgggattacaggcacgcactgccacacccggctaatttttgtatttttgcgtcgtggcacatgcgtgtaatcccaggtactcgggaggctgaggcaggagagtcgcttgaacccgggaggcagaggttgcagtgagccgagatgacgcctttgcactccagcctgggcaacaagagcaaaacgccccatctcaaaaaaaaaaaaaaaagagagagagagggagagatgggggtctcgccatgttgccccagctggtctcagactcctgggctcaaacaaccctcctgcctcagcctcccaaagtgccaggattacaggcgtgagctactgtgccccgcccgtgtgatggtgattcaacaaccagtggggggttcggggattcatttgcttcatctcctctgggaaggagagtcacacagtcgcttgcccgagcccatggggaccagctgcagcctacttctgatctcagcctccccagaagatgccaccagggcactggccatgaactcacggcctctctcacacccaccaggctcatcttgggggttgccgcctaacactcagcccctctgagagctccacccagccatgcctgcaggtatgaaaggcccctattcctgcagctccagagagctggctccaggctggctccatgctagcaggccagcctgctcccactgtggggcccctagtctgcccctctggtcatcttggtctgggaagcatcttcgcacctgctttgctctgtgctgtctcagcttctctgtgtgccctcagtctcgtggcccccaacctcccttcccttctccacgtgtcttcctctccrgggctgcaccctaggagattgctcgatcgtggtggatttctcaactgtgaatcttcagtccctcttcccccttcatttctgtctctgcagatgtgttgtttctttttttttttttcttttttttttttttttgtctttttgagatgaagtcttgcactgtctcccaggctggagtgcagtggcacaatcacaatctcagcttactgcaacttccgcctcccgggttcaagcgatyctcctgcctcagcctcctgagtagctgggactacaggtgtgcaccaccacactcagctaatgtttgtatttttagtagagacagggtttcaccatgttggccaggctggtctcgaacctccgacctcagacgatccacccacctcagcctcccaaagtgctggaattacaggtgtgagccaccgtgcccagcctctttttttctttaaaaattttttaggccgggcgcggtggctcatgcttgtaatcccagcactttgggaggccgaggcaggcggatcacgaggtcaggagatcgagaccacggtgaaaccccttctctactaaaaatacaaaaaattagccaggcatggtggcgggctcctgtagtcccagctactcggagaggctgaggcaggagaatggcgtgaacccgggaggtggagcttgcagtgagccgagatagtgccactgcactccagcctgggygacagagcgagactccatctcaaaaaaaaaaaaaaaaaattaaatttcttattttttgaaacaggatctctgttgcccacgttggagtgcagtggcgtgatyatagctyagtgtaaccttgaccttctgagctcaagtgatcctcctgcctcagcctcccaagtagctgggactataagcatgtgccatcatgcctggctacgtttttaaatttatttatttgttgtttgtttgcttattgggacagattctcactctgtcactcaggctggagtgcagtggcactatcatggctcactgcagcctccacctcctgggcttaagcaatcctcccacgtccacccccttastacctgggactacaggtgtgcaccacctcacccaactaatttttgtattcgctatgtttcccaagctggtttcgaattcctgggctcaaatgaacccactttggcctcccaaactgctgggattacaacaagcatgagccactgtgcctggccttgatttttttttttttttatgataatctgtagttagatgaagtttttaaattttttgtagagatggggtctcactatgtcacctaggcttgtctccaactgctgacctcaagctgtcctcttgccccagccctccaaagcattgggattactggcatgagccattgcatctggctttttttttttttttgagatggggtctcaccatgttgcccgggctggcttcgaatgcctaggctcaagcaatcctcccttctcagcctcccaaatagctgggattacaggcacgtgccaccacgccaggcttgttttctttccctgtccctccctctctatttcccactctcttcctccccaattcttctggccctataaaatcacatttgtggcctgtaccctgctaggctcgaaagacaccaaagtgaatccatctccatcctgaggcttgaaaaggcagcccaaaggtggcagttctcttgttcagcaagcactccctacggtggagggacacaggaacgcagacttggacctcagtgcagcaagtcccagccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtgggggtggataaatgctgaccacatgggcttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcytggaggtggagtctagcctggcactcagggtgggtggaaactgatcgtcattttgcccacaggaatcctcgtagcycactacctccagagcatcacgccttgcctggccctgggtggagagctggtctaccaccggcggcctggagaggagggcactgtcatgtctctagctgggaaatacacatgtgagcctggcrcctgggtccgagggtggaggggctgggcccctggactcctcctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccactygctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttrggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccrgaattgaggggcacgcaggattctgagcaccaggggcagaggcggccagacaacctcagggaggagtgtcctggcgtccccatcctccaaagggcctgggmccgccccgagggggcagcgagagsagcttccccatccccggtcagtccaccctgcccygtccactttcccatctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtggcctggggtcgctatcttcccatccggaacatctgccctgctgggggacactacgggccttcccttgcctgagggtagggtctcaaggtcacttgcccccagcttgacctggccggagtggctatagaggactttgtccctgcagactgcagcagcagagatgacactgtctctgagtgcagagatgggggcagggagctgggagagggttcaagctactggaacagcttcagaacaactagggtactaggaactgctgtgtcagggagaaggggctcaaggactcgcaggcctgggaggaggggcctaggccagccatgggagttgggtcacctgtgtctgaggacttggtgctgtctggattttgccaacctagggctggggtcagctgatgcccaccacgactcccgagcctccaggaactgaaaccctgtctgcccccagggtctggggaaggaggctgctgagtagaaccaaccccaggttaccaaccccacctcagccaccccttgccagccaaagcaaacaggcccggcccggcactgggggttccttctcgaaccaggagttcagcctcccctgacccgcagaatcttctgatcccacccgctccaggagccaggaatgagtcccagtctctcccagttctcactgtgtggttttgccattcgtcttgctgctgaaccacgggtttctcctctgaaacatctgggatttataacagggcttaggaaagtgacagcgtctgagcgttcactgtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgccctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctcccatcccacttctgtccagccgcctagccccactttcttttttttctttttttgagacagtctccctcttgctgaggctggagtgcagtggcgagatctcggctcactgtaacctccgcctcccgggttcaagcgattctcctgcctcagcctcccaagtagctaggattacaggcgcccgccaccacgcctggctaacttttgtatttttagtagagatggggtttcaccatgttggccaggctggtctcaaactcctgaccttaagtgattcgcccactgtggcctcccaaagtgctgggattacaggcgtgagctaccgcccccagcccctcccatcccacttctgtccagccccctagccctactttctttctgggatccaggagtccagatccccagccccctctccagattacattcatccaggcacaggaaaggacagggtcaggaaaggaggactctgggcggcagcctccacattccccttccacgcttggcccccagaatggaggagggtgtctgtattactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactcagccccagcggaggtgaaggacgtccttccccaggagccggtgagaagcgcagtcgggggcacggggatgagctcaggggcctctagaaagagctgggaccctgggaagccctggcctccaggtagtctcaggagagctactcggggtcgggcttggggagaggaggagcgggggtgaggcaagcagcaggggactggacctgggaagggctgggcagcagagacgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgttgttgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggagttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctatacctccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgcgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttag

SEQ ID NO: 17890 - DNA, 59247 bp, Homo sapiens
tcccacaccacagataactcctacacataatgtgtatcatgggaaaatacatgcagtaggaatttgctgtacaggaagcttaaaaaccagcaaaactaactgaggtttgttttggggagatatagatatacttattgcacaaatctttgaaggaatacaaaggaatacgtatcagaagactcaggatggagtctcctgccgagaccagctcggtcaggaagaccctaacccagtggtgctagaggacttaaagacacacacacagaaatatagaggtgtgaagtgggaaatcgggggtctcacagtcttcagagctgagagccccaaacagatatttacccacatatttattaacagcaaaccggtcattagtgttgtttctataggtattaaattaactaaaagtatcccttataggaagcaaagggatgggccgaattaaaggaataggttgggctagttaactgcagcaggaacacacccttaagacacagatcgctcatgctattgtttgtggcttaagaatgcctttaagcggttttccgccctgggcaggccaggtgttcctttccctcattcttgtaaacccgcaaccttccagcttggacattagggccattatgaacatgttacggtgctgcagagattttgtttatggccagtcttggggccagtttatggccagattttgggggacttgctcccaacggtctccttctagggggtgactgggtagcagcccagggtagctttacaggcttgtgttttacaccagtgctgggcaccctcgtagatacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagccatgtgacagagaggaccaggatgccatgaaaatggcattggctacaaataggtcatttgatccttggctccctggcatctctctagattttcaatgatacaatgttcaatctgctgtgcaagataatttcatcttccaaagatttgatgttacattttaccacacattaaactgaaataaacttttacagattggaaatgcacatcattgatcaaaataaatgaaacatgaaaagagtagggaggaatacccagtgatggaatagcaaatatgaatggaaaacagaataggactgctaaaaagaaaaaaaaattcagaagcatgtaatagcagcgctatttagaatcatagtggtgtccaaatcacttctatcacatctcattcaataccacaacaaaagatgttaagtttattatagaatgcccatcaaatagccagtttttgaaaaaaacttgtttctcaattagaactaaccatttcgggctacagcatcaagccaaaattattggcatcatgctaataatttttactaaagtaaaataaagttgactgaagtatgagattcacatttttgtaaatgaaaagcaatttgattaggcatttttttctgcacagcaaaagaaactatcatcaatcacagtgaacagacatcctacagaatgggagaaaaattttgcagtctatccatctgacaaaagtctagtattcagaatccacaaagaacttaagcaaatttacatgaaaaaaaaacttcattaaaaagtagacaaagaacttgaacagacacttctaaagaagacatacatgtggccaacaaaaatatgaaaaaaagctcaacatcgctgatcattagagaaatgcaaatcaaaaccacaaatgagataccacctcatgtcagtcagaatggcaattattaaaaagtcaagaaacaacagatgctggcgaggttgcagagaaataggaatgcttttacactgttggtggaaaagtaaatggttaatccattgtggaagacagtgacagtgtggtgattcctcagagatttagaatcagaaataccatttgatccagcaatcgcattacagggtatatacccaaaggaatacaaatcattctattataaagatatatgcatgtttacattcatggcagcactattcacaatagcaaacacatggaatcaacccaaatgcccatcaatgatgaactggataaagaaaatgtggtacatatacaccatggaatattatgcagccataaaaaggaatgagatcaagtcctttgcagggatatggatgaagctggaagccattatcctcagcaaactcacacaggaacggaaaaccaaacaccacatgttctcatttataattgggaactgagtaatgagaacacatggacacagggagaggaacaacacacactggggcctattggggcagggtggtggtgggaggatcattagcaaaaatagctaatgcatgccagggttaatacctaggtgatgagttgacaggtgcagcaaaccaacatggcacatgtttacctatgtaacaaacctgcacatcctgcacgtgtaccctggaacttaaaaaaaattaaattaaaagacaagcttaaagaaaaagacaagctgaaagagttaatgaaaaataattagataaaagaagtctttgattttcaaaaacctgaaacaatagttataattttgcttttaacatatattcaaaacatttgatactgttcccttccagaggtgcatcttaattccctctcctgagtgtggcttggacttaatgaggcacttctgatatggcctggttctgtgttcccacccaaatctcatcttgaattgttatgcgaattgtaatcgctacctattgggggagggaccacatgggaggtgattggataatgggggcggtgcccccatgctgttctcgtgatactgagggaattctcatgagatctgatggttttataaggggcttttccctgcttcattctgcacttctctctcctgtcatcatgtgaagaaggatgtgtttgcttccacttctgtcatgactgtaagtttcctggggcaggctcctcagccatgcagaactgtgagtcaattaaacctctttcctttataaattacccagtctcaggtatttcttcatagcagtgtgagaatggactaatataacttctaacttatagaataatgctgacataatggtttgtaactctgggtgtagaacctaaaactcactgcggcttccaccttctctctctctgtctctgggatcatgagctctgggggaagccagctgctgtgccacaagcagccctgcaggaaggtccatgtggctgagaactgaggccttccgggaccagacaacaaagaactaggccttttccaacagccatgtgactgatccatgtttcatgtgaatcctcagccccagtgaagccctcagatgatgcagcccttggctgacaattggactgcaaccttgtgagaggcccggagcaagaagcactcagggaaacctctcctggactcctgaccattggaaactgtggcagatgaggaatatttgttgttttaagctaagttttacataatttgttatgcaatagtaaataaataacacattttcacaagagaggatgtattattacacattaaattgcatttgctttaaatgtatcatcgtcatcattattatttttgagacatggtctcgctctgtcacccaggctggagtgcagtggcatgatcaccatgcactgcagtgtcgacctcctgggttcaagggacccactgatctcagcctcctgagtagctgggactaccatcatgaactactatgcctggctaattttctaattttttgtatagatgggggttttgcccaggctgatcttgaacttctggagtcaacaaatctgccttcctctgccttccacagtgctaggatggcaggcgtgagccaccatacctggcgtaaattaattataagatattaaacatgtaacttagttttaaaaggtaaggagaatttccatggctgaagaggatgtattttatgaccattcacaatgatcactttacttgaacttcaatttccaactgtgtccgaagtaaacacaaaaggaagatccaacccttgctaggctgattctattatgccctcaacaaccagctcctggtcattcaccatcctccagttattcaatcaactctaatgtaggtgctgctgtgaagggagttagtggatataattaagggtctcaattagttgactttaggctgggtttatcctgcttggactgtcctaatcaggtgagaccttgaaaggactgggttcttcctgagcatagagactcacagtgtgagagggactcagcatgaggggtttcctccagcatgggctttgaaaatgaaagggctgtgggccgggtgcggtgcctcacgcctgtaatcccagcactttgggaggctgaggcgggcggatcatgaggtcaggagatcgagaccatcctggctaacatggtgaaaccctgtctctactaagaatacaaaaaaaaaaaaaaaaattagccaagcgtagtggcgggtgcctgtagtcccagctgcttgggaggctgagacaggagaatggcgtgaacctgggagccatagctggcagtgagccgagatccggccactgcacccaagcctgggctacagagcaagactccatctccaaaaaataaataaataaaataaaaaatgaaggggctgtgtaggaaagaatgctggtgaggaccaggaatcgagcacagccctccctgttctctacattgacagccagcaaggaacagggacctcagtcttacaactgccagaaactgcattctgccacctctgtataagcctgaaggaggattcaaaatgaaaacacagcttttggaagcccagaagagagattccatccacaattttgcccagatttctgatcaaggaactataagcagataaatgggtgttgtttcgccaggcatggtagtgcacgaatgaattgatgaattgatatgcacactagttacataaaataaaaattttctgaactttttccgtgttttgcactttataattatctgtaatgcaatttaatacactcatatttcattcattcagtcgacaaaaattaatttagtccctacgataaaccagatatcccctcatatgctcacgtgcctgacactccagaagtttctcaagaccgaggtggagacactggagtgttttaagtggagagatgacacactccgactcccaggagcaggaccactgtgaaaagaacagtcacgtaacaggtcatgggacagtgctagtgtcacaactcacaagtgacagtgtggtggggactaaggggacaggagggcctgaaggatgaaaaggacggagagaagggctggagaagcaggaggtgaagaaaaggagcagaggaaagaattcgaaagcagcagaattcttaggtttaaatacattgttttatggattttaatacatccatctacagagcctagcagggtgtccttggcagttggcctttaatacctcatgtgggtctgcctaaaaactaattttttaatgttaatcaggtttaaaaattactaagtgttcctataaaatatacacaacacttagcagtggatacttcctaaaaacaggcagtgcatgagcactagtgaggggcattgtgactacattgaacagttgcaactttgaggtgaataaagcctgtactgactcctggttgcaacgtacctggttgcaaagtacacagtgtgctactttgtattgaggagatatcctggactcacacagaaactcagagctatggaatgatggcaaatttaaaatatgacaagcgggagtcacaggtacactgcaaaagtgaaacttagaagctttgtgagtcctgttgtaacgcttttgggcacatttatacatcatggggccaaagtcacattttttaccgattagattcctgatcattcaggggttaccaaggttctgctatccaatgtatttaataaacaaataaataaataaactggtctctattctgtctcatgcactcagdcacaacttttcccaataaaaaaaaaaaaaaaaaggaaaacaaaaaacagtttctacacctccattcccadagcaagctcactctctgtcaccaaactccgtgggtgdsttttcttctagaagagtccaggtggacagggagtccagttcagggacggagattcckggatgaaaagtgaagggagagggacagggcccatgccgagggtttcttcctggtttctcagacagctcctgggccaagactcagggaaacactgagacagagcgcttggcacaggaggagcggggtcagggcgaagtcccagggccccaggcgtggctctcagggtctcaggccccgaaggcggtgtatggattggggakgccccgccttggggattcgccacctccgcagtttctcttcttctcacaacctgcgacgggtccttyttcctkgatactcasgaagcgggcacagttctcattcccactaggtgtcgggtttctagagaagccaatcggtgccgccgcggtcccggttctaaagtccccacgcacccaccgggactcagattctccccagacgccgaggatggtgctcatggcgccccgaaccctcctcctgctgctctcaggggccctggccctgrcccwgacctgggcgcgtgagtgcagggtctgcagggaaatggtcgggaggagcgaggggcccgcccggcgggggcgcaggacccrgggagccgcgcagggaggagggtcgggcgggtctcagctcctcctcgctcccaggctcccactccatgaggtatttctacaccaccatgtcccggcccggccgcggggagccccgcttcatctccgtcggctacgtggackatacgcagttcgtgcggttcgacagcgacgmcgcgagycagaggatggagccgcgggcgccgtggatggagcgggaggggccrgagtattgggaccggrasacacagatctgcaaggcccargcacrgactgaacgagagaacctgcggatcgcgctccgctactacaaccagagcgagggcggtgagtgaccccggcccgggrcgcaggtcacgacccctccccatcccccacggagggccgggtcgcctcgagtctctgggtccgagatcctccccgaaaccgcgggaccccgagacccttgacctgggagaggcccaggcgcctttacccggtttcattttcagtttaggccaaaatccccgcgggttggtcsgggcagggcggggctcgggggaccgggctgaccgcgggggcggggccaggttcycacaccatgcaggtgatgtatggctgcgacgtggggcccgacgggcgcttcctcygcgggtatgaacagcacgcctacgacrgcaaggattacatcgctctgaacgaggacctgcgctcctggaccgcggcggacatggcagctcagatcaccaagcgcaagtgggaggcggcccgtsdggcggagcagckgagagyctacctggagggcgagttcgtggagtggctccgcagatacctggagaacgggaaggagacgctgcagcgcgcgggtaccaggggccacagggcgcctcccggatsgcctgtagatctccggggctggcctcccacaagaaagggagacaaatgggaccaacactataatatcgccctccctctggtcctgagggagaagaatcctcctgggtttccagagagtgactctgagggtccgccgtgctctytgacacaattaagggatgaaatctctgaggaaatgaagggaagacaatccctggaatactgatgagtggttcyctttgacrctggcagcagccttgggccccgtgacttttcctctcaggccttgttctctgcttcacactcaatgtgystgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaagatggccacatgcgtgctggtggagtgtcccatgacagatgcaaaatgcctgaattttctgactcttccygtcagacccccccaagacacatatgacccacyaccccatctctgaccatgaggccaccctgaggtgctgggccctgggyttctaccctgcggagatcacactgacctggcagcgggatggggaggaccagacccacacacggagctcrtggagaccaggcctgcaggggatggaaccttccagaagtgggyggctgtggtggtgccttctggagaggagcagagatacacctgccatgtgcagcatgagggtctgccmgagcccctcaccctgagatggggtaaggagggagatgggggtgtcatgtcycttaggraaagccrgagcctctctggagagctttagcagggtcagggtccctcaccttccccccttttcccagagccatcttcccagcccamcrtccccatcgtgggcatcrttgctggcctggttctacttgtagctgtggtcactggagctgtggtcrctgctgtaatgtggaggaagaagagctcaggtaaggaaggggtgaggagtgtggtctgagatttcttgtctcactgagagttccaagccccaggtagaagkgccctgcctggttactgggaagcaccatccacactcatgggcctacccagcctgggccstgtgtgccagcacttactcttttgtaaagcacctgttacaaygagggacagatttatcaccttgatgactgtggtgatgggacctgatcccagcagtcacaagtcacaggggaaggtccccgaggacagacctcagaagggcggttggtccaggacccacatctgctttcctcatgtttcctgatcccgccctgggtctgcagttgcacatttctggaaacttctctggggtccaagacttggaggttcctctaggaccttatggccctggcttctttctggcatctcacaggacattttcttcccacagatagaaaaggagggagctactctcaggctgcaagtaagtatgaaggaggctgatccctgaaatcctttggatattgtgtttgggagcccatgggggagctcacccaccccacaattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagakttgttcacaccttccctttgtgacttgaagaaccctgactttctgcaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggmggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatggactttatgtggtcactgctcagctgggtcatctttgctccttcattctccttggcccttcagtagaaccttgtcccaccaccacctgtgatcacagggacttggatgtcacctacggtggtccctgcatacaaatctcattgtggtatcaagagactaattttcagacctgtccagctcttgccctcctcccagggctctttcctggattgtagttttcatcttgtctccaatctttttaaaggaagcagattctgaaatttgcagagaggaggggtcccatagtttctcatcatagtgaactttctgttggagctcctcttctgctctcctactcttcttcctgccctgagttgtagtaatcctagtgctggctccaatccaaactcatggatttacaaagcagagtctaatttagattcatacgtggttggaaaattgtacccataagcctagggttatctttcctgaagagaaaaatatggttgtgtgctgcagtgtgcaggagggttggtgtgggaggaggtagggagggagggaggacacacaagcactcctggtgagaaaagcactggcggcatcgatgtccacatgagatgatgttgttctttagctgccacaaaacagcatttgccctgaggctaccttaacaaagatattggctttagaatagagaagtgctctacagtgatcattcattcaactgacatttgttgtctgctagggatatgactgcttttgcgtttagaaagcatcattaaggtgaaaacagaaaaatttctggtgttgtggtacatatgttctagatgctagcttgtctaacccgtagctcgcaggctgaatgtggcccaggacagttttgaatgtgaggagtttttgcttttctgtggcggacctgagacctggagtgagtgcacccacctccctcaggatcaggagtgaatgctttaggaaccctcctttgcagtgacctgcaaaagatagagggcacggttactgtgagaacccagagtagcagccaaaggggctcaaccttcatggagttttgggaaaggttagtaaaaggtggtgtcccagcgtcagaacagatgggcagccagcgagggcactgcttcatatctatgatgggaatgcaagaattgaggagcaggagactgagggtgtttgatcaaatacaaagtcatgatcccagtctcaattcctagacttcagccaagcttcagattcagaatctacagtggggcttaaggaggccaggaaataaacctggacacattatggcccactgtgggaccactgggttcataaacccagtcctggttatctccccattctccacatgcataattggccttgatgcactggcaaagggagtcacccccacactacatccctagtctggagagtaagggctatcattgtgctgaagcccaaagggaatcatctaaaacttccctcatcccagccaagccagaagcaatattgcgccccaggtgggacttcaggagggtactgcaggtattgtaggggtggcactgccattagagagctgaaggatggggggtggtgttgggattgcctattatctccatataattcagcagtctgtccctgaagaagcctgataaagaatgaatggaattactccagacttgaccaagtaggagtcctgattgcagctgccatgctggctggatatcactgcttggggagattaataaggcctcaggcacatggcaaacagccatgcatttggtgagtgcattctttcccattccatttagaaaatggatatggaatgattcacattcacatgggatttataatacatttattgatagcttgcctcagggctactttaactcctcaaccttctataaatatcaccttaagagatctggacaaatcagacatctcacagaatactaaatctcttcatttcattggcaatatcacatagattgggatggatgagtaagaggaggaaagtacgctgaattctttggcaaaacgtgtgcactacagaaggtgaagattaaccttacagagcttcaagagtggccactgcagtgaagtgttatgggtccagtggttaggggcatgcagggctgtcccctccaaagtaaaagacaaacttgcatcttgcatcctcaacagaaggaaggaagcacactatttggtgagcttctctgggtcctggcaacaccacattccacatctaagtatattgtttggcccactgtctgggtataatataggaagaggtcagctttgagtgcggactagacaggaaaggacactgcagcagatccaggcggtggtgtaccaggtcatcaactctcagtcccctggtgctgggggtgacagcgtggggaaagatgctagatggagctgaaccaagcagctgagatcaagtgagctgagatcccgcccctacactccagcctgagcaacaagagtgaaactccatctcaaaaagaaaaaaaaattaaaaggataagcaccctcccacatcagagataactccccaacacataatatacatgcggtgtgagttctctgtatggggaagttaaaaaaatacaggtcaaactgtgatttgggtattattgtaaaaatcttcagtgacaatgccaaggaatagcaaatacaagactcaagacataggttccttttaggggataggattggacaacagcctagggtggcttcataggttctgtttcttatgccaggaggggatatccaggtagttagttacttgatcataaaactttatttatttatttatttatatattttgagtctcgctcttgttgcccaggctggagtacagtggcatgatctcagttcactgcaacctccgcctcccaggttcaagggattctcctgcctcagcctcctgagcagctgggattgcaggcaaatgccaccactcccagctaatttttgtatttttagtagagacgggcttcaccatgttgaccaggttggtctggaactcctgacctcaggtgatccacccacttcagcctaccaaattgctgagattacaggcatgagccaccactcctggcccacaaatctttaaagtggtatttttcaaaatgcaccttgtgtgccattcctgattgattatttggaaatgaaagagaaaagaaaatgccaaagttcatcacaagcatcctttgcgataactactcgtagtaaaacaaagccgcagctggccgggcacggtggctcacttctgtgatcctagcactttgggaagtcgaggcctgtggatcacgagatcaggagttcgagaccagcctgaccaacatggtgaaacctcgtctttactaaaaatacaaaaattagctgggcgtgttggtgcgtgtctgtaatccaagctactcagaaggctgatgcaggagaatcgcttgaacctggaaggcagaagttgcagtgagctgagatcctgccatcgcactccagcctgggtgacagagccatactccatctcaaaacaaacaaacaaacaaccacaaaaaacaagccacagccaattttaaggagccatgtgagaggaccaggatgccatgaaaaacagccttggctacaaataggtcatttgatccttggctagttggcaactctctacattttctgatacacagtgttcaatctgataggtaaggcaatagtatcttgcaaagaatttgagaatttgatatgttgctcacattttaccacacatacaagtgaattaaacttttacagaatagaaaaaaagcattgttgagcaaaataaattaaatgaaaagacataaatgaataactagtgatgaaatagcaataagaatggaaaacacgaaagagctgcttttaaagcaacattagaagcacaaaataacagtgtttttcagaatcatactggagtccaaatcacttctaccacatctaattaaaaaccacagtgaaagatgttaaactgatcacaggatgcccactgaatagccagttactgaaaaatcttgttcctagattgaatttaaccatttccacctaccacatcaaaccaaatcattgtcatgatgctaagccagttgtacagacaaagatgtgagactcacatttttctaattgcaaagcaccctgattaggcaaatatttttgtagatgcttgagtcagaaaattgtcattttgggcattctttttttttttttttttttttttgccttcaagcatctgtttaacaaagcacatcttgcaccgcccttaatccatttaaccctgagtggacacagcacatgtttcagagagcacggggttgcgggtaaggttatagattaacagcatcccaaggcagaagaatttttcttagtacagaacaaaatggagtctcctatgtctgcttctttctacacagacacagcaacaatctgatttctctgtcttttccccacatttcccccctttctattcgacaaaaccgccatcgtcatcatggccccttctcaatgagctgttgggtacacctcccagacggggtggcggccgggcagaggggctcctcacttcccagacggggtggccgggcagaggcgccccccacctcctggacgaggtggctggccgggcgggggctgccccccacctccctcctggacggggcggctgccgggcagagacactcctcacttcccagacggggtggctgctgggcggaggggctcctcacctctcagacggggcggccggggagagacgctccttacctcccagacggggtggctgctgggcggaggggctcctcacatcccagacagggcggcggggcagaggcgctccccacatctcagatgatgggcggccgggcagagacgctcctcacttcctagaccggatggcggccgggcagaggctgcgatcttggcactttgggaggccaaggcaggcagctgggaggcagaggttgtagcgagccgagatcacgccactgcactccagcctgggcaacattgagcactgagtgagagagactccgtctgcaatcccggcacctcaggaggccaaggctggcagatcactcccagttaggagctggagaccagcctggccaacacagtgaaaccccgtctccaccaaaaaaatacgaaaaccagtcaggcatggtggtgcgcgcctgcaatcccaggcactctgcagactctaaattattcaacgcctcagacactaactttccaaggaataggagattatcccaggtgcctgtggccaggaggtgtctgggttctgtgctcccttccccaccccagatgtcctatccattctcaggatggtcacatgggtgctgctggagtgtcccatgaggaatgcaaagtgcctcaattttcttactcttcccttcagaatcccagaatacatgtgtgatccactaccccatctcggaccatgaggccgccctgaggtgctgggtcccgggcttctaccatgtggaaatcacagtgacccaactgtgggatggggaggaccaaatttaggacgcagagcttgtggggaccagacctgcagggtatagaaccttccagaagtgggcagctgtgatgctgtcttctagagacaagtagagatacacatgccatgtgcagcaggaggcactgccagagcccctcacactgagatgggctaaggagatgaatgaggggccatgtctcttctcagggaaagcaggagcccttctggaggccttcagcagggtcagggctgaggcctgggggtcaggacccctcacgttcccctcctttcttagggccatcttcccagcccacattcctcatcatgggcatcgttaccgtcctggttgttctaggtgctgtggtcactgctgtgatgtggaagaataagaccccaggtaggaaaggggtgagttccaagatttcttcttccattcgtggatttcaagctccagatggaagttggctcatttcctgcctagttgtgagacaccatctccacacacatttaccctgttcagatgccctgtcaactctcactcttttgtaaagcacctgtgaaattgaaggacaaatttatcaccttgattgtgatcatgggaacctgactcccagcagtcacaagtcaggagaatgttcctgctgaggacagatgtcaaaaggacatttggttcagcttcaacacatcctcttccctcgggttttctgatcctgacctgggtctgcagtcacagttctggaaactcctctaggatctcatggccctgcctcttccctggcctctcacagtttgttttctttcctcatatggaaaaggagtcagctatgctcaggcttcaagtaagtgtggtaggggtgggagagtgattcctgagatccttggaatagtgtagacaggagcccatgggggaggtcaccaccccacaattcctcctttagtcacatcacctgtgggctctgaccagactttgtttttgttccaccccaaacaggaacagtacccagggctctgatgtgtctctcaagtcttgtaaaagtgacaccttagagggcctgaagtgaaggaggagttggggcagatgggacacaactaggctctagagagtctttgatttggaatttttcaatgtgtggtgggctgttcagtgtcaccacttaccatgactgacttgaatttgttcacgactattttctttccaagactgccttgtgagggactgagatgcaagatttgttcatggctccactttgagacttcaagggcctctgttttctctttctgccaaggcatctgaatgtgtctatgtccctggtaacatgtgagaagtggagagaccagcccaccctcatgtccaccatgacccctgatattgtttggatctgtgtccccacccaaatctcatgctcacttgtaatccctaatgttggaggtggtgcttggtgggacgtgattggctcatgaggatggatgattcatgaatggtttagaatcatctctttcatgctgttcttgtgatagttcttggaggcattgtgccacctccctagggatctgtggaactttaaacttgagagtgatgattaagggtatctgatggaagaaatttctcagtagcatagaattcaggatttggtctggctgcctgtaatagcctatgtgcatatgtgtgagcaaagaaatgacccgaaactggaactgatatttaaatggggaaatttaatacccaggaaaattcttagcggagctgcagcaacaggacccctgccaggactactaaatggtagagccactggctatgtgcaacctcagcctggaaaagccataggcattcaattttctcccatgacagcagctatatgggttatgttcagcaaagccataaatgtggagctgcaaatggcattaggagcccagcagttgcaccagccactgtgctctggattcaaaatatagagtcaaaggagattcttttagacctttaagttttaatgtctgccatgatgagtttcaatcttatgaggaaactgcattcatttcttttggcccatttatataccttttggaatggaaatgtacaagaaatgtctcttccactgttttattaatattttagatgcaaataacattttttaaaaaaattttacaggctcaaagctataagaatttaccttgcgtctcagatgagactctagaattttgagttgatgctggaacaacctaacacatttgggacaattgggagtagattattatattttgcaatgtgagaagaacatgacctttggctggctagggaggggatgcaatgatataaacatttatcccctgatacctcatgttaaaatctaacgcccactgtgggacttggggcctaatggccaccatttgggtcatggtgaccaatcttttatgaatcgagagatactgccctctctcgggaatgaatgaattgttgctctattattttccaagagagctagttgttaaaaagaccctggcaacttcctactctctgtgttcctctgttaccatgtgatctctgcatataccagctcccctttgtcttctgccatgagtggaagcagcctgaggccctcactaaatgcgcaaacatttccagacatcagaatcttgagccacatgaacctcgtttatataaattagtcagtctcagacatttctttatagcaacacaaaatggaaaaagataaccctcgcatcacaggtatgtgtctctggcagctagccaccgttcttaagatatccaggatccactcagccaagagtcttctcatcagtactctaaagacactcttatcactcaagagagtctaaggtttttaggagaaaccagggacaaagactaaatgtttttgtgataactcagattgcccacttttctttgaccacatatcttttacaggaaaaaggattgtaacagtaaagaggtattggcatattatcagagtctcatccattcattcaaaattaggccagtttatcatcctcttgtatgaatatgtctcccagaatgaaatcactcagctttgctgacaacactcaatcttaccaggttccaaaaacaaggatggtctcagggacatacagcttcactcttttaggcatcccgtataattgacctaagtgacaatatcttctcttgctcacaccacctttgaggagttaagctaatattgaatttttctcattatataaccctttgatttattcacttaccctcagccactattcctccctctgtccctttatatcagttgtttccaggtttgggagtgacattaggtttgtctgctgggctggcctagactgcaggcagcaatagtattctagcatgtcttccctcagtctagtcttgatcatagagggtaggttatataggtaaggaactagtgggggctatcagaccaccaggctatataactctacttactgttaatcctaacttttcagatgaaatgaatacttgagaattcttacataaaggtgtaaaaatatagttatggtttttcgcttagggataattcctgtttctggcacttttatttacatccctattcctggtactatggcataacatatgaaaaaataaatttgaggtgaagtgtagtctttattccagcatcctctccccttcagaagaattgtatgtatcgtcgtaacagcatcgtcctgatccatcaggtaaaagagaggatgctacctagtggagttattcttgcagccccactcatgttgacagcgagcacattcatgaagatataaaagccagtccttcatgtttatattgcccaacaattagattggcagtttttagacaaacaatgtttcaattgaccatttcaattttctatcaaattttcccctgaggaggacatgtccctctgcattgttggccgtttgaggctgtaaagtgtgttttcttgtgtaaagaagtgtgactcggcagtccaaattggtgcaacctcttcttttctggtccttgtatagcccttgaagcattgacatctacccctggttgagcatagcccaatccagagtcagtgattttcctgtcaagatccattggcagctcctttggggttgctggcatcattctggcttgccaggtattatgatcaaagccttcccactagagaatctgtcacatctccatctgctgcctctgtctgttttcttgaccaacagtgaaaaaagagattatgagaaataagataaattaccaaaattgtgaacaaaagagattatcactaatgacccttaggaagttaaaaaacattataagtgaatactctgaaaaacctgaagccaataagttagaccacttagataaaaaggaccaattcgtgcagagatagaaattgccaaaactgacccaaattaactggaaaacctgaagagaactgtgaactaagtcagaaattgaaaaaccttctcaaaaagaaatgccaaagcccagatatcttcactggtgaattctatcaaatattttgaaagctctttcagacaagaagagaggagggaagactttccagcccatttacagaactggcattaccctcatatcaaagtcacagcaagactcacaggaaaagagtgccatacaccagtgtcaccaataaacataaatgaaaacatccttaacaaacattggcagataatacaaagccacataaaaaaggattacactccatgaccaatgggattcatcccaggaacatatggttggattaacatttgaaaatcaattcatggaatgcactgtattaatggaaaaaaagacataattatctcaaaagatgcagaagaaacagttgacaaaaatgttaacatcactcatgttcataagtttcaacaaaataggaatggaggagaccttcttcactctgataaagggcatctataaaaaacccacagctaaaatcaaacttaatgaagaaagactgaagactgaatgcttttctcctaagatggggatcaatgcaaggatgtccaatcccaccacttttatttaatattatactggagattgtagccagtgcaataaggcagaaaattaaaaattaaaggcatccagataaaaaggaaaacatacaattctattcacagataacatgaccctgtctgtagaattcacaagcagataaaaactggctagcactaataaatgaatccagaagggcccataggatatcaaatcaatataaaaattaattattaacatatttctctatagaagcaatgaaaatctcaactttcctatcacagtagttaccagaagagcgaaataggaataaatttaggaagacagcagtgtttgttcactgaaaataaaaaaacattcctcagagaaattaaaggtctaaataaatggagagatgcgagttggaaagctcgataatactgttaagatggcaattctcccccagtagatctataggttcaacacaatccctatcaaaatcccagcagggattttatagaaaattgacaaaataggccgggcgcggtggctcatgccggtaatcccagcactttgggaggctgaggcaggcggatcatgaggtcaggagatccagaccatcctggctaacacggtgaaaccccatctctactaaaaatacaaaaaactagccgggcgtggtggcgggctcctcgggaggctgaggcagaaaaatggcatgaacccggtaggcggaggttgcagtgagcggagatcatgccactgcactccagcctgggtgacagagcgagactccgtctcaaaaaaaaaaaaaaaaagaaaaaaagaaaagaaaattgacaaaataatcctaaaaatgtatattaaaatgcagaggatgcagaagggccaacacaaatttgaaaaaaaaaatggaatgtcatatgaaactacaataatccagacagtgtgaaactgagagacatagagatcaatgaacagaagtgagaatctagaaagatattcttactttctttgtcaattgattttcaatgaagttgcataggtaacacaatgttacatttaacaccatataaaatatcagctcaaacaaattagagacctaaacagctaaaatttatgagttaaaactataaaatttctaaaagaaaacacaggagaaaatttttattactttgggtagttaggcaaaagattcttagataaaataccaaaagcatgatctacaaataaaaaaaaaagagagagagaaattgggcttagttaaaatttaaaacttgagtgctccaaaagacattgagagaatgagaagacaagccatagacagggagaaaatatttcacaatttatcacaaattacatttgtgttgaagaacatgtttccagaataatgtggcaagttcttaaactcaatgtgtaagaagatgagcaactcaactgaaaatgagcaaaacacacaaatatgctcaactgacatttacaaaagcacaaacacaattcaatgaaggaaggagagctttcccaacaaatggtgctggagcaactggacaaccacagtggaaaaaaaataggctgagcccaaacctcacgctttatacaaaaaaaaaaaaactcaaaatgaatcacaggctttaatgtaaaacacacagttaaaattacaaacattgagccaggtgtggtgtcacaggcctgtactctcacctactcaggagactgaggtgggaggatcccttgagcccaggagttcaaggccagcctaggcaagatttttttttaaataaataacaaatacattaaaaaattaaaattacaaatcttttaacaaaaagccatcagaactaagactagacaaagagttcttacacataacaccaaaagtatgatctgtaaaagaaaaagttactaaactggatcttatcaaaattaaaactgttgctctgtgagagacctatgaagagcataaaaagacaagctacagaatgagagaagatatttgcaaaccacatattcaataaagacttgcattcacaatatatgaagaaatgtaaaaactcaacagtaaaaatgaaatccaaataaacaataggcaatgagcaagacatgaacagacgtttcactgaagaggataaacaccaggctaacaagcagatgaaaagacactcaacatcactatccagtaggaaaatacaaattaaaactgcagtgatgagaatggctgaaatacaaaataaaggtagcaacagatgctggcaaggttacagagaaactggatcattcatattgctggtaggaatggattttaaaatggtacagccactctggaaatggatattgcagttttcttcaaactgaacatgcaatttaccatatgactagaaattgccctcctaggcacttatttcaaacaagggaaaactttatgttcatgaaaaacctgtatacaaatactcttgcagctttattcataatactcctggaagtaattattcataattacttccataaactggaaataatgcaattgtctttcagtgggtgaaggagatctgctggttgaactcataactgagtctacacaagtgccctttctcaagactactatcctgcttctctttgcatatctcccattttctcacaaagaatattaaagacatgtactcaaggatcaaaatttaatgaacataaatattttactgctccatcaaaggcattcttaaatgggactgcagtttggagccactgccttggttctgctaaggtgctgggtgtgctaccgaccttggcatttgcagcattaatggaaaagtcaacataatgaaacaggcaaatggcatcttggtattactgtgaaaacaggtttccctccaggactctctgaaggcagctcagggggccacactttcaaaatggcagagatcaattatagttcctagtgagacccaacccctagcctattcagattcagcactctctctcgctcttttttttccctcattcttccaacttataattgtatatattttcaaatgtgcaaagaagctgaaagaatagtgcagtaaaattcaagttatcactctgatatatctgattaatatctctttatatgcatgaaagcagcgtgtggaatgatagacaatagagacccagaagggtaagagtggttggcagtgggtgtatcgtagaggagtttcttgttggggtcaatgtatctgtctccagtggtggatgcactgaaggccctgactttaccacaactcaatatagcaatgtagcaaaactgcacctgtgccccatgaatatatacgaatttaaaaatttaaaaataaaataacatctctctttgtagatacaggtagacatgtttgcatagcatgtgtgtgaatgtgtgtgtatgtgtgtgtagagaggcagcaggaatgaagagattaagattttgtgactgagccattctaaagtaacaaacataaaacacgcatggataaatgtctatgtgacaacaaacctgaatataaacatgaaagaacatgtctataaacatatctctggctagataacctatgaaagaattccctaccccagctcccttactggttaccctgcgaacacaggcaggcagggaacaggacccaactaggttccctcatcctcttgcttccaggcaggtcctgcatccactcctgctgcacagagggctcccatctctgccttggtcggtttcacaggtgctcccctaactctctctgccaccactgccttacctgggtggagctgaggctgccttgaccaagaacagcaccacccatctgtgtgccccaagaccaggaagttaggaggaaccacgcaacagagtcaataactatcccacctccccagtcagtctgaactgatggcgggagatgctgatgcttgcttatcctcattccccgtttatttattcttcgttaattcagtccaaactcccctcagtctgaactgatggcgggagatgctgatgcttgcttatactcattccctgtttatttattcttcattaattcaatccaaactcccctcagtctgaactgatggtgggagatgctgatgcttgcttatcctcattccccgtttatttattcttcattaattcaatccaatctccccagcagtcacttcacccaggaagcagactgacctctgctcttcataatcaggaaaccccaaagcactctccatcacctccctgatatcacccttcagctctacatcatcacatgtgggctctaactctgaaggcaggtgtcctcccacagggtcaacccctgaacattggccccagatgtctccccatctcttcccagccctttcagtactgctgtgaatctgtccctcactgagaactggcggggcgatgtgggggaggaggggaaatttcttggtgctgtgtcaaagcatcaagacagacctctccttctctcctgaacctcacactctatctcttcccagacacttgaaataaaacgcagaccagaaatgtctatttaagagtcaacacaatttctttttctagacaagtttctcttattctcagggctcagctatgactgtgggtgaccaaacaactattcacaaaggacagaactcgcttcaatgccagcttatgaatccacaccttgccacctgcagaggtggaaaaaggcacctaaatccacgatccaatagttcttcctgcccttaactcctcacacacatctggacacttggagagtgtggagggcacccagggtgcagggtggcagtggaggccttgggaaaactggccaggaagccaagatatgcacctcaggtgactaaatttttttactgttctgcacttgctggagaatgaccccaaaagataagatcaatttgttgactaccaacttatttggctgagccatggacatggagcagatgagcattgcctttacctatgacatgcatgaggattctgagacctacctgcagcagttaagccccacacccagagggacacccactctcccacctccttactttctgtatcttttcacactttacatcctcatccttccctctgagagtcttccctctttgggtcttctagtcctatcctaccctctatccccttccaggtggcacagggcttgaccatcacatttgtgtcaggtgacaataatgccaggatcctcagtatgggcagcatcgctttgaggtcagtgatagtgagctgcctgatgagacagacatctcctccacagtgagtgctgatgtcatgaagccctttagttcttcctagttccttaatatgtttgtcttcaatcctgtcatgggcacctgatgcataatggacacttggctgcttcatgcaccctggtctttgatgccgtgttgggatgtttttctgaccgttatgtggggtatctgttttctttcatcatattacatctcttcccccactcccaagtctgtcctctgaacccacacagtacaccagcatctgcatgtgtgccgtgtgctcctgcctcactttttccttttcatgccttattctcaccatgccacattttccccttagttgaacagacacagtaggggactagcccattctggcatgtgaccacgcttcaggaggagactgcaggttgggggtgaaggagactctactgaccccacccctgacatcctcttcccccaccccctggcttctgtcctctgcctcagcaccactcctgaacccccattcctgattgtcagaatttttaacataactaaaaatgaaacacaagtgcatctgcattatgtgtgggtgctctctccctttattttatttggggtgaggttattttagggcatggcccagggtaaattcctgtaaggccttggtgccctgctgtgaggtcaaagagggatgggactaagactgcagagccctggctcccccactacctgccaattgccagccctttgtggggtctcttctgctttctctggcctgggagatgctggggtgtttctgatcctggggctcctgggggtggtgcacattagttccaggcatggagggtgctgtgggcactgctgggaagcttgggtgtcccctcccaggctctctcctcccaggctctctcagtgcctcctcatctgtttctttagcttttggatcttgagcaccagggcctgggcccccaccgactccttcccttccaggagggcctggtccagctccagctgctgtgcaagcaactcctcagcttgggccagctcagctgtgtggggggctcagggccctggtcagagggagtggaggagggagcatcagccagggtagaggggttgaggcccttggaacctgtgttgcaagatctcatggtaagtgaggaattcgacctcgttttctctttttccagcccattagcttaagtccacctgtagtgagaatcccagggagcaacctgtcttgggcataggcctctggagggcagatacagatccctggctcaggggctatatctggatgccttgaatgaggatatggggtcaccggaaagagacaaccagatgtctgtccccactaataaatgattaactgttagatgagggggaattcctgttcaaggactctggactgtgctgctctgggcagagggagggctggagagagggagccctgagggctgggctggggtgggggtggaaggagctgagagttggaaataggcaaaaagctgcagaggtgagggtaatgcagggtgggattgagagaatttcccccgactactgtactgatcccttcatctcctccacccgagcacttggagccacatagcgggtggcctcatcttcccactgtcccagaagctgttctgcccttccatacttgccttggagttttgggagcagcatgtttatgagccctggggtgccagggaccaggagggcaggaggaggtgaagaaaacagcaccgagagagccaggggagtgggaggactgtggcaggtgaggcaaggagctgtctgagccgctcagcagccttcaggaggctctctccaggcctgtcttcactccagtgcctggccctacccaggcccccactcccgctctgctctcaagctggccccagacaggatcccaaacaactcctgttcctaatgtgaaaaatgtttctgccgctttaggcagaacttgctttagagcactggcacagccttccgcaggtcgtgtgtctgattctcttggcactgtgccttttttcacttattcttctgcaaggaaggaattatatcactggttgggtgaggcaactggctcagaggggttcactgagcactcacccactgggcaagtgtctgtcagggccagctatggccaagatgtgtccaaggctctatagctagctggtggaaaggcctggagggttcatattcaggtccacctaacttgaaaacttatattgaccttacttaagtactgattccccctttataatccatgccgcaaacttcattgtcttattttaagaagttgccataagagcctttagcaaccaccctcctgatcagccagcagtcatcaacattgaggcaagaccctgccccagcaaaaagattaagattagctgaagcctcagatgatccttagcatttttgagcaatagagtaattttaaattaaggtatatacatagttcttttatacataatgctatcatacacttaataggctacagtagagtgtgaatataacttttctatgcactggaaaaacaaaaatttgtgtgacttgtttgttgccatggtctgaaaccaaatctgcagtgtctctgaggtacgtctgtagtttccctttccctcttcctgctggcccggaatgaccttgtttcttgcccctgtctagccctgcatgctgcaggggtttgccttctctggtaggtctgggaactttgcatccttgtaaccttggctcctggcatatgacactggtaccaagctctgttggactagtgagcctcctccccacacacctcctgaactagaaccaaagctctgtgcatgcaccgtgcatgtgtgagccaatgacaagatgttgtcttcctgcgagtgttctgaaggagtgttctgttgtgactggaggacacagccacgggccccccaggcagaggtggctcagaagggagtggatggccccggttttgatcatctggggacaagaaggtcctgagataaaaacccatgttttggaaaacaaaactgcccgagactgaaaagtggctaaccaattcgctatctgggacatcactgcacactgggagggaagatggcttctgccatggtgtagggtcccggacctagacaaagaggccttcctatggctcagtgcttctgaagcacctttaaatgaggccaaagacctcatgttcatgattagctgactagttcccactcagtggaaaaaaaaacccagaacttttgcaaaattttaggagagagggatttccctcttgtctcttagtgctacggttatgcatgactcatacttgaattgcagtgtgtacacagcttaaggacttaactattagaatacaagaggcccaaactactgttgttatagatatgtaaaactatatggtataaggttaaacaacccacaactaattaacagtgaagataaattaactacattgcaaatttaaaacaagattagcagccctttagaaaaaaaacaaaacacatgggaggttgcaaaggcaatctaaatgatactctaataaaaatccttcatgaaaatgacatttcaaccatctgagtttctgctttaagttatgaactccaaaatggactaacacccaataatttacagtagggaggtctaagccaccaagaaaggtgtcagggcagacctgaaacctggaatgaacacgccccctctctcagggtaatgagtaaatcctctaagacccgttctatctcagacagaccatccactcataaggaggtcaaaagaaagttccacacagcactgagacccaaccacctcattgtcctcacctccacggacagagcccaggtgagagccacccctgctcctcctccctcatctcccacagcctcagcaccattgtctgcgccgagtccaccaggactcagctcatcatgtcctttccctgtttgtgtcagtgacactgggtcccccacatactctgcactcacatccccacaaggctctgcacaccactattctgtctccccaacctcccgaaccacagaaatcttcccagtgcaccccctggaatctcagtcaatgatcaacaaaacctccacaccctctctcaggatgttcctgcacctcccagctccagcagcaacctggtctccctgaggacatgaccccctctgaagtcctcccacataggggagtttcccccatggacttgtacccctgggttcagaggtgaggtggggaccttgctcctcactgtggttctcagaactttctgcctccctcctccctaaaacccctaggctgtcatcagattagacccccattcccctcattgtagccattccctgtgggcccctggcctttcctctcaatcctgactcttgtagctcttggttcactgtcaccctctccagcagtctccttgactgttggtgacttcaacatgtggtgggctgagtaatggtcccgaaagaggtccagtcttagtccttggaacctgtgaacaggttgcattacatggcaaaagggactttactcatgtaatgatgattaaggaccttaaaatagggagattctcctggacaatctgtgtggccccattcaaatcaaatgagccactaaaagcagagaacctgccctggctggagtcagattctgcagaggaggaaggcagaggagacatagaagaggggaggtcagacgttccaagcaggaggattggatgtgccttaggcaccatgtgtgagtagctgaaagaagattctaggagctaagcgtggctcttaacaaggaagtggaaacctctgttctatgtgcaaggaagtgaattcagacaagaacctgaatgagcttggaaatggattcttccccagagtctccaggagggaacacagacctgcccataccttgatcttagccccataagactgtgtggacttgcaacctacaggactgtaacatgataattaggtgctgtttaaagccacttggtttgtggtaattcttatggcagcaatagacacctatacagcagagaagatgcccttgctccctggactctcagatcctggaactcctctcctccatgaccttctcctctctctgcctgaatctcatgcccctgtcatcccctaggcctcatcatgcccaagaaccccagcccttccatactctcaatttcacacttcccactctctggccatctttccactcatcccatgcaaggtggccacaggctctgaggacacagactctatcattttatcatatgctgtgaggtaatatcagtgactactcattgcatatgtgcctgcattccaggcttgaagtccaccctttagcacatcaattccaacaatccttcgacccccaccctgggaataccaatccagtgattccaccatctactcactgtccctcatcgttggtgtcttctctaacttcatgacccaaaccacatggggagcccccaccagggccagcaatcaccctctccctgcatggctcaccctcagcctcctcctggcctgggtgacccttacacaccttctctctgtgctcacacatccaaccctccttccccattcttatctcagctgacaaccttggttcctacctcactgagaaaactgaacacattagaagacagattccatcaccatctgctcatgcatttgcagctgcaacacatgtcaggtgttttaccatgttggggactgttgtgggtaaaccattctgctcccatcagagccagtccctcttctggtgcccaaaatgtcatcccttatcatctacttaaaggtgtcagttcatcaattaatacctttttttctctttatcatcaacctttttcctctctccccactggatcattgtggcagtcatgagaatgcacatcccagcccctcagctagagtaagcagaattgatagtggcctcaacttttgaatcctgaaacctattgccacatttgctctgagaccacacctgccccctgtcttttcctgccaatgactgaggaaagcagggcagaaactaaggcaggaacatttcttctctgaaggctgactgaagctctagggcttcctgccacgcttactgaacttctgttagcctgcacagggtctaggatgcttccagctgaccttcctgcactgtttacctcactggggctcagagttgctttgtggtctgatgacattcccagcattttccgtctgtgtcctgaatttctctcataactatttcctctaataaatccttgcacattgaatactgtattggggtccgctcctcaggggaccctaactaacacaagtagtatgaagggtgatccatgaaaacaggcaaaaatgagaatttgaaaaaagcttgcccactgcctggcaggccaagaggatgccaccagggttgtgggagacacagaaattccatagcacaagatgcagccgagctgctatgggtctcaccagtgctgagctgagaggatgccctggttaggggaagctatggcaggtggggtgatagaatgccctgcacaataatgacggggttagggggaaacctacaaagacagtggagttggctggttactgctcagctgcaatgatgccctgtgaaagtatcatgagaatctgcagattgttaacagctgtcactggctacatgtgacagcctctgcagtgtctcatgcacaggtctttatctcttgtagcgaaagggcagataccgtggaatggtagctgaagacatcactatgagggccacagtgctccagagaggtttgccactcagccaaggcaggcctgttacaggaaagtcaggaccctggtggggaaacctgagattctgcaaacaggaacagggttatccgatgggtgccctccaggatcctctgggcatgcataggaggctcacccttctctagtaatggttcccacttcctatgctggaagatgctacagaagtctcacccccatgatacagcaggaatcccactgaagagctttgcaggaactagctggcacgtccccataggaggccgaggagcacttctgggattggaatttgagggtgtttgatcaaggaaccagaatttcaagctggaagaataaaaatcctttggcttggaggcactttctcaaggcatgggtttatcaaacaccccaggactttgataaggggggggccaaacccaccgctggggtgaatccatatagactagaaaaaatgatgcctaactctcaacaaggtagacgtgacttagttgccctggaacttgcacaggatggaataacaaggctgagggaagtgggcatggtgaaggcccaccagtaccatgctccacaagacggtccaaaggaaacaccttccaccagagcctcagaaacgtgatggtgagagggacctgcatcattaagaaatgtcggggtgttgtcctctgcaggctggatgtgatggtagtaaagatgacccagagttgcatttattaatatccctggggagagtgtggccctgaagagacaaagaccaaatggtggcagtgacctgaaaaagccagagggcagagttactatggcaaactaaaaggagtagccaataggactcaagctgcagggaatgtggggaaggatagtagagggtggtgtcccaggattaggacaggaagccaacaagggcgctgcttgatatctatgataagaaagcaagaattgagaagcaggagggtgaaggtgtttgacccaatacaaagtcatgatcccatcctcaatgcctagacctcagccaaagttcagattcagatcccagtgacagaggaggagtccatatccctaggaggaataccctgcaactccgtggaagtaaatgctggcacaattccctcagtccttcagcaaaggaacctatagccatttactcaggagattgtacactggcgaaaggaaagatgcagaactggtcagattattgacactgagtgagagctgacattgatgcccagatgcccacagcactatcatgtctcccatcacagtggggcttacggaggtcagggagtaaacctggacacattacggcccacaatggaactactggatccatagacccagccctggttatcttccaattccctgagtgcataattaacactgatgcactgttaagtggagtcacccccacactgggtccctagtctgtggagtcaggactctcattgtgctgaaagccaaagggaaacctctgacgctgcccacatcctggcaaaaaaaaaaaaaaaaaaaatcatagtgtgtcccagggtgtgtcttgaggaagacactgaaagtaatgtgggggtcacaccaccattagagagctgaaggatgtgggatggtgttggggttgtctattgtctctacataatccagcaacctgtccctgaggaagcctgatgaggactaaagaatgaatgagattactccaggcctggccaagcaggaattataattgcagcttttatgttgtctggatatcactgcagagcagaataataaagcctcgggcacacagcgtgcagctatggatttggtgagtgcatttctttccactccaattagaaaggggatatggagcgattcacatccatgtgggatccacaacacatttatttatagttttttctcagggctattgtaactcccctgccctatatagtatggtctaaagacaatactagacatactggatattctataggatattaaatcagctcatttcactgacaacttcatgttgactgcggtgaatgagcagcaggtagaaagtgcactggagtcattggcaaaacacacgcactccagtatgtgaagataaaccttacagagcttcaagagtggccactgaagtgaagttttatgggttaacaagtgccaagtgtttaggggaatgcaggtgtgttccccccaaggtaaaagacaaactgtttcatcttgcatcctcaccagaaggaaggaagcacactgcctgatgagcctctttgagttctgacaacaccacattccacatctaggtacgtgctttggcaaacactctaggtgacataggaggaggccagcttcaagtagggcctacacaggaaaggaccctgcagcagatccaggccatggtgcaagcagccagcgtccctcagaccccctggggctggtggtgccagtggtggggaaagatgcaggatggagcagaaccaagcaccagtgggagagtcacagtgaagggcctgggattctggagtaagatcatgtcatccacagcagagacatatgccccctgttagaagcaacttttagtgttccttgtactgatttgatagaaagcttgaccacaggacaccaggcaactatgtggttccaagtgcctttgtgacccacaacatcataaattgcacaggcccaacagcattcatcatgaagtgaaaatggtccacctggattgagcttgaatcccacgtttacacccacagaaaacacccaagtctgatgtggcactgaacaaccaaacagacaaatggcagttagccagccttcaccatgggtcagcccaggcctggtaggatgagtgcatgaatggagcaaccacagtggcaggcatgagtgccagcagcactgacttccccctaccaaggcagatccagctgctgccacctctgaatgtccaactcatcagcattttaggcccatgatgtgccctagtggggcactatttctttaggtgactagtcattaactaagaagttgactacatttacctacttccatcctggaaggaccagaggttcatcttcacagggttaggtacctattctagggggggttttctgtcctgctctcagacacagccagtaccactctctgggtgctgttgacattcctggtctgcaggctaggcagtgctcctagcccattatctgcctgaaggatccacttggcaagggaaagattcagtgtttccatggctgttgcttccactaaccctatcaccagctactctccccaggggctgccagccacaaggaatgccccatatgtagcctcacacctgccactgtggttgttccattcatgtgcccatcctatcatgcatgggctgacccatagtgaaggctggctagcttccatttgtctgtttcgttgtttaatgacacttcagacttggctgttttctgtgggtgtcaacatgggattcaagctcaacccaggtggatcattttcacctcatgatgaatgctgtttggcctgtgcaatctatgactttctgggtcacacaggcacttggaaccacatagttgcttggagtcccgtgatcttccacaggcacaactaagtgccagcctggaggaagcactctgagggttgcgtgccatctttcaggacatggtgcgttgtttaaatcagagtcgtctctacagttctgtgttcgcaagaggaagaacatgtgggtccagaaatcaaacggtggaagcaggtatggctccatgtctaatctcttagattcacctaatggggtatttgacatgttttatctcagaacactgggctgtgcagggtacgaggtcctggtttgcaaaggagggtacccttaaaagcagacaaaagacagcccactgaactacacattaagtttgtcaccagagaagtgtggacagtatatgcccagagaccacctggtgagaagaggagtctcctcctctccaggcccaggtaatagatcctcatccccaggaggaggcatggctactttcacacaataaaggcagaagtgtggaaaccagagatccacctgggggccttctgttttccctcaccccattgcaagtgagagtagaattatccagcaattcagcctgagaggatttgatttccaagggcccagacccatcagggcagaaggtttgagtcacactcctgggtaatcctccaaggccgtgctcctgtgctctgacatcctcagtggcattggtgctgaggccctgcttcccatggactattcccaaccagtgatgggtcacaccagtgacactaaggcaggacattcctggaagacaggggactcctctgatggccagctgtggctggaggactcctccatagccttgctcaactctccttagattgcctgtggtctaggacatgttaagtaatccttccttccttctttccatcactgggggtcacacttgcatcttattctattgcctttcccagggtaacctacctccctcaccatatcgtctgacaggtgtgtcccctaataaaatgctgtaactttaatcctatgatggcacttgctttttggagcatttggactacaaaatcattttcgtctgcacaccagtgacctcttacttattccaacgtgtaaaatctttttgtttattcaacttcttctacctgcattggctccattttgctggtatttgtattatgtttttgagttcaccaatgtttgttgctgtaagtcactaaatttgggggtagtgttttacacagcaacagataactaatgaagccttcttacatttccgttattcgatagaggttaactacgtctattttatttcctcctattttgataatattagccatacagagggtttccagttcccaacgcctattcttttctttattttagtttcttttctcctttgttccttctttttctctttccttctgtccctccttccctctttaattccattcaatctctcgccctccttctcccttcctcctttccgtcctttttcttccccttccccttccttcttttcttctttcactccttcctcaattcctccttctttctctcccttcctccattttttcctttttattatgaaattttcctaacatattaaataacccctacgtgattgtgttatcagtaagcattttctgaatctatatgtcaaaagtataataccatggtatatgagaaacaagtaaacaacaggaagttattaacagagtctgaataaaaatgcctgctataattctgcagccaagacagtggcttttaactcaattccttcaactaggtgttttcagaacacatgagtttaagttgacacaatcaccttggaaatcatattatcattatctagtatggttaaagtccatacaacatatcgtccaaccctcccactcctaaccatacactctagcgggctttcttgcctatgtgcccaggagacaggcacactgatgtttatggcaaaaactggaatcagccacatatacatcaataggaaatatacatcaataggaaattgtggcataaaatgtaaaccttcagcagtgaaaatgaatgaatgacagcctcccacaccacagataactcctgtacgtaatgtgcatcatgggaaaataaatgcagtaggaatttgctgtacaggaagcttaaaaaccagcagaagtaaataattttttttggatatatatgtgtgtatatatatatatatatacacacacacacacacacacacacacacacacacacacacacatatatatatatatatatatatatatatatatatatatactcattgtgcaaatctttaaagaaatacaaaggaataaggatcacaagactcaggatggagtctctctctgggggatgtgactgggcagcagcccaggggagctttacaggtttgtgttttacaccagtgctgggcatctttttagttacatgattgtaatttgttaaacagagttttcaaattaaaatatacctggtatttataaaaatgaaagagaaaagaataccaaagttcattgcaaggatccttaacaagaactacttacattgaaagaaaaccacagagaaatgtaagcagccatgtgacagagaggaccaggatgtgatgaaaatggccttggttaataataggtcatttgatccttagctcactggcatctctctggattttcaagtatacaatgttcaatctgatgtgcaaggtaattccttcttgcaaaggatttggtgttacattttaccacacatacaactgaattaaactttcacagaattggaaatacacatcactgatcaaaataaatgaaacaagaaaagagtagaaaggaacaaccagtgatggaatagcaaatatgaatggaaagcaaaataagacagctaaaaaaaaaaaaaaaagaaagcttcagaagcacataatagcagtgctatttagaactgtagtagtgtccaaatcacttctaccacatctcatgcaataccacacccaaaaatgttaagtttacaatagaatgcccctgagccgtttttggaaaaaatttgattctcaattcgagttaagcattttgggctactgcatcaaaccaaagttactggcattatgctaagctagatgtgttgactgaagtatgagattcccatttttgtaaatgagaagcaatctgattatgcaattttttctaagtgaaagcaagtttattagagaagtaaagaaacaaaagaatggctactccatagacagagcagtgtgtgtgtattttttttttaagtgtaggcaaatgttttctgaagatgatatgtcaataagaaaattggcacttggggcatacttccactaaatttgagacatcttagacaaaacaaagacttattttcaaggcatcattcttatggcactgaagtcttggaactatttgatctagttactctatgttctcaactgtgttaacttattgaagaacattgttattaaaggtatttacaagagaaacgcagagatactgttgtttctcctttctctgtctcaaactgttttccctgcagcacccaaggctctgtcatgtctcaaacatttaatcattaatttaaaaagagaagcttatcacagaattagaaaaaaaaatttgaaaattcatatggatccaaaaaagaggttgtgtagccaggagaatgctaagcaaaaagaataaagctggaggcatcaggctatcctacttaaaactatactataaggctaaagtaaccaaaacagcatggtactggtagaaaaacaagcatatagaccaacagaacagaatagaaaactcagaaataagacctcacatctacaaccatgtgatcttcaacaaacctgacaaaaacaagcaatggggaaaggaaacgctatttaataaatggtgctgggaaaactggctagccatatgcagaaaattgaaactggaccccttctttacaccttacacaaaaattaactcaagatggattaaagacttaaatgtaaaacccaaaactagaaaaaccctgaaagaaaatctaggcaataccattcaggacataggcatgggcaaagattttatgatgaaattgccaaaagcaactgccacagaagcaaaaattgacaaatgggatctaattaaacaaaagagcttctgcacaggaaaagaaactatcatcagagcgaaaaggagacaacctacagaatgggagaaaatttatgcaatctattgatctgacaaaggtctaatattcataatctaaaaagaacttaagcaaatttacatgaaaaaaacaacttcattaagaagtggacaaagcacatgaacagacacttctcaaaagaagacatacaggtggccaaaaaacatattttaaaaagctcaatatcactgatcgttagagaaatgcaaatcaaaaccacaataagataccatctcatgccagtcagaatggcaattattaaaaagttaagaaacaacagattctggcgaggttgtaaagaaataggaatgcttttacactgttggtggaaatgtaaattggttcaaccaatgaggaaggcagtgtggtgattcctcaaagatttagaaccagaaataccatttgacccagcaatcccattgcagggtatatacccaaaggaatataaatcattctattataaagatatgtgcatgtgtttgttcattgcagcacaattcacaacagcaaagacatggaatcaacccaaatgcccaccaatgagggactagataaagaaaatatgatacatatatgccatggaatattatgcagccataaaaaggaatgagatcaaatcctttgcagggatatggatgaagctggaagccattatcctcagcaaactaacacaggaacagaaaaccaaacaccgcatgttctcacttataattgtgagctgaacaatgagaacacatggacacagggagaggaacaacacacactggggcctgttgggggagggcggtggtggggggagcattaggaaaaatggctaatgcatgcaggggttaatacctaggttatgggttgattggtgcagcaaactgccgtggaacccgtttacctgtgtaacaaacctgcacatcctgcatatgtaccctggaacttaaaattaaactaaattaaattaaaggacaagattaaaatgttaaggaaaaataattagattaaaagcctttaacttaaaaatcctgaaataatagtttgaattttgcttttaacatatatgcaaatcctttaatactgctcccttccagaggtgcagcttaattccctctcttgagtgtggcttggacttaatgatgcacttctgatatggcctggttctgtgttcccacccaaatctcatcttcaattgtcatgcgaattgtaatccccagtattgaaggagggacctcatgggaggtgattggatcatgctgttctaatgatagtgagtgaattctcatgagatctgatggttttataaggggcttttccccgcttccctctgcatttctctctcctgccaccatgtgaagaaggacaggttttcttccacttctgccatgattgtaagtttcctggggcggcctcctcagccatgcagaactgggagtcagttaaacctctttcctttataaattacccagtctcaggtatttctttatagcagtgtgagaacagactaatacaacttctaactgatagagcaatgccgacgtaacagcttgtgactctgggtgtagaacctaaaactccctgtggcttccaccttctctctctctgtctctgggatcatgagctctggggaaagtcagctgctgtgccatgagcagccctgcaggaaggtccatctggctaagaactgaggccttctgggactcaattacaacgaactaggccttttccaacagccatgtgactgatccatgtttcatgtgaatcctcagccccagtgaagccctcagatgatgcaggcctagactgacaactggactgcaaccttgtgagaggcccttagcaagaagcactcagggaaacttctcctggattcctgacaattggaaactgtgggagatgatcaatatttgttgttttgaaatggtacattttacataatttgttatgcaatagtaaataactaatacattttcacaagacaggatgtattattacatgttaatttgcatttgctctaaatttatcatcatcattattattatttttgagacagggtctcactctgtcacccaggctggagtgcagtggcatgatcaccatgcactgcagtgtagacctcctgggctcaagggaccctctgacctcagcctcttgagtagctgggagtacaatcatgaaccaccatgcctggctaattttctaattttttgtagagatgggggtttccccatgttgcccaggctgatcttgaacttctggagtcaacaaatctgccttcctctgccttccacaatgctaggattgcaggtgcgagccaccaaatctggcctaaattaattaaaagatataaatatgtaacttagttttaaaaggtaaggagaattttcgtggctgaaaaggatgtattttattaccgttcacaatgattactttacttgaacttcaatttgcaactgtgtcccaagtgaacacaaaaagaagatccagcccttgctaggctgattctatgatggcctcaacaacaagctcctggtcattcaccttccccccattattcaaccaactctaatataggtgctgctgtgaagggatttagcagatataattaagggcctcaattagttgactttaggctgggtttatgctgcttggactgtcctaatcaggtgagtccttgaaaggactgggttcttcctgagcatagagattcacagtgtgagagggattcagcatgaggggtttcctccactgtgggctttgaaaatgaaggggctgtacagggaagaacgctggtgggcatcaggaattgagcgcagccctccctgttctctacattgacagccagcaaggaacgcggacctcagtcttacaactgcaagaaactgcattctgccacctctgtataagcctgaaggaggattcaaaatgaaaacacagctttgggaagcccggaacagagattccatccacatcatgcccagatttctgactaaggtactataaacagataaatgggtgttgtttggccaggcgtggtaatgcacacctgcaatcctaacatctgaggagttgacacaggaggatcacttgcatccaggagtttgagaccagccaagatcaaacagtgagacactcatctctacaatttctttttaattagctgggagtggtggcacttgcctgcagtcctagctactctgaagactgaggcaggaagatcccttgagcccaggagtttgaggctgcagtgagccatgatcatgtgactgcacttcaccctggatgacagagggagactctgtctctaaaaacaaataaatcaacaataattgggtgttgtttaaagtcaatgtttgtgataatttgttatgcaatcttataaaattcatacacaggctcaacagactcggatgaattgatatgcacactagttacataagataaaatatttcttaatttttcagtgttttacattttataactttctgtgatgcaatttaatacattcatatttcattcattcagtcaacaaaaattaatttagtgcctaagatgaaccaggtatgccctcatatgctcacgtgcctgacattctagaagcttcacaagaccgaggtggagccactggagtgttttaggtgaggaaatgacacactctgactcacaggagcaggaccactgtggagagaacagtcacgtagcaggtaatgggacaatgctagagccacaatttagaagtgacagggtggtggggactaaggggagaggagggcctgagggatgaaagggacagagggaagggctggagaagcaggaggttaggaaaaggagcagagggaaggaattggaaagcagtagaattcttaggtttaaacacattgttttatagatttttattacatccatctacagagcctcgctcagtgttctttgcagttggcctttaatacctaatgtaggactgcctaaaaactaatgttttttatgttaataaggtttaaaaaatacttagtgttccttctttgcagttggcctttaatactatatttgggactgcctagaaactaattttttttaattaatcaggttttaaaaatactaagtgttcctataagatatacacaccacttagacgtgaatacttcctaaaaacaggcagcacatgagcactgctgaggggcattgtgactgcattgaacacttgcaactgtgaggtgaataaagtctgtactggctcccggttgcaacatatagtaacgcagtgtgctactttatattgaggagatgtcttggactcacccagtaactcagggctgtggaatgaaggtaaatgtaaaaaacaagcgggagtcacagatacattgtctgcgaaagtcaaacttagtagctttgtgagtcctgttgtaatgctttcagacacatttatatatcaaggggccaaagttacattttttaccgattagattcctgatcatttaggggttgccaagattctgctacccactgtagttaataaacaaagagaaaacttgtctctatgctgtctcatgtactcaggcacaacttttccggatttaaagaaaaaaaaaacaaaaacctgtctctacgcctccattcccagggcgagctctgcctctctggcggcgagctccctctctgtcaccaagctccctggggtgagtttttttctagaagagttcagggaaataggtaaggagtgggaggcagggagtccagttctgggacggggattccgggatgaaaaatgaagagggacggggcccatgacgagggtttctccctggtttctcagacagctcttgggccaagactcagggagacattgagacagagcgcttggcacaggaggagcggggtcagggcgaagtcctatggccccaggcgtggctctcagggtttcaggccccgaaggcgatgtattgattggggaggcccagggttggggattccccatctccgcagtttctcttctccctctcccaacttatgtagggtccttcttcctggacactcaggatgtggactcagttctcacccccatttggtgtcgggtttctagcgaagccaatcggcgtcgctggggtccctgttccagaagtccccgcgaacccattgggactcagattctccccagacgccgaggatggggtcatggcgwcccraaccctcctcctgcygctcttgggggccctggccctgaccgagacctgggcgggtgagtgcgggatccggagggaaatgrcctctgcggggaggagstaggggcccgcgcactggggcgcaggacccggggagcmgckcaaggaggagggtcggaygggtctcagcccctcctcgcccccaggtwcccactccataaggtakttcagcaccgccgtgtcccggccgggtcgcggggagccccggtacatcgcagtgggctacgtggacgacacgcagttcgtgcggttcgacagcgacgcggcgactccgaggatgtagccgcagkcgcmgtggttggagcaggakggaccggagtattgggaccggagcacacsgaacatcaggcccgcgcacagactgacaagagtgaacctgcccatgccgcgccgctactaccaccagagctaggccggtgaatgaccccggcctggggcgaaggtcacgacccctcctcatcccccacggacgycccgggtcccccccgcgagtctccggctccragayccaccccgaggctgcgggacccgccagatcctcgacccgggagaggcccaggmgcctttaccaggtttcattttcmgtttaggccaaaatccccgcgggttggtcggggcgggggcggggctcggtgggcggggctgacmgcgggggcggggccagggtctaacaccctccagataatgtatggctgcgactyggggctggaasggcgcctcctccgcgggtatgaacagcacsccaacgatggcaaggattacatagcccggaactaggacctgcgctcctggaccgcggcggacatggmggctcagatcaccaagcgcaagtgggaggcagaagaatttgcagagcagatcagggcctacctggagggcacgtgcgtggagaggctcgcagacacctggagaacgggaaggagaygctgcagctcacgggtaccagggaacacaagacgyctccctgatcgcctgtagatctcctgggctggcttcccacaaagagagaaggaaaatgggaccaacactagaatgtcgtcctctctctggtcctgagggagaggaatcctcctgggtttccagatcctgtacaagagagtgactctgagggtctgccctgctctctgatacaattaagggatgaaatctctgaggaaatgaagggaagacaatccctgraatactgatgaggggttccctttgacacyrgcagcagccttgggccccgttacttttccyctcaggccttgytctctgctttacactcaatgtgtgtgggggtctgagtccagctcttctgagtccctcagcctscactcaggtcaggaccagaagwcactgttccctcctcagggactrgaattttccacggataggagattatcccagrtacctgtgtccaggytggygtctgggttctgtgctcccttccccaccccaggtgtcctgtccattctcaggatggccacatgcgtgctgctggagtgtctcatgagagatgcaaagtgcctgaattttctgacwcttcctgttagacccccccascaagacacatatgatccaccattccrtctctgactataaggccaccctgaggtgctgggccctgggcttctaccctgtggagatcacactgacctggcagcaggatggagaggaccagactcrggacatggagcttgtagagaccaggcctgcaggggatggaaacttccagaagtgggcagctgtggtggtgccttctggagaggaacagagatacatgtgccatgtgcagcatgaggggttgcccaagcccctcaccctgagatggrgtwaggyargagatkagtggagggggggtcatgtctcttagggaaagcaggagcctctctggagaacttcagcagggtcggtgctgggggctgagggtcagggacgctcaccttccccttttttcccagagcagtcttctcagcccaccatccccatcgtgggyatcgttrctggcctggttctccttggagctgtagtcactggagctgtggtttctgctgtgatgtgcaggaagaagaactcaggtaaggaatggatgaggagtggggtctgagatttcttgtcccactgagggtttcaagccccagttagaagtgtgtcctgcctggttactgggaagcaccatccacactcatgggcctacccagcctgsgccctstgtgccagcacttactcttttgtaaagcacctgtgacamtgaaggacagatttatcaccttgatgattatgatgatggggacctgatcccagcagtcacaagtcacaggggaaggtccctgctgaggacagacctcaggagggcagttggtycaggacccacacctgctttcctyatgtttcctgatcctgtcctrgatcagcagttacactttcaggaaacttctctrggatcaaaggctagggggtttgtttagggccgtatggccctgactcctttctggcctctyataggacattttcttcccacagatagagtgagctactctgaagctgcaagtaagtatgaagtgggctgatccctgagatccttgggatattgtggtcgggagcccatgggggagctcacccaaccccagattcctcctctagccgcatctyctstgggctctgaccaagtcctgtttttgttctaccccaggcagcraccatgcgcagggttctgatgtgtctctcayggcttgtaaaggtgagamrctgggggacctgatgtgtggggggtgttgggggcaatagtggaygcagctgtgctatggggtttctttgaattggatgtattgarcatgtgatgggctgtttaaagtgtcayccctcactgtgacggatatgaatttgttcatgaatattttattttatagtgtgagacagctgccttstgtgggactgagaggcaagatttgttcacgccttccctttgtgacttcaaaaaccctgactcwctttctgcaaaggcacctgaatgtgcctgtgttcctgtaggcataatatgaggaggtggggagaccaacccacccccatgtccaccatgaycctcttccctcatgctgacctgtgttccstctccaataattaatcattcctgctccatagasgtgaggctgagatgtctccatctctrtctcaactttatgtgcactgagctgtaacttcttacttccytattaaaattagaatctgagtataaatttactttttcaaattcttgccatgagaggttgatgggytaattaaaggagaagattcctaaaatttgagagacaaaataaatggaagacatgagaaccttccagagtccacawgtttcttatgctgatttgttgcatgagaggagagtagatggggctgtgcccagtgggtgctcaggccaccgtgcrctttatgtggtcactgctcagctgggtcatctttgctgctcygttgtccttggctgtatgatccrkccctacgggrcttagcgggttttctccccgtgtgcggagatgagagattgtaataaataaaagcacaagacaaagagataaagagaaaacagctgggccsgggggaccactaccatcaagatgcggagaccggtagtggccccgaacagctgggctcgctgatatttattgcatacaagacaaggggcagggtaaggaaggtgaatcttctaactgattgacaaggtgaagcaagtcacgtgattacaggatagggggcccttcccttttaggtagcatatgtcaccattttcttttctgcacttaagatcaaagactttaagactttcactatttcttctaccattwtctactaygaaattcaaagaggaaccaggagtacaggaggagcatgaaagtggrcaaggagcatgaccactgaagcacagcaccacagggaggggtttaggcctctggatgactgcgrgtagctctggataatatccagccttctacaagaagctggtggagcagagtgttcccygactcctccaagaaagggagactccctttcrtggtctgctaagtaacaggtgccttcccagacattggcattgccacttgaccaaggatccctcaagcggcccttatgcgggcgtgacagaaggctcatctcttgccttctaggtcacttctcacaatgtcccttcagcacctgaccctatgccygccagttattcctaggttatcttagtaatgcaacaaagagtaatattaaaagctaatgattaataatgtttataataatgattgataatttttcatgatcatctctatatctaatttgtattatgactattcttattctaactattttctttattatactaaaacagtttgtgccttcagtctcttgcctcggcacctgagtaatcctccacccacacttggcccttcagtagaaccttgtcccaccatgacctgtgatcacagggacttggatgtcacctayggcagtccctgcaywccagggtccttgtggtatcaagagacaaattttcagatckttcaagctcttgccstcttcccagggctctttcctcattgtattttccatcttttctgcaatctttttaaaggaaccagattctgaaattygccaagaggcagggtcccrtagtttctcatcataggtaactttctgttggaactcctcttctgcwctcctactcttcttcctgccctgagttgtagtaatcctagtgctggctccaakagaaactcatcaatttataaagcagagtctagtttagattcatatgtggttggaaaattggacccataagcctagggttatctttcctgaagagaaaaatatggttgtgtgctgcagtgtgcagkagagttrgtgtggggggagggagggagggagggaggacacacaagcagccctggtgagaaaagmtcyrgtggcactgatgtcagtgtgagatgatgttgttctgtagctgccacaaaaataaagcatttgtcctgaggctacattaataaagatattgcctctagaatagagtggttctctatgatcattccttcaactgacatttgtttctgctaggtatatractgtttttgcatttagaaagcatcattaaagtaaaaacagaaaaatttcgggccttrtggtgyatatgttctagatgcaagcttrtccaacccgcrgctcgtgggctgcatgtggcccargacaattytgaatgtgaggacttttttgcttatctgtggtgcacctgagtcccggagtgagtgcacccacctccctcagggtcaggagtgaatgctttaggaaccctccttttcagtgacctgaaaaagatagagggcacacttactgtgataacccagagtatcagtcaagggggcttgaccttcaaggagttatgggaaagcttaataaagggtggtgtcccagggtcagaaaagatgggcagacagcaagagcactgcttgatatctatgataagcatgtaagaattgaggagccctctccctctccctctccctctccctctccctctccctctgcctctccctctccctctgccacggtctccctctccctctctttccacggtctccctctgatgccgagccgaagctggactgtactgctgccatctcggctcactgcaacctccctgcccgattctcctgcctcagcctgccgagtgcctgcgattgcaggcgcgcgccgccacgcctgactggttttcatatttttttggtggagaaggggtttcgctgtgttggccgggctggtctccagctcctaaccgcgagcgatccgccagcctcggcctcccgaggtgccaggattgcagacggagtctcgttcactcagtgctcaatggtgcccaggctggagtgcagtggcgtgatctcggctcactacaacctccacctcccagccgcctgccttggcctcccaaagtgccaagattgcagcctctgcccggccgccaccctgtctgggatgtgaggagcccctctgcctgactgcccagtctggaaagtgaggagcatctctgcctggccgccatcccatctaggaagtgaggagcgtttctgcccggccgcccatcatctgagatgtggggagtgcctctgccccgccgccccatctgggatgtgaggagcgcctctgcccggccgtgaccccgtctgggaggtgaggagcgtctctgcccggccgccctgtctgagaagtgaggagcccctccgcccggcagccaccccgtctgggaagtgaggagcgtctccgcccggcagccacccactccgggagggagttggggggtcagccccccgcccagccagcctccccgtccgggaggtgaggggcgcctctgcccggccgcccctactgggaagtgaggagcccctctgcccggccagccgccccatccgggagggaggttggggggtcagccccccgcccggccagcctccccgtccgggaggtgaggggcgcctctgcccggccgcccctactgggaagtgaggagcccctctgcccggccagccgccccgtccgggagggaggtggggggggtcagccccccgcctggccagccgctccatccgggagggaggtgggggggtcagccccccgcccagccagccaccccgtccgggaggtgaggggcacctctgcccggctgcccctactgggaagtgaggagcccctctgcccggccaccaccccgtctgggaggtgtacccaacagctcattgagaacgggccatgatgacaatggcggtttagtggaatagaaaggggggaaaggtggggaaaagattgagaaatcggatggttgccctgtctgtgtagaaagaagtagacatgggagacttttcattttgttctgtactaaggaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaatgatcaataaaaaaaaaaaaaagaattgaggagcaagcttcayattcagaatccagtggctgaggaagtatccatatccctaagagaaagaaccttgggacaccatgactgttacatgctgggacaattccatcagcccttctgcaaaggagcctatagccatttaatcaggagatgggataagtgttaacattgggtgtgagctaacattgctgcccagattcccacagcaccattatgtccctatcacagtggggcttacagaggccagggaatwaacctggacaaattatgccccayggtggaatcactgggtccataaatcctgtcctggttatctccccattctctgtaaaaasgattctctgtaaaaagattacatcgccctaaassaggacctgagctcttggacygcggcggccatggcggctcagattacccagcgcaagtgggaggcggcccatgaggcggagcagcagasagcctacctggagggcasgtgcgtggagtggctccgcagatacctggagaacrggaaggagayactgcagcacacctgtaccagggaccacgggcgcctccctgatcgcctgtaatctcccgggctggcctcccacaaggatgggagacagatgggaccaacactagaatatcaccctccctctggtcctgagggagaagaatcctcctcagtttccagatcctgtaccagagagtgactctgaggttccacactgctctctgacacaattaagggataaaatctctgaggcaatgacgggaagacgcaattaagggataaaatctctgagggaatgacgggaacacgatccctcatttagtgatcccaagtcactaaatttgggagtagtttgttacacagcaatggataactaatgaagccctcttacatttccattattctctagaggttaactacatctgttttattttctcctattttgataatattagccacacataggtttctagtttctcaacacctattcttttctttattttagtttcttttctcctttgttccatcctttttttttcttttttcttttcttttctttttttttttttttttttttgagacaaagtctcgttctgtcgcccaggctggagtgcagtggctcgatctcggctcactgcaagctctgcctcccaggttcatgccattctcctgcctcagctttccaagtagctgggactacaggcacctgccaccatgcccggctaattttttgtatttttagtagagacagggtttcaccatgttagccaggatggtctctatctcctgacctcgtgatctgcctgcctcggcctcccaaagactgggattacaggcatgagccactgtgcctgacctcttccttccctttctccttccttctagccctccctccatctctttcttctctatttccattcaaactatcgccttccctccttctttctccctttccttcccctccccttccttcttttcttcttttgctttttcctccattcctccttctttctctctcttcctccattttttcctttttattatgaaattttcctaatatataaaataactctatgtgattgggctgtaagtaagcattttctgaatctatatgtcaaaaatataatgtcatgtatatgagaaacaagtaaacaacaggaagttattaacagagtctgaataaaaatgcctgctataattctacagccaagacagtggcttttaactcaattccttcaacacagtgttttcagaacacatcatcaacatcaagtattacacatttattgtaaaagtttaagtagccacaatcactttggaatttgtattatcattatctagtatggttaaagtccatacaacgtatcatccaaccaacccattcctaatcatccactctggggggctttcttgcctatgtgcacaggagacatgcacactaatatttatggcaaaaactggaatcagccacatatacatcaataggaaactagtgaaattgtggtataaccatatgtaagccttcagcagtaaaaatgaatgaatgacagtctcccacaccacagataactcctacacataatgtgcatcatgggaaaataaaggcagtaggaacttgctgtacaggaagcttaaaaaccagcaaaacaaactgatatttgttttggggatatatatatatacacacatacatatatatatgtgtgtgtgtatatatacacatacatatacacatatatacatatatgtgtatatatacacatatatacatatatggatacatatatgtgtatatatacacatatatacatatatggatacatatatgtgtatatatacacatatatacacatatatgtatatatatacacatatatacacatatatgtgtatatatatacttattgcacaaatctttgaagaaatacaaaggaataagtatcacaagactcagcatggagtcttctgctgagaccagctcggtcagggagatcctaacccagcggtgctagaggaattaaagacacacacacagaaatatagaggtgtgaagtgggaaatcaggggtctcacagccttcagagctgagccccaaacagagatttacccacatatttattacagtcattagcattgtttctataaatattaaattagttaaaatatcccttatgggaaacgaagggatgggccgaattaaaggaataggttgggctagttaactgcagcaggaacatgcccttaagacacagatcactcatgctattgtttgtggcttaagaatgcctttaagtggttttccaccctgggcgggccaggtgtcccttgccctcattcccgtaaacccacaaccttccagcttgggtgctagggccattatgaacatgttatggtgctgcagaaattttgtttatggccagtctcggggccagtttatgaccagattttgggggacttgctcccaacagtctccttctggaggatgactgggtagcagcccagggtagttttacagttttgtgttttacaccagtgctgggccccctggtagttacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctgtgcaaggtaatttcatcttgcaaagattctatgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgctaaaaagaaaaaaaattcagaagcacataatagcagtgctatttagaatcatagtggtgtccaaatcacttctatcacatctcattcaataccacaacaaaagatgttaagtgtgttatagaatgcccatcggatagccagtttttgaaaataacttgtctctcaattcgagctaaccatttcgggctacagcatcaagccaaaattattggcatcatgctaagctagatgtgttaactgaagtatgagattctcatttttgtaaatgaaaagcaatcagattaggcaatttttttctgcacagcaaaagaaactatcatcaatcagagtgaacagacatgctacagaatgggagaaaaattttgccatctgttcatctgacaaaagtctagtattcagaatccacaaagaacttaagcaaatttacatgaaaaaaaacttcattaaatagtggacaaagaacatgaacagacacttctaaagaagacatacatgtggccaacaaaaatatgaaaaagaaagctcccatcactgatcattagagaaatgcaaatcaaaacgacaaatgagataccattttatgccagtcagaatggcaattattaaatagtcaagaaacaacagatgctggcaaggttgcagagaaataggaatgcttttacactgttggtggaaaagtaaatggttaatccattgtggaagacagtgacagtgtggcgattcctcaaagatttagaaccagaaataccatttgacccagcaatcccattgcagggtatatacccaaaggaatataaatcattctattataaagacatatgcatgtttacattcatggcagcactattcacaatagcaaagacatggaatcaacccaaatgcccatcaatgatggtctggataaagaaaatatggtacatatacaccatggaatattatgcagccataaaaaggaaggagatcaagtcctttgcagggatatggatgaagctggaagccattatcctcagcaaactcacacaggaacagaaaaccaaacaccacatgttctcatatataactgggaactgagcaatgagaacacatggacacagggagaggaacaacacacactggggcctgttgggggagggtggtgatgggaggatcattagcaaaaatagctaatgcatgccagggttaatacctaggtgatgagttgacaggtgcagcaaaccaacatggcacacatttatgtaacaaacctgcacatcctacacacatgtaccctggaacttaaaaaaaaattaaattaaaagacaagcttaaagagttaatgaaaactaattagatacaagaagactttgattttcagaaacctgaaacaatagttataattttgcttttaacatatattcaaatcctttgatactgttcctttctagaggtgcagcttaattccctctcttgagtgtggcttggacttaatgaggcacttctgaaatggcctggttctgtgctcccacccaaatctcatcttgaattgttatgcaaattgtaatccctacctattgggggagggacctcatgggaggtgattggataatgggggcggtgcccccatgctgttctcctgatgctgagggaattctcatgagatctgatggttttataaggggcttttccctgcttcattgtgcatttctctctcctgtcaccacgtgaagaaggacgggtttgcttccacttctgccatgactgtaagtttcctggggcagccgcctcagtcatgcagaactgtgagtcaattaaacctctttcctttataaattacccagtctcaggtatttctttatggcagtgtgagaatggactaatacttctaacttatagaatagtgccaacataacagtttgtgactctgggtgtagaacataaaactaactgcggcttccaccttctctctctctctgaatctgggatcatgagctctgggggaagccagccactgtgccataagcagccctgcaggaaggtccacatgactgagaactgaggccttctgggaacagacaacaaggaaccaggccttttccaacagccatgtgactgatccatgtttcttgtgaattcccagccccagagaagccctcagatgctgcagcccctggctgacaactggagtgcaaccttgtgagcggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatcattattatttttgagacagggtcttgctctgtcacccaggctggaatgcagtggcatgatcaccatgcactgcagtgtcgaactcctggggtcaagggactctctgacctcagcctcctgagtagctgcgactaccatcatgaactaccatgcctggctaattttctaattttttgtatagatggaggttttgcccaggctgatcttgaacttctggagtcaacaaatctccattcctctgccttccacagtgctaggatgacagacgtgagccaccacacctggcctaaattaattataagatattaaacatgtaacttagttttaaaaagtaaggacaatttccatggctgaagaggatgtattttatgaccattcacaatgatcacgttacttgaacttcactttccaactgtgtcccaattaaacacaaaaggaagatccaacccttgctaggctgattctatgatggcctcaacaagcagctcctggtcagtcaccttcctccagttattcaaccaactctaatgtaggtgctgctgtgaagggatttagcagatataattaagggtctcaattagttgactttatgctgggtttatcctgcttggactgtcctaatcaggtgagcccttgaaaggactgggttcttcatgagcacagagacttacagtgtgagagggactcagcatgaggggttt

SEQ ID NO: 17891 - DNA, 12600 bp, Homo sapiens
ggaggctggccgggcggggggctgaccccccaacctccctcccggatggggcggctggccgggcagaggggctcctcacttcccagtaggggcggccgggcagaggcgcccctcacctcccggacggggaggctggctgggcggggggctgaccccccaactccctcccggagtgggtggctgccgggcggagacgctcctcacttcccagacggggtggctgccgggcggaggggctcctcacttctcagacagggcggccgggcagagacgctcctcacctcccagacggggtcacggccgggcagaggcgctcctcacatcccagatggggcggcggggcagaggcactccccacatctcagatgatgggcggccgggcagaaacgctcctcacttcctagatgggatggcggccaggcagagatgctcctcactttccagactgggcagtcaggcagaggggctcctcacatcccagacagggtggcggccgggcagaggctgcaatcttggcactttgggaggccaaggcaggcggctgggaggtggaggttgtagtgagccgagatcacgccactgcactccagcctgggcaccattgagcactgagtgaacgagactccgtctgcaatcctggcacctcgggaggccgaggctggcggatcgctcgcggttaggagctggagaccagcccggccaacacagcgaaaccccttctccaccaaaaaaatatgaaaaccagtcaggcgtggcggcgcgcgcctgcaatcgcaggcactcggcaggctgaggcaggagaatcgggcagggaggttgcagtgagccgagatggcagcagtacagtccagcttcggctcggcatcagagggagaccgtggaaagagagggagagggagaccgtggcagagggagagggagaggcagagggagagggagagggagagggagagggagagggagagggctcctcaattcttacatgcttatcatagatatcaagcagtgctcttgctgtctgcccatcttttctgaccctgggacaccaccctttattaagctttcccataactccttgaaggtcaagcccccttgactgatactctgggttatcacagtaagtgtgccctctatctttttcaggtcactgaaaaggagggttcctaaagcattcactcctgaccctgagggaggtgggtgcactcactccgggactcaggtgcaccacagataagcaaaaaagtcctcacattcaaaattgtcctgggccacatgcagcccacgagccgcgggttggacaagcttgcatctagaacatatgcaccacaaggcccgaaatttttctgtttttactttaatgatgctttctaaatgcaaaaacagttatatacctagcagaaacaaatgtcagttgaaggaatgatcatagagaaccactctattctagaggcaatatctttattaatgtagcctcaggacaaatgctttatttttgtggcagctacagaacaacatcatctcacactgacatcagtgccactggagcttttctcaccagggctgcttgtgtgtcctccctccctccctccctccccccacaccaactctcctgcacactgcagcacacaaccatatttttctcttcaggaaagataaccctaggcttatgggtccaattttccaaccacatatgaatctaaactagactctgctttataaattgatgagtttctattggagccagcactaggattactacaactcagggcaggaagaagagtaggagtgcagaagaggagttccaacagaaagttacctatgatgagaaactatgggaccctgcctcttggcaaatttcagaatctggttcctttaaaaagattgcagaaaagatggaaaatacaatgaggaaagagccctgggaagagggcaagagcttgaaagatctgaaaatttgtctcttgataccacaaggaccctggtatgcagggactgccataggtgacatccaagtccctgtgatcacaggtcatggtgggacaaggttctactgaagggccaagtgtgggtggaggattactcaggtgccgaggcaagagactgaaggcacaaactgttttagtataataaagaaaatagttagaataagaatagtcataatacaaattagatatagagatgatcatgaaaaattatcaatcattattataaacattattaatcattagcttttaatattactctttgttgcattactaagataacctaggaataactggcgggcatagggtcaggtgctgaagggacattgtgagaagtgacctagaaggcaagagatgagccttctgtcacgcccgcataagggccgcttgagggatccttggtcaagtggcaatgccaatgtctgggaaggcacctgttacttagcagaccatgaaagggagtctccctttcttggaggagtcggggaacactctgctccaccagcttcttgtagaaggctggatattatccagagctacccgcagtcatccagaggcctaaacccctccctgtggtgctgtgcttcagtggtcatgctccttgtccactttcatgctcctcctgtactcctggttcctctttgaatttcgtagtagataatggtagaagaaatagtgaaagtcttaaagtctttgatcttaagtgcagaaaagaaaatggtgacatatgctacctaaaagggaagggccccctatcctgtaatcacgtgacttgcttcaccttgtcaatcagttagaagattcaccttccttaccctgccccttgtcttgtatgcaataaatatcagcgagcccagctgttcggggccactaccggtctccgcatcttgatggtagtggtcccccgggcccagctgttttctctttatctctttgtcttgtgcttttatttattacaatctctcatctccgcacacggggagaaaacccgctaagccccgtagggctggatcatacagccaaggacaacggagcagcaaagatgacccagctgagcagtgaccacataaagcgcacggtggcctgagcacccactgggcacagccccatctactctcctctcatgcaacaaatcagcataagaaacatgtggactctggaaggttctcatgtcttccatttattttgtctctcaaattttaggaatcttctcctttaattaacccatcaacctctcatggcaagaatttgaaaaagtaaatttatactcagattctaattttaatagggaagtaagaagttacagctcagtgcacataaagttgagacagagatggagacatctcagcctcacctctatggagcaggaatgattaattattggagacggaacacaggtcagcatgagggaagagggtcatggtggacatgggggtgggttggtctccccacctcctcatattatgcctacaggaacacaggcacattcaggtgcctttgcagaaagagagtcagggtttttgaagtcacaaagggaaggcgtgaacaaatcttgcctctcagtcccacacaaggcagctgtctcacactataaaataaaatattcatgaacaaattcatatccgtcacagtgagggatgacactttaaacagcccatcacatgttcaatacatccaattcaaagaaaccccatagcacagctgcatccactattgcccccaacaccccccacacatcaggtcccccagcgtctcacctttacaagccgtgagagacacatcagaaccctgcgcatggtcgctgcctggggtagaacaaaaacaggacttggtcagagcccagaggagatgcggctagaggaggaatctggggttgggtgagctcccccatgggctcccgaccacaatatcccaaggatctcagggatcagcccacttcatacttacttgcagcttcagagtagctcactctatctgtgggaagaaaatgtcctatgagaggccagaaaggagtcagggccatacggccctaaacaaaccccctagcctttgatcccagagaagtttcctgaaagtgtaactgctgatctaggacaggatcaggaaacatgaggaaagcaggtgtgggtcctggaccaactgccctcctgaggtctgtcctcagcagggaccttcccctgtgacttgtgactgctgggatcaggtccccatcatcataatcatcaaggtgataaatctgtccttcattgtcacaggtgctttacaaaagagtaagtgctggcacacagggcccaggctgggtaggcccatgagtgtggatggtgcttcccagtaaccaggcaggacacacttctaactggggcttgaaaccctcagtgggacaagaaatctcagaccccactcctcatccattccttacctgagttcttcttcctgcacatcacagcagaaaccacagctccagtgactacagctccaaggagaaccaggccagcaacgatacccacgatggggatggtgggctgagaagactgctctgggaaaaaaggggaaggtgagcgtccctgaccctcagcccccagcaccgaccctgctgaagttctccagagaggctcctgctttccctaagagacatgaccccccctccactcatctcctgcctaactccatctcagggtgaggggcttgggcaacccctcatgctgcacatggcacatgtatctctgttcctctccagaaggcaccaccacagctgcccacttctggaagtttccatcccctgcaggcctggtctctacaagctccatgtcccgagtctggtcctctccatcctgctgccaggtcagtgtgatctccacagggtagaagcccagggcccagcacctcagggtggccttatagtcagagatggaatggtggatcatatgtgtcttggtgggggggtctaacaggaagagtcagaaaattcaggcactttgcatctctcatgagacactccagcagcacgcatgtggccatcctgagaatggacaggacacctggggtggggaagggagcacagaacccagacgccaacctggacacaggtacctgggataatctcctatccgtggaaaattctagtccctgaggagggaacagtgtcttctggtcctgacctgagtggaggctgagggactcagaagagctggactcagacccccacacacattgagtgtaaagcagagagcaaggcctgagaggaaaagtaacggggcccaaggctgctgccagtgtcaaagggaacccctcatcagtattccagggattgtcttcccttcatttcctcagagatttcatcccttaattgtatcagagagcagggcagaccctcagagtcactctcttgtacaggatctggaaacccaggaggattcctctccctcaggaccagagagaggacgacattctagtgttggtcccattttccttctctctttgtgggaagccagcccaggagatctacaggcgatcagggagacgtcttgtgttccctggtacccgtgagctgcagcatctccttcccgttctccaggtgtctgcgagcctctccacgcacgtgccctccaggtaggccctgatctgctctgcaaattcttctgcctcccacttgcgcttggtgatctgagccgccatgtccgccgcggtccaggagcgcaggtcctagttccgggctatgtaatccttgccatcgttggcgtgctgttcatacccgcggaggaggcgcccttccagccccaagtcgcagccatacattatctggagggtgttagaccctggccccgcccccgctgtcagccccgcccaccgagccccgcccccgccccgaccaacccgcggggattttggcctaaacggaaaatgaaacctggtaaaggcgcctgggcctctcccgggtcgaggatctggcgggtcccgcagcctcggggtggatctcggagccggagactcgcgggggggacccgggacgtccgtgggggatgaggaggggtcgtgaccttcgccccaggccggggtcattcaccggcctagctctggtggtagtagcggcgcggcatgggcaggttcactcttgtcagtctgtgcgcgggcctgatgttcsgtgtgctccggtcccaatactccggtccmtcctgctccaaccackgcgmctgcggctacatcctcggagtcgccgcgtcgctgtcgaaccgcacgaactgcgtgtcgtccacgtagcccactgcgatgtaccggggctccccgcgacccggccgggacacggcggtgctgaamtaccttatggagtgggwacctgggggcgaggaggggctgagacccrtccgaccctcctccttgmgckgctccccgggtcctgcgccccagtgcgcgggcccctasctcctccccgcagaggycatttccctccggatcccgcactcacccgcccaggtctcggtcagggccagggcccccaagagcrgcaggaggagggttygggwcgccatraccccatcctcggcgtmtggggagaatctgartcccartgggttcgcggggacttctggaacagggaccccagcgacgccgattggcttcgctagaaacccgacaccaaatgggggtgagaactgagtccacatcctgagtgtccaggaagaaggaccctacataagttgggagagggagaagagaaactgcggagatggggaatccccaaccctgggcctccccaatcaatacatcgccttcggggcctgaaaccctgagagccacgcctggggccataggacttcgccctgaccccgctcctcctgtgccaagcgctctgtctcaatgtctccctgagtcttggcccaagagctgtctgagaaaccagggagaaaccctcgtcatgggccccgtccctcttcatttttcatcccggaatccccgtcccagaactggactccctgcctcccactccttacctatttccctgaactcttctagaaaaaaactcaccccagggagcttggtgacagagagggagctcgccgccagagaggcagagctcgccctgggaatggaggcgtagagacaggtttttgttttttttttctttaaatccggaaaagttgtgcctgagtacatgagacagcatagagacaagttttctctttgtttattaactacagtgggtagcagaatcttggcaacccctaaatgatcaggaatctaatcggtaaaaaatgtaactttggccccttgatatataaatgtgtctgaaagcattacaacaggactcacaaagctactaagtttgactttcgcagacaatgtatctgtgactcccgcttgttttttacatttaccttcattccacagccctgagttactgggtgagtccaagacatctcctcaatataaagtagcacactgcgttactatatgttgcaaccgggagccagtacagactttattcacctcacagttgcaagtgttcaatgcagtcacaatgcccctcagcagtgctcatgtgctgcctgtttttaggaagtattcacgtctaagtggtgtgtatatcttataggaacacttagtatttttaaaacctgattaattaaaaaaaattagtttctaggcagtcccaaatatagtattaaaggccaactgcaaagaaggaacactaagtattttttaaaccttattaacataaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctaacctcctgcttctccagcccttccctctgtccctttcatccctcaggccctcctctccccttagtccccaccaccctgtcacttctaaattgtggctctagcattgtcccattacctgctacgtgactgttctctccacagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaattaatttttgttgactgaatgaatgaaatatgaatgtattaaattgcatcacagaaagttataaaatgtaaaacactgaaaaattaagaaatattttatcttatgtaactagtgtgcatatcaattcatccgagtctgttgagcctgtgtatgaattttataagattgcataacaaattatcacaaacattgactttaaacaacacccaattattgttgatttatttgtttttagagacagagtctccctctgtcatccagggtgaagtgcagtcacatgatcatggctcactgcagcctcaaactcctgggctcaagggatcttcctgcctcagtcttcagagtagctaggactgcaggcaagtgccaccactcccagctaattaaaaagaaattgtagagatgagtgtctcactgtttgatcttggctggtctcaaactcctggatgcaagtgatcctcctgtgtcaactcctcagatgttaggattgcaggtgtgcattaccacgcctggccaaacaacacccatttatctgtttatagtaccttagtcagaaatctgggcatgatgtggatggaatctctgttccgggcttcccaaagctgtgttttcattttgaatcctccttcaggcttatacagaggtggcagaatgcagtttcttgcagttgtaagactgaggtccgcgttccttgctggctgtcaatgtagagaacagggagggctgcgctcaattcctgatgcccaccagcgttcttccctgtacagccccttcattttcaaagcccacagtggaggaaacccctcatgctgaatccctctcacactgtgaatctctatgctcaggaagaacccagtcctttcaaggactcacctgattaggacagtccaagcagcataaacccagcctaaagtcaactaattgaggcccttaattatatctgctaaatcccttcacagcagcacctatattagagttggttgaataatggggggaaggtgaatgaccaggagcttgttgttgaggccatcatagaatcagcctagcaagggctggatcttctttttgtgttcacttgggacacagttgcaaattgaagttcaagtaaagtaatcattgtgaacggtaataaaatacatccttttcagccacgaaaattctccttaccttttaaaactaagttacatatttatatcttttaattaatttaggccagatttggtggctcgcacctgcaatcctagcattgtggaaggcagaggaaggcagatttgttgactccagaagttcaagatcagcctgggcaacatggggaaacccccatctctacaaaaaattagaaaattagccaggcatggtggttcatgattgtactcccagctactcaagaggctgaggtcagagggtcccttgagcccaggaggtctacactgcagtgcatggtgatcatgccactgcactccagcctgggtgacagagtgagaccctgtctcaaaaataataataatgatgatgataaatttagagcaaatgcaaattaacatgtaataatacatcctgtcttgtgaaaatgtattagttatttactattgcataacaaattatgtaaaatgtaccatttcaaaacaacaaatattgatcatctcccacagtttccaattgtcaggaatccaggagaagtttccctgagtgcttcttgctaagggcctctcacaaggttgcagtccagttgtcagtctaggcctgcatcatctgagggcttcactggggctgaggattcacatgaaacatggatcagtcacatggctgttggaaaaggcctagttcgttgtaattgagtcccagaaggcctcagttcttagccagatggaccttcctgcagggctgctcatggcacagcagctgactttccccagagctcatgatcccagagacagagagagagaaggtggaagccacagggagttttaggttctacacccagagtcacaagctgttacgtcggcattgctctatcagttagaagttgtattagtctgttctcacactgctataaagaaatacctgagactgggtaatttataaaggaaagaggtttaactgactcccagttctgcatggctgaggaggccgccccaggaaacttacaatcatggcagaagtggaagaaaacctgtccttcttcacatggtggcaggagagagaaatgcagagggaagcggggaaaagccccttataaaaccatcagatctcatgagaattcactcactatcattagaacagcatgatccaatcacctcccatgaggtccctccttcaatactggggattacaattcgcatgacaattgaagatgagatttgggtgggaacacagaaccaggccatatcagaagtgcatcattaagtccaagccacactcaagagagggaattaagctgcacctctggaagggagcagtattaaaggatttgcatatatgttaaaagcaaaattcaaactattatttcaggatttttaagttaaaggcttttaatctaattatttttccttaacattttaatcttgtcctttaatttaatttagtttaattttaagttccagggtacatatgcaggatgtgcaggtttgttacacaggtaaacgggttccacggcagtttgctgcaccaatcaacccataacctaggtattaacccctgcatgcattagccatttttcctaatgctccccccaccaccgccctcccccaacaggccccagtgtgtgttgttcctctccctgtgtccatgtgttctcattgttcagctcacaattataagtgagaacatgcggtgtttggttttctgttcctgtgttagtttgctgaggataatggcttccagcttcatccatatccctgcaaaggatttgatctcattcctttttatggctgcataatattccatggcatatatgtatcatattttctttatctagtccctcattggtgggcatttgggttgattccatgtctttgctgttgtgaattgtgctgcaatgaacaaacacatgcacatatctttataatagaatgatttatattcctttgggtatataccctgcaatgggattgctgggtcaaatggtatttctggttctaaatctttgaggaatcaccacactgccttcctcattggttgaaccaatttacatttccaccaacagtgtaaaagcattcctatttctttacaacctcgccagaatctgttgtttcttaactttttaataattgccattctgactggcatgagatggtatcttattgtggttttgatttgcatttctctaacgatcagtgatattgagctttttaaaatatgttttttggccacctgtatgtcttcttttgagaagtgtctgttcatgtgctttgtccacttcttaatgaagttgtttttttcatgtaaatttgcttaagttctttttagattatgaatattagacctttgtcagatcaatagattgcataaattttctcccattctgtaggttgtctccttttcgctctgatgatagtttcttttcctgtgcagaagctcttttgtttaattagatcccatttgtcaatttttgcttctgtggcagttgcttttggcaatttcatcataaaatctttgcccatgcctatgtcctgaatggtattgcctagattttctttcagggtttttctagttttgggttttacatttaagtctttaatccatcttgagttaatttttgtgtaaggtgtaaagaaggggtccagtttcaattttctgcatatggctagccagttttcccagcaccatttattaaatagcgtttcctttccccattgcttgtttttgtcaggtttgttgaagatcacatggttgtagatgtgaggtcttatttctgagttttctattctgttctgttggtctatatgcttgtttttctaccagtaccatgctgttttggttactttagccttatagtatagttttaagtaggatagcctgatgcctccagctttattctttttgcttagcattctcctggctacacaacctcttttttggatccatatgaattttcaaatttttttttctaattctgtgataagcttctctttttaaattaatgattaaatgtttgagacatgacagagccttgggtgctgcagggaaaacagtttgagacagagaaaggagaaacaacagtatctctgcgtttctcttgtaaatacctttaataacaatgttcttcaataagttaacacagttgagaacatagagtaactagatcaaatagttccaagacttcagtgccataagaatgatgccttgaaaataagtctttgttttgtctaagatgtctcaaatttagtggaagtatgccccaagtgccaattttcttattgacatatcatcttcagaaaacatttgcctacacttaaaa

SEQ ID NO: 17892 - DNA, 13761 bp, Homo sapiens
gaagttgtcaatgatatgagctgatttaatatcctattggatatccagtatgtttagtatagtcttaagactatactatagaggtcaggggagttacaatagccctgagacaaatgataaatcaatgttttgaggatcccacatgaatgtgaatcactccatatccactttctaattggagtggaaagaaatgcagtcaccaaatccacagctgcatgctctgtgtccaagggtttattaatctgctctaccagtgatatccagacagcacaaaagctgcaattataactcctacttggccagacctggagtaatctagttcattctttaggcttcatcaggcttcttcagggacaggttgctggattacgtagagacaatagacagccccaacaccatcccacatccttcagctctgtaatggtgatgtgatccccacaatacttgaagtatcttacacaagacccaccctgggacacactatgatttttgatttggccaggatgggggcagtgtcagaggtttccctttggctttcagcacaatgaaagtccttactccacagactagggacccagggtgggggtaactccacttagcagtgcatcagtgtcaattatgcactcagggtataggaagataaccagggctgggtctatggatccagtagttccattgtgggccataatgtgtccaggtttactccctgagctccataagccccactgtgatgagagacatgatagtgctgtgggcatctgagcatcaatgtcagttcacacccagtgtcaataatccccccagttctgcctgtttcctttccccagtgtacaatctcctgagtaaatggctatatggtcctttgccgaaggactgagggaattgtcccagcatatacttccacggggttgcagagtattccgcctagagatatggactcttcctctgtcactgagatctgaatctgcatcttggctgaggtctaggcattgaggatgggatcatgattttgtattgagtcaaacaccttcaccctcctgcttctcaattcttgctttcttatcatagatatcaaccagctgcctgtcctaaccctgggacaccaccctctattatacttccccacattccctgcagcttgagtcctcttggcttctcctccgaggttgccatagtaaccgtgccctctggcttttgcaagtcactgccaccacttggtctttgtctcttcagggccacactctccccagtgatattagaaatgaaactctgggactatctttactaccatcacccccagcctacaaaggacaataccctgacacttcttagtgatgcaggtccctctcaccatcaagttcctgaggctctggtggaaggtgtgtcctctgggccctcttgtagagcatggttttggtaggccttcaccaagcccactcccctcagcttgttattccatcctctacatgttccagggcaactaagacatgtctaccttgttgagagttgggcatgtttttttctagactatgtggatacaccccagcagtgggtttactccacttatcaaagtcctggagtgtttgataaatccatgccctgagaaagtgtcttcaagccaaaggattatattcatccagcctgaaattctggttccttgatcaaacaccctcaaattccaatcccagaagtagtccctgggctcctatggggacgtgctggctagttcctgcaaacctcctgagtgggattcccgcggcatcataggggtgaggattgtgtagcatcttccagcagtgaaagtgggaaccattactagagaagggtgagcctcctctgcatgcccagaagatcctggagggcacgcatcgcataatcctgttccagtttgcagaatctcaggtttccccaccaaagccctgactttcctgtaacaggcctgccttggctgagtgtcaaacatctctggagcactgtggccctcatagtgatgtagagctaacattccttgctatctgcccttttgctacaggagataaagacctgtccatgagacactgccgagggtgtcaaatgtagccagtcatagctgtcaacaatccgcagattctcattatctttttacacagcatcgatgcagctgagaagtaactagccaaagccactgtctttgtaggtttcttccaaccctgtccttattatgcagggcattctatcactgcatgtgccatagcactccctaaccaaggcaacttctcagctcagcactggtgagacccccagctgctcagctgcaccttgtgccatggactttctgtgtctgccaccaacccgggtggcatcctcttggcctgccaggcagtgggaagcttatttcaaattcccatttttgcctgttttcatggatcacccttcatgccacttgtgttagttagggtcccctgagaagcggaccccaatacagtagtaaacatgtaaggatttattaggggaaatacttgtgagagaaattcatgagacagaaaatgctgggaaagccactggaccacaaagcaactctgagcctcagtgatgtagagagtgcaggaaggtcagctggaagcatcctagaccctgtgcaggctaagggaagttcagtaagggtggcagggagccctggagcttcagtcagccttcagaagaggaatgtcctgccttagtttctgccctactttcctcaatcattggctggaaaaagccaggggtgggcatagtctcagagcaaatgtggcaatagatttcagacttcaagagctggggccatcatcaattctgcttcttctagatgaggggctgggatgtgcattctcatgactgccacaatgatccagtggggagagaggaaaaaggttgacgataaagataaaaatggtattaattgatgaactgacacctttaagtagatgataagggatggcaattggggcaccagaagagggtctggctctggctgggagcagaagggttaacccacaacagtccctcacatggtaaaacgcctgacatgtggtgcagctgcaaatgcatgagcagacagtggtggaatctgtgaagttgtcttctaatgtgttcagttttctcagtgaagtgggaagcaaggtcatcagctgaagtaagaatggggaaggcaggttggatgtgtgagcacaaagaaaaagtgtgtaagagtcacccaggccaggaggaggctgagggtgagccatgcagggagagggtgattgctggccatggtagggacttcctatgtggtttggaatcctaaattttaagagaccagtcagcgtactgtgtgctgctctccagcctcctgcagctcatgggggcaggctcagcataggcagaggtggaacccaccagctgtgtagttttgccaggtgagtgtgacaattcaagggagagggaagggagggatggaaattatttaccatagaattcaaaatgggtgaggagggaggacaggacacccagggtgagggacagtgagtagatggcaggatcactggattgggaatcccaggagggtggaacgattgttggaattgatgtactacagggtagactccaagcgtggaaagcaagcacatatgcaatgagtggtccactgatattacatcacagcatatgataaaatgatagtatctgtgtcctcagagcctgtggccaccttgcaaggggatgagtggaaagatggtcagagagtgggaagtgtgagatagagagtatggaagggctggggttcttagccatgatgaggcctaggggataacaagggcatgagattcaggcagacaggagaagatcatggaggagaggagttccaggatctgagaggccaggaagcgagggcatcttctctgctgtgtgggtgtctattgctgccataaaaattaccacaaaccaaatggctttaaacagcacctatgtatcatggcacagtcgtgtggattgcaagtccacccagtctcatggggctaagatcaacatacgggaaggtctgcattcctttccatagactctggggaagaatccacttccaagctcattcaggttcttgcctgaattcacttccttgcagatagaaaagaggtttccacttccttgttaagagccacccttagctcctagagccttctctcagatactcacacacggtgcctaaggcacattcaatcctcctgcttggaacttctgacctcccctctccagcttctcctctgccttcctcctctgcagaatctgactccaaccagggcaggctctctgcttttaatggctcttgtgatttgattgggcccacacagagagtccagcagaatctccctattttaaggtccttaatcttcattacatgagtaatatcccttttgccacgcaatgcaacctgttcacaggttccaacgattaagactggacatctttggggaccattactcagcccaccacatctgcgtatgttgaagtcaccaagagtcaaggagacagcaatgctggagagggtgacagtgaaccaggagctacaagactcaggattgagaagaacagcctggggcccacagggaatggttacagtgaggcaaatggggctctaatctgatgacagcctaggggttttagggaggagggaggcagaaagttctgagaaccacaatgaggagcaaggaccccacctcacctctgaacccaggggtacaagtccctggggaaactcccccatgtgggaggacttcggagggggtcatgtcctcagggagacccaggttgctgctggagctgcgagatgcaggaacatcctgagagaggctgaggaggttttgctgatgtggactgagaaatccagggggtgcactgggaagatttctgtggctggggaggtcggggagacagaatagaggtgtgcagagccttgtggggatgcaagtgcagagtatgtgggggacccagtgtgactgacacaaacagggacagagcatgatgagctcagtccaggtgcactccaggccgacgatggtgctgagcctgtgggagatgcgggaggaggagcaggggtggctttcacctgggctctgtccatggaggtgaggacagtgaggtggttgggtcttagtgctgtggggaacttttcttgacctcctgatgactggatggagtgtctgagggaggaagggtcttacaggattgactcatgaccctgagggatgtgctcactccaggtctcaggtctgtcctgacacctttatttgtggcttagagctccctactgtaaattattgggagttagttcattttggagtttataacttaaagcagaaattcagatggttgaaatgtcattttcatgaaggtttgttattagtgtatcatttagattgttttgcaaaagtctcattttttttctaaagggttgccaatcttgttttaaatttacaaaggttgttaatttatcttcactgttaattggttgtgggttgtttaaacttatactgtgtagttttacatatctgtaacagcagtagtttgggcctcttatattctaataattaagactttcagctgagtacacactgtaattcaagcacgagtcatgcataaccctagcactaagagacaagaggggaatccctctctctgaaaattttgcaaaattctgggttctttttccactgagtgggcacaagtcggctaatcatgaacatgaggtatttgtcctcatttaaaggtgcttcagaagcactgacccctaggaaggcctccttgtctgggtcaggcaccctacaccatggcagaggccatcttccctcccagtgtacagtgatatcccagatagcttactggttagctgctgtccactcttgggcagttttgtcttctaaaacatgggtttttatctgagaatcttcctgttcccagatgatcaaaactggggccatccattccattctgagccacttctgcccaggggcccatkgctatttcctccagtcacaacagaacaccccttcagaacagcctgcaggaaggcmccgtctcctcacaggctcacacatgcacggtgtgtgcacagagcttttgctctagttcaggaggtgtgtrgggagcctcactagtccaacagagcytggtaccagtgtcatatgccaggaaccaaggttataagggatacmatgtccccagacctaccagagaargcaaactcatacagcttgcaggaccagacaaggacaagaaacaagttcaaaagagggaaagggaaaytacagacrtacctcagagatactgcagatttggtttcagaccatggyaacaaacaagyyacacaaatttttgtttttccagtacatataaaagttatattcacactctactgtagcctaktaagtrtacaatagcattatgtatgaaagaactatgtacataccttaatttaaaattactctattgctaaaaaatgctaacggtcgtctgaggcttcagctaattttaatctttttgctggrsagggtcttgcctcaatgttgatgactrccrgctgttcaagagggtggttgctaaaggctgctgtggcaatttcttaaaataagacaatgaagtttatggcatggattataaagggggaatcagtacttaagtaaggtcaatatgagttttcaagtcaggtggacttgaatatgaaccctccaggcctttccaccaactagctatarakccttgggcacatctggcccagagctggccccgacrgacacttkcccagtgggtgagtgctcaatgaacccatctgagccaattgtctcatccaaccagtgatataattccttccttgcagaagaataagtgagaaaagacacagtgccaagaaattcagacacaagacctgcggaagtctgygccagtgctctaaagcaagttctgcctaaagcggcagaaacatttttcacattaggaacaggagttgtttgggatcctgtctggggccaggttgagagcagagtgggagtgggggcctgggcaggaccaggcactggagtgaagacaggcctggagagagctgactcctggaggctgctgagcggctcagacagctccttgcctcacctgccacagtcctccctctcccctggcctccaagtacccgggagtgcgagcctgggccccgggaaccggcaccttgagrgcdggagagggaccccgcccgctccctgtctccctgacgcgctctctccgcctccccgcgggdacccagcctcccgggctccctcctgcctaccgcccggccctggagccgcttacctgggagcttcttacggtgtagggggagctggggaggggacagagggacagggaccacgggagggtggcgtggggcggcgtacttggagatatgacctgaggagtctgcagacccbagaccggggcagaagmgccgtgggaggagctgctgagctctccaggccgccctttacctcctgcctccccagcccagttcatcttgatcctctcctcactagcccagktctccccaaggtcagggctcatagagcagcaggagttgggttccgggacgcgggatccggcttctctgggaatcttggattccaggaaggatcctggagatctcccactttatgaagcccaatctccastcactstgatggcgtctttagaccccactggaaaccagatacgacgccctcatcggccctggggaaaaaacaagagcaaagtatgagaggtggccatgaggtcagggaaactcctgcagaattctcaggaaaggaaactcttccgagctgggcccttggcttagtttgtcttccctgcccagccacctgtcccagagctggagacgcccaggtttaagccagagactttggatactttccttgatggtgacataatttttgtcttcttctctcctggaagagaagccccagaaccatcagagtgatccagtctgcccactcttcttattattctgtctctccaatcactctccctgagctggactctccacccaccctcacattctggatagtgcagagatgtgagcatggccctggggcaggattgtctgcgtgcaagcccagctccaccacgacttgtaggcgaccttctttcctattgtatcacctgaaaacggaaaattagcaggcacaccccatagttgtatagtgacaattaaatgaattcatattttgaaagtgctaaggacacagattaacacatagcaccatgacagtgtatgatattatcgctgttggttttttttttttttttttttagatggagttttgctctcgttgcccatgctggagtgcagtggcaccatctcggctcactgcaacctccacctcctgagttcaagcgattctcctgcctcagcctccagagtagctgagattacaggcgcccgctactacgcccagctaattttttgtatttttagtagaaacggagtttccccatgttgggcagtctggtcttgaactcctgacctcaggtgatccaccctcttcggcctcccaaagtgctgggattacaggtgtgagccaccatgccccgccgttgttgctatttctttcatcctttttgcttgagcctcttctcttctttctaggttcccagggaaattctctgttggaagattatgcctgcaagaggcctccacctgggaaatgctggcccatggggggatctcccttttattaaatggaatgattgttggtgaagtgacagctagtgagccagtgacagtacggttcatgtaaaaaagaccacatacctaggattacctccattttaataaagacacatcccacacattataagtccaatgtgatttgtgaggagattgctttgatttgctcacgaaaaatattactctactttctttgagagagttttgcaacacatttcaaatctctgcttctcatttcacactatctggctcatgagtgaaggtgataagtgtcgtactatgctctcaggtttgtctgtcagagtcatagtcatgtattacacataaagattattttcttgttatcatttatttatatatattatactcatgggatatagatagatattattacagtgcttaaatggctactactgatatctatacattttctctcttggtatatgatattaacacatagaattgtatactgttactttggtttccagcaattgctgattaggtcatttggaccacttctcccattgagtacaactggaaaaatgggaggaaaatacatatttgaaaagtctggttgaatttatagatgggctagcaaagcagtgaagatttgcttggccaggaaccaggaagaggcagaaatccagaagagcatcttgagctatggggctgcttttttggatcagatgcagtgacacctgcctcccaggcaagaagccaacttctgggattcagaactaaagtgtcccaatatttagaaggtctcttggtctctctagagttcagtgctcattggccagggctatgatactcacactcattccttggaggagccaagcttcgggtttggctgcctctgggacatttcatgctagaaaaaccccaacatgtgtagataaatggtatagaggacaccagccacccttcgatggagctctgcccagtagtgtcccctcacttccactcagagacaacatgcccatttcactaaattcatgaggacatggccaacataagtaagagaacaccgggaggtaccttggacagagttccatgcagtcacagcttttgcgtctctgtgtcttttcccttcatctcaaccagagagcatttgccgaggccgaagaacaaaaaacttcaaatattggagcggaatctaagaccactgatccattgtgatcaggaggctggagccatgtggtccaggaataatgaagtctgtgaggccttggtcaccccaaggctctctcccattaggagctgcctctcactgctatcagggaggacccaggagctggacatggctttttttttttttttttttcatttctgatgagaacctggagaggtcccagagcatatagaccttgattgaaatggggccagagtggagtcaggcaaaaaactctaatgactcagaggcacctaagtataaaataaaatctcaactcagagcttccatcagagcatcaggctcagtatctcctgtgtttgcactgtgagtactggagcttgatgagaagaaaaatagctacatgtgcagaaaaacatatgtagttagaaagctgggtcatggttcaaggtaagagggacccttgtcttttccgtggtagatagtggggctttctgccatcttagttctgatggaccaagtgcagaagataaactttcctgctttcagcttagtgactggtaatagaagctggagttaagagaatcagtggcagcctctctctccatgccccagcccagtaaatctaagccaggacttggggctctggcactttcttctcactgtgcgtcctccttctctggctcaaaagagaaccacatgtaacagaaaccaagggctacaattctcatagaacccagaaaactggactaggggcctagagagtcatgtgcctgccattgttccaccgcttacgtgctgtgtgacctcaggagaagctctctgctctttgaatcatctgtgaatcatggacaaacacctccatgctagcaacattactgaaatgcagggaggaacaagtgattcaattgggaggaaaaaaagcaaagtgatgacatttactcctagacaaaactttttaggaaaatgtatcttaaaagtaggagaaaaacatataatacctgcaatcccctgcaaaagaagcctctttagcttactacttgttcatcgtctttctgtgaaatttgggcaaaactagctccctcattatctcaaataaattaatgcagttggcgattctatgtcagtttaggtctacaacttttgctttgtgtgaaactgaaagggaatgggaacatcttcatttttctgtggtggccaggggacactcagaggcttggaaatgaccctatatcatctattttcaattgcctcactctatcttttgaaatctcaggtaattcatactcctaaaaaaatctcatgttcatacataggacaaggtagaaaaggtaatattcctgttttaatttgctagggctgccataacaaagtaccaaaggctgggtgacttaaataataaatatgtgttgtctcacagttccagaggccacaggtgcaaggtcaaggtgctgcagggttgatctcttctgaggcctctttcctttgcttgtagatggccacttcttctgccttctcaacatagggcttcaacatgtggattttggtggcgtaggaacacaattcctcttgtaacagtctggatcgtctttgacaatggatgttctaaaaaataaaagagagtaatagacagtacaaccctttggctgaaatctttctcttggttttctaaaattttggtcttgcaatagaaaaaacaagaaagagaaccaaagtttagttcttcccggaaggtgaggcctcctccctaagtctgtgtaatcccagacactaagacatggtgctgtgcagttctccaaagtcctactcactccagtgattctgtttctgtctttttaactgagcagaagagtctctttcaggagagcaacttcttctgatgctttatgggctttattctccttaaacttatggaatgaaaaagatcttaataaaaaggaaaatatttgccaaatttttatcatgctcataatttttgtacctttttaaatgccccatattgtgttgtttattttttaaattttttaaaattggtacataatatttgtacatatttatgggatacatgtgacattttgatacatgcatagaatgtgtgtatcagtcaagatatttagggtatccatgacctcaagcatttatcatttctttctgttgagaacattttaaattcactcttttttgttttgttttgttttttgagatggagtctcacaccatcacccagactggagtgcagtggcacgatctcggctcactgcaagcttcgcctcccgggttcacaccattctcctgcctcagcctcccgagtagctgggactacaggcacccaccaccacgcccggctaatttttttttttttttttgtatttttagtagagacggggtttcaccatgttagccaggatggtctcgatctcctgacctcatgatccaccctcctcggcctcccaaagtgctgggatcacaggcatgagccaccacgcccagccaaatccactcttatagctattttgaaatatacatttttgttaactttagtcagtctgctgtgctatcaaacattagaacttattttctctatataattggacatttgcatccattaacctgcatctctatattttcccacccctacattcttcccagtttctgggaactgtcattctactctctctacctccctaagattaacctttttggctcgcacatattagtgacaacatgtggtatttgtctttccttgcttggcttatttcacctaacgtaatgacctttggttacatccatgtttctgcaactgacaggatttcattcttttttatggctgaattgcattccattgtgtatatatataccaccatttattcattcacccattgatgaattcacccattgatttcataacttcgctactgtgaatagtgcttcaataaacctgggggtgcaggtagtcttttgatatattgatttcttttcctttatataaatacccatgagtggagttgttggatccaatagtagttctattttttgttttttgagaaatcattatactgatttccataattgctgtacttactttcccaagagtgtacaacagttcccatttctccacatgctcaccactatccattattttttatttcctattagtagccattctaaataggataagatgatatttcattatagttttgatttgcattttcctgatatttaataaggttgagtgtttttcgtatacctgttgaccatttgtatgtctccttttgagaaacatctattcagacactttgtccattttttaattggattatttgtgtttttactgctgagttttttaagttccttgtatattctagatgttagttccttgctggatgaatacatagcaaatattttctctattcaacaggttgcctcttcattctgttgattgtttcatttgctgtgctgaagctatttagtttaatatagtcccacttgtctattttatttttgttgcctgtgcttttgaggtcttagccataaagtctttgcctagacccatgtctggagtgtttcctgtaagcattcttctagtagttttatagttttgggacttacatttaaatctttaatccattttgagttgatttctgtatatggtgagagacggttctagtggtattcttctgcatctggtagcattttcccagctccatttattctccattgttgcttttgttctttctccattgtatattctcagttcctttaccaaaaatgagttggctatcaatgcatggatttattgtgagttctcttttgtattccattagtctatgtgtctgtttttatgctagcaccatgctgatttggttactataactttatattgtatcctgaattc

SEQ ID NO: 17893 - DNA, 13701 bp, Homo sapiens
ttactctctcatttctattcagataccaccttgacagcggagctgtcccagactacccttgtgtaaagcagtatttccacacccctcccctggactacctgtcctccttacactataataattttctcccataacacctattatcatttctataatagacacattatctatctattgtagtttttgtgtcacccaattaaatgtaaactccttgacagtaaagacttagtttcattcactgatacagccctagacctagaccaacacctgttgtatatactagacactcaaaaaatatgtgttgaatgtatgaatggttatagtatgtaaaaaaatcccacaaaggatttacacagaattgtaaataataactgtattaggttaagaaccttggaaaataaagaacaaggtcatatagagcgggtatgtggaggatttttagttccatggaaaagtcgccccagtcagcagtgagggaggaagttgaatagttggttctcggacatgagataagagaatgaaaaccgaattatgtttcggccgtaagactaccagatctccagtaagtcaagaacactggaagctggccaaaaaggtgggtaaagggccccacacaatgggacttcccgggcatgtcctggttactgtagaagtgtctcctcctcaaggcaatgttataacgacaagtgagggaaatagtcaacaagggctgcaaagcacgttggtctaattagtgcccccttgcctagagatctggggagaagtctgaggagggagtatccaaagatgacataacctgagtgcagattttcaattgtaagtgaaaagtgagctgagcctgtgctcaaggacttcctgcgtgctgagcacccatgctgagcactctctctcactagcttgctgattggggtttgggtttataaatttcatgttttactcaccaacactaactcattttatacttcaatcgaaacagaatgtgtgagtccaggcgcggtggctcatgcctataatcccagcactttgggaggcagaggcaggcagatggcttgagctcaggcgttgtagaccagcctgggcaatgcagcgaaacaccatcttcaccaaaaatacaaaaatattagccaggtatggtggcatgtgcctgtagtaccagctactctggaggctaaggtaggaggattgcttgagcccaggaagatgagggtgcagtgagccaagatcgcgccactgcactccacccagactctgtctcaaaaaaaaaaaaaaagtgggttttttttttctggaaggaaatagaacatattctctaatattctctaagtggtttgtgtgctttggcacacaaaagaatgaaatgacgatggcctttctcactggttggtttgctgttcccgcagttagaagagactgcccacatagggagagtggcacagaggagagtaacatcaatcaacagcgaatatgcacttgatcgcggtctaatcagcaccaggcacctcagggcagcagtattgtcagacgcattggaaccagagggactccatcttgaataaggtctgggtaaaatgaggctaacacctactgggctgcattcccaggaggttaagcattcttagtcacaggacaagataggtcagcaggacaagatagaggtcataaagaccctgctgataaaacaatgccataaagaaggcagccaaaacctgccaaaaccaaggtggtgatgaaagtgacctctagttgtcctcactgctcactatacgctaattataatgcattagcatactcaaagacactcccagcagcaccacgacagtttacaaacgccatggcaacattaggaagttaccctatatggtctaaaaggggaggaaccctcagttagggtaaatccctgcccttttcctggaaaactcatgaatgatccaccccttgtttaacatataatcaagaaataactatacgtgtactcagttgaacatcccgtgccactgctctgcctatggagtagccattcttttattcttttacttctctaataaacttgctttcactttactttatgaactcgccccaaattctttcttgtgcaggatccagaaccttctcttggggtctggattgggacccctttcctgtaacagtattagtcataactattatctgaaaaagtatatttatatggtactttacaaattcaattttgcacaatagactctgacttatgtcattctcacaatcaccccataatgtcaatcctcccatttcacaataaagaaattgaggctcaggctggagacggtggcccacacttataatcccagcactttgggaggctgaggcaatgggatcatttgaggatcggagtttgaaaccagcatgggcaacatggtgagattccagttctacaaaaaaaaaaaatgtttttggccgggcgcggtggctcacacctgtaatcccagcactttgggaggccgaggcgggtggatcacgaggtcaggagatcgagaccatcctggctaacatggtgaaaccccgtctctactaaaaatacagaaaactagccgggcatggtggcgggcacctgtagtcccagctacgcaggaggctgaggtaggagaatggcatgaacccgggacgcggagcttgcagtgagccaagattgcaccaccacactccagcctgggcaacagagcgagactccatctcaaaaaaaaaaaattgtttttaattagttgggcttggtggggcgattctagtcccaggtacaagggacactgaggcaggaggattgcttgagcccaggagtttggggctgctgcagtgagccgagatcacaccattgcactttagcctgagtgacagaatgagaccctgtctcaaaaaaaaaaaaaagaaaagaagaagaagaagaagaaattgaggctcaaggaggttagggtgaattgctcaaagccattctgatgtgaccgacacctagagtgaacatatgtcctgatgtgtccaggacagcctcagtttatgcctgcctattgtcctggtgtaattattaatagcaccttttcactccccggagtatcctggttggatagtaaattatatggtcactctaccaaaacctgtttctttcattcacttaaatccaatcttttatttcattactgccttatttcctccacttaggcagcttcaggatgattataacagctgaaaaggctggcttcagaccatggtatcacttctatgagagaggacatttcaagttgcaaacaaacaattcaaccagtgacttttaaatttgaaaactaccagtatagtacggcagtgaagagatcagggtctgaatctccattagcatagacattattcaaaatgtcaggcctgagaaggagctaaaaaacggcctgtcttgggggaagaaacggcaagaattttatcgaacttcagctggagtgggagaggggactgtcagccagaatgcggctagtttggggaagagttggtcaaagagattcttgaaagagggaggaattgttgttgcagatgagcagccactgtttgggcactttggattgatcagcctggacaggaggaacagttaggggctaagatcctgcacaggaagaggtggaaggaacaactacaggcaaaggggacctgcaggggaaaatgttccatgtggaaaatgctaggacttcagggtctcttaggttagttaactcttctgagcctcattttcctcatctgtaaaatgaggatgttaacagtttaaggttgattctgaggatggaatgtactcagtacataagtgttcagcaaacagtagtagctcttattgtttgagtctcttccccgccttgtgcccctagtgtagtagtaagggtacggattttcttttttttgtttgtttttgtttttgtttttggaggagtctcgctcagtcgcccaggctgaagtgcagtggcgcgatctccgctcactgcaagctccgcctcccgggttcacgtcattctcctgcctcagcctcccgagtagctgggaccacaggcgcctgctaccatgcccacctatttttttttgtatttttagtagagacggcgtttcaccgtgttagccaggatggtctccatctcctgacctcgtgatccgcccgcctcggcctcccaaagtgctgggattacaggcgtgagccaccgcccggctgggtacggattttctttacgctgtatataaaagtctgagaaactatcaattgtttataataaagaatgaaaactccaaaggcatctggggtgaggttgagggtctgcacagagattatgggggaaggggacgtccaaagctgtcattggattcaggcactcaacagattggaacacagtgtagagatttatggtagtgtgaaggtgctttatttgttatgaattactcagagattttactatattttaacctggggcggggaacccttcctttttttgcccttttgaaaataaggtagatttcttcagatgtggaaagtatcaatggtcaatccaatagcttttcgttattttatttttttatttttggaggcaaagtctcactctgttaccctggctggagtgcagtagtgcaatctgggctcattgcaacatttgcctcctaggttcaagcaagtctcctgcctcagcctcccgagtagctgggactacaggcgtatgccaccacgcttggctaatttttgtatttttagtagagacaggttttgccatgttggccaggctcgtctcaaactcctgacctcgtgatccacctgcctcggcctcccagtgctaccattacaggcggagccaccacacctggctcactttgtggcatatttctagaagttaaaaaactcacctgacaaaagagatactttgtggccaggcacggtggctcactcctgtaatcccagcactttgggaggctgaagtgggtggatcacttcacgtcaggagttcgagaccagcctggcgaaaatggtaaaacccccgtctctactaaaaatacaaaaattagccaggtgtggtggcaggcacctgtaatcccagctacttgggaggctgagacaggagaattgcttgaacctgggaggtggaggtttcagcgagacgagatcgtgccattgcactccagcctgggtgaggacagtgaaactccatctccaaaaaaacaaaaaaaaaaaaaaaaaaagagagagagagagaaactttatgatttactccatggaacaaatatcatatagaactgtaacatttaaaagtcagatttctgtttctaaactttaggtttatacctcttggcagatgactagatgattctttccccattccaagagtaacagatattcagccaacttgtgtgtgtgtttatcacatgtgattccacatttcagtttgtttctctatattttttgtattttaaattggacaagtattacttttataataagaaaaaagataattactaaaaataaatgagaaatacatatacatgtagaatttgcatagtgtcaagtaaatgataagggtagaaagagtgcagagaaaaaaaggatgaaaacgaaggtggctgaagaatgctttgtgacggaggtgggattgaaatgagctttgaaaggccgggtgcagtggctcacacctgtaatcccagtaatttgggaggctgcggcgggcggatcacctgaggtcaggagtttgagaccagcctggccaacatggtgaaactccgtctctactaaaaatacaaaaattaaccaggtgtggtggcaggcgcctgtaatcccagctactctggaggctgaggcaggagaatcgctcgaacctgggaggtggaggttgtagtgaaccgaaatcacgccactgcactccagcctgggcaacaaagcgagactccgtctcaaaaaacaaaacaacaacaaaaaacgaaacaccgaaatgggctttgaagaatggaagggatgcagataaaagagaggagggcgcagagcggtttggtcgttcgttggaccagtgtcggttcttcgctcgcgactgcggctcttcctcgggcagcggaagcagcgcggaggtcggagaagtggcctaaaacttcggcgttgggtgaaagaaaatggcccgaaccaagcagactgctcgtaaatccaccrgtgggaaagccccccgcaaacagctggccacgaaagctgccaggaaaagcaccccctctacctrcggggtgaagcctcmtcgctacaggcctgggaccgtggcgcttcgagagattcgtcgttatcagaagtcgaccgagctgctcatccggaagctgcccttccagaggttggtgagggagatcgcgcaggatttcaacactgacctgaggtttcagagcgcagccgtcggtgcgctgcaggaggctagcgaagcgtacctggtgggtctgttggaagatactaacctgtgtgccatccacgctaagagagtcaccatcatgcccaaagacatccagttggctcgccggatacggggagagagagcttaagkgaaggcagtttttatggcattttgtagtaaattctgtaaaatactttggtttaattggtgactttttttgtaagaaattgtttatatgttgcatttgtacttaagtcattccatctttcactcaggatgaatgcgaaaagtgactgtttacagacctcagtgatgtcagcactgttgctcaggagtgacaagttgttaatatgcaaaacggatgcrtgatatttcttgcttctcatgatgcatgtttctgtatgttaatgacttgttgggtagctattaaggtactagaattgataaatgtgtacaacagggtccttttgcaataaaactggttatgacttgatccaagtgtttaacarttggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgttttacattcacaagtggtggggagtcttgtcattaaggtgtgtgtaatttagagtccagttggttttcttctgactgcacttgttctcatagtagtaaaatgctatgtgcatttataccttgcataaatcctcattctaccacatgttaactaaccctctagctgataatggaaacactaactgggggattttatttataagggctctagaaaaaaatatgagttattcacaccagcatcatctgttaactaatattctgaactagtgcagcttttcattgtgttgtgtggttggtctcataactaggttgagttttctcctctgctaagaggaaacagtactgaagttctttttcttgtggcatttgtattataaaaacttggtgtaggggaggagcacaaagctctagcccactgaacctctgcyggttaagatggtgttaggttaggttacatctggttactgtcctgggaaaatcatttttatagagatggccttccaagtggttttaaaatttatcttattgaagtttttaggtcaattatgtatgttgactaaatttacaaataaacttgtttatccaaaaaaaaaaaaagagaggaaaagaatcagaaatattggagagtagaaatgcaacagaagagaactataaagtttatgttgggggaaaacaattagtttgtctcaagtgtagtatttacgcaaaggagaaaactttagggatgtagggcccacattgtaaagagcttggaattaggatttaaggaattttatactctatcctgcaaaattcacagacaaatttgagaactgactagcattttaacttgcaaaaaaagacaagttagtacagaactagcacatctaatttttaaaaaagtatttgaactataacatggtgaaatcccgtctctattaaaaatacaaaaattagctggatgtggtggtgggcgcctgtaatcccagctactgtcaaggctgaggcaggagaattgcctgaacccaggaagtggaggttgcagtgagccgaaatcgcaccattgcactccagcctgggtgtcaagagcaagactgtctaaaaaaaaaaaaaatcacaaagtcaggagatagctcagattgttatatattagtcaacaattctgattggataactttggggtcagtcttgataaaaagaaaaacagtatgtttctgtcttttgcataaaaaataacttcacggcttatcttggaattcaaagcttttgaaatatttctggttttcgtggcttatcttagagtgcaaagcttttaggaatgtcagccttttccagactatggtacaggatgggcttgattagtcgatatagtgggcatgatattcgttttacagactagagttcacactaaatggccataggctcccatagggccaccaggtagagttgtgcagattgtataggctgtgcactgcacaactttttatgttatgtgcacagtgccctctggagttataaaatgcaaagtcggctggacgtggtggctctcgcctgcaatcccagcactttgggaggccgaggcaggcagatcacaaggtcaggagttcgagaccagcctggccaacatggtgaaaccccatctctactaaaatacaaaaattagctgggcgtggtggcatgcgcctgtcatcccagctactcaggaggctgaggcaggagaatcgtttgaacccaggaggtggaggttgcagtgagccgagatcgtgccattgcactccagcctgggagacagagcaagactctgtctcagaaaaaaaaaaaaaaaaaaaagcaaagtctactcagccatacctggaagcctagacgccaggcaggtaacacaaatcagtgaaacctggggccctttgaaaggattccagcaaatttaaaaataatggtcagagcactgtggagttgtagaaaaacaaatttgcagactatgttcagccttggagctcaagtttgggacctctgccatataaggtagaggcagtcaatatttttgtcaaggtaatgatgcaaagagatatgtaaaatagattaccatagagaaaagaggctacaaagaaataaaaaagtcagaaaagtacttcaataatctgggctgaggaaacaggggcctggccgggccagaactatgtggatagacatagaaagaaaagaattagtagaatttagtgatcagattcaggtttgattctgaaccaaatcaattcagacttgatttctcataagacaaaaaaaaaaaaaaaagaaagggagaccagagtaatgcaaggttttgaacttgggtccttaggaaaatacctggaagaaaaatatttaccttggaaataatttcagattaaaaaataatcttttgaccgggtgtggtggctcacgcctgtaatcccggcactttgggaggccgaggcaggcagatcatgaggtcaggagatggagaccatcctggctaacatggtgaaaccccgtctctaccaaaaacacaaaaaatcagctgggcgtggtggcggatgcctgtagtcccagctactcgggaggccaaggcagtagaatggtgtgaactcacgaggcggagcttgtagtgagccaagatcgcaccactgcactccagcctggtcaacagagtgagactcagtctcaaaaaaaaaaaaaaaaaaaaaaacttttaggataggatagtaaaaatcatgttttgaaagcttatgtaatgctggccgggcacggtggctcacgcatgttgggaggctgaggcaggcggatcacttgaggtcaggagttcgagaccaacctggccaacatggcgaaaccttatctctactaaaaatacaaaaattagccaggcttggtagtgggcgcctgtaatcctagctactggggaggctgaggcaggagaatcacttgaacctgggaggcagaggctgcagtgagcagagatcgagccactacactccagcctgggcaataaagtgagacaccatcttaaaaaaaaagaaaaaagcgctgggagcagtggctcacctctgtaatcccagcactttgggaggccgaggtgggcggatcatgaggtcaggagatcgggaccatcctggctaacacagtgaaatcccatctctactaaaaatacaaaaaattagccggatgtggtggcgggcacctgtagtcccagctactcgggaggctgaggcgggagaatggcgtgaacccaggcggcggagcttgcagtgagccgagattgtgccactgcactccagactgggtgacagagtgagactctgtctcaaaaaaaaaaaaagaaaagaaaaaagcttatgtaatgctatggcactgctcataataaaaaaaatgtgagaaaaaagcagacaagaggaagacaaaaattggaaaaaaaactatgcaaaaacattaacaaaatgttatcctcagcaatgtgattgtaagttataaaaattttcttccttatacttgtactatgtttccaaactttctacaatgaatgttatatttaaaaatagaaaaaaatacttttaaagatcctagaggcttcccttttacagaaaccataaattcaaccttcattattttgtttttgtggtaaccatttgtgacagtaagtgctaacaggcttggctttttggttttggaaaaattggtccttgtgtactaaatagaaagtccttgtaatctcgaggagataaagatttaatgttgcctagtgatacagatttgttttaggcattattttcttattcaaaaactaacttcaattgttttaatgatttttagaaaagatggttttcctttttttttttttttgagatggagtctcgctctgtcgcccaggctggagtgcagtggcgtgatcttggctcactgcaacctccaccccccgggttcaagcaattctgtgcctcagcctcccaagtagctgggattacaggcacctgccaccatgcccagctaatttttgtatttttagtagagatggggtttcaccatctctgccaggctggtcttgaacttctgatctcgtgatctaccctcctcggcttcccaagacgctgggattacaggtgtgagccactgcgcccggcctctttttttggaattagctgttagcccttcccaagttgtattcatagcttaaagcctatctaagcttttgccaagaacataaagatttaagcaaaacggaatgataacagtattattctgtttaaggccgggcatggtggctcacatctgtaatcccagcactttaggaggctgaggtgattggatcatctgaggtcaggagttccagatcagcctagccaacatggtgaaatcccatctctactaaaatataaaaattagctgggtgtggtggtgcatgcctgtaatcccagctactcgggaggctgaggcgggagaatggcgtgaacccaggcggcggaggctgagacatgagaatcacttgaaaaggaggcagaggttgcagtgagccaagatcgcgccactgcactccagcttgggtgagagtgagactctgtctcaaaaaagaaaaaaaaaaagaaaagaaaaaagaaaaaattctgcttatagcagtgtaaagttttaaaagatggcttcacataggcctggcacagtggctcatgcctataatcccagcactttgggaggctgaggcgagtggatcacctgaggtcaggagttcgagaccaggctgaccaacatggtgaaaccctgcatctactaaaaatacaaaattagctggacatgatggcgcatgcctgtaatcccagatattcgggaggctgaggcagaagaattgcttgaaccagggaggtggaggttgcagtaagccaagatcgtgccattgcactccagcctggacaagagtgaaactccatctaaaaaaaaaaaatggcttcacatatatttgatgccaggctcatttgacctttaagaagaaaaacaggatgtaattacagcagatttttttcagctctattttgtggagaagacattaaggctcacagaggtaaagtctcttgctcagtatcacagagttatcaaatggtaaagcaagaatttaaatcaaggtctttcaagtagtacaatttttcttacacacgattaattgaaaaccatgaggactgtccttggcccacaggattggatctccttgctgtgctgacagctggatctgttcatcaactcaccacctttgtccagccccatgacctggtcaaacctcaggctatcaatgtggtacagcggctccagtacccagtaaaacccaaaatacaacaaaggagaacagaaggtagctaacaactctaatttctttaacgcgcatttggtattttaaactttgcaccatggtttccacacaagtccttcttcaaaagaatacaagagtcaaagtctgagataaataatgaaaattatagaaaattttacaagtttgatgtaatagttcacattccaccagcagaataattttttctgtgtgaaaatcttgtacttatcataaatggttaaattacgggagcacagttcctgataacctgaagcagaacttgaagaattagcttcagttccacatggttacaggctcaaaattagttttcccttcatacttcttttatattatcctatttggcagttatgctcacttgctgcaggaatttctcattgttctgtgatcaggggtattcatttgttttaactcatgctatacagttcgtcatgcacacatgatttttactttgaatataattttggctggatacattctcacactgttcttcacacatgcttgggttttttgtatgtatcattttcttctgacaagatgattaacttctcatgtatactgtttgggtatttgtttatacttttatgctattacccatacttctttgctcagtaaacccttcttactagataacttggatatactagcaaatagctcatttatcaccctactaatcactttaaaagcaacattgctttctataaagttaatactaatgtcacatacaataaatatttatcaaatgaatgattaaatggatatcagctaagaaaataggtattatagccaactttgaggatgttacaaaaagtaggaaattctaattttatatatgtatttatatataaatatatacattcatgtaaacatatatttatttaaagacatatatttaaataaatatatgtattttggagagagggaattttgctatgttgcccaggctagtcttgaactcctggcctcaagcaatccttccacctcagcctccctaagtgctgggatgttaggcgtgagccactacatccagcctaaaatattttttgatgagcaataaaaatggcttaagtctagttgtaacttagaatttgaaatattttaagataccaagcctaagcaataaagggtaaacttgaagaacaagattttacaaaaatgaccctacatggtaacttctcagaggaagcagtctaccttcctgttcaaagccaatccctcctgtattatctatttctatataacaaattacccagacttcacagcttaaaacaacaa

SEQ ID NO: 17894 - DNA, 28789 bp, Homo sapiens
agtaaatatctcccattcagggaggcccaggtcgtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgctttaccccggggaatgcaggtcggggcagtagggaagcccctagggatgcagggaggcgggcgctgaggagtggagggtcgcctgagaggaggaggcgagagcgggagcgcggggtacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagcgaggcctctcatcttcctttcttagcctagtggttaatccctggatctctcagatcattgctccttactcttgtcctatgtggtccatcttagtgctaatagtatatttcacaaaacagctttttggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatcctacaaaataattcctttccaatgcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgttcccccaccatgttccctatggatgacagatctgtttcccatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtctcatatttgaacccccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctggccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctggtctcgaacccctgacctcaggcgatccgcccgcctcggcctcccaaagtgctgtgattacaggcgtgagccaccgcgccggaccagaaagaaggcacttcttaatagtaggctcagagcttgaagtagtaactttgagaaaattcagtgattctccaattacaaagcattctccaattacaaagcaaggacaacagataaagttgcccttgagacaactgtattttacttaatgataaagaaacatttttgcagttttatatcccagagtaaccgccactaaaggcgagtgagactcattgcaggcctgtacagtgcgaaccagagttcgggctccagttccgctgtctgcgggtctcgcgcgccccctcccggcggcccagcccagaatgaaggccttggctggggaagcgaaagcgaaagctgcccgagccctgacgcccgccctggccgagcgtagctggcggaccagagccggtagcgaggttgggagagacggagcggacctcagcgctgaagcagaagyccccggagctgcggtctccccgccgcggctggtgagttggtgcggaggggaacctggagcgccaacagggacgcagcccaagtgactacccactccacgctcctgcttcccagtccctctgcacccggcgataggagggagcggagcccggaccacttagctcgccgcggcaggcgggggtgggggtgggggtccggggattttttttttttttttttttaagcacgaggctcctgatggtcatgcttccagctccccagaaggccgaaagctgtctgtcgtaggaggggtgtacggatgagcaccggttactcaggagagctctcagggttgaataggatraaatgagaagccgatggacgggttaggcggagccgggcgggtaggagggcagggacaaggattgggactccacccccatgatttctcatctcgtatccgttgacagagccatgyggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctragagggctgctgggatttgtggggacactgctgctcccgctctgtctggccaccccmctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagtcaggagaggacgttgtgagttggaggtggtaaaagggcmtgsgcaccagcacattcttgtgttatttttcatkcctctttcaggtgagacattaatccctcactattctggtcgtgtgattgacatcctgggaggtgattttgacccccatgcctttgccagtgccatcttcttcatgtgcctcttctcctttggcaggtaggtrrtgggcagctgggtccatttgctagccccaaatctttataggggtcttcacttccctaactccatttctaggccctttcaggcgcaaaacacaaaaatacttaaactaaaatatggtgaatgtagtcaccattctgtttcatctatccattcatttcttccttcgttcatattcatccaatatcttcaaagtttatctgatcttattataggaacaagttatgagtgaaggtagtacaaaaggaatttaagtctcagatggaatgtctctcagttgtctctcaacattcctaggtccatgaaattccatttctttctgcctcctacctcctacccctaagtctgtctccaaagtatctctccagggtcactcyctcaggatgggtatgcttctccctytcactcttctttcccagctcatcttgcyartccctgaagatcttactctgaggcttatcacctttctttccagaatcattactcttttcccttcacttgctttcctttctytttctagacatactcaaacaaacaaactgtttgataaggctgggactgggatgaggtgagcgaggcacctggggtgcaaagtttaaggaggtgtgcactcaccttacccaaatcccagccggcctgattgtctctatttttatggtcatacttaatttagagtaccctcgaaaaccatttcattgtgccttcattccatcctggctgctttctgctgaaactacagtcgtgcactgcataacgawgtttaggtcaatgatgggccacatataagatggtggacccacaagattataataccatatttttactgtaccttttctatgtttagatacacaaatacttacttctgtgttacagtcgcccacagtgttaggtgcagtyatatgttgtacagatttgtagcctaggagcaataggctaaactacatggcctaggtgtgcagtaggctatgacatctaggtttgtgtaagtacactctatgatgttcatacaacgatgaaaccatctaacgacacatttctcagaacacatccctgtcattaaagtacaaaccctcattatatcatgtctgactattccaaacgcctcttcaatatggtaactaaatttgtattagaaacatatattttgtaaaatacatgcttttatgctttatattttttcctctaagtgttactgtagcatgtagttggtctaagagggattttccaactcgaaggatgamagatgggaatcacatgactctggggctccagagaattgtgggggcagggaatttattattgcagttcccatgatgaagtatctatgatgacagagaagggctttgggtatggggcaggaaggagaccaaggcggaggagacgcacagagggacaagcctgagggacgctgggacagaagcaagcactgggatacttgttttcacaatatcttttcccttctattgtagtyttctattgtgtctagtacagagtgcactccataaatacttgtaaatttgtacatgttatgattttgttctcacatctagctcaccatgtctcctctttcttcttcctctgtgtattccttacctcttctctctctgtgtgtctgtctctcatttctttctcttttgcccctcctggcatgctttcccctgactttgcgcttctctgcactcctggcttgctcctctgtttcacccgctggcttgctccttctctgcatctcccycycctcttattctcctaccccacagctcactgtctgcaggctgccgaggaggctgcttcacctacaccatgtctcgaatcaacttgcggatccgggagcagcttttctcctccctgctgcgccaggacctcggtttcttccaggagactaagacaggtggggcctggwgtccaggtctgagattcccatggacatcccttgcccctcagtgaccttccacccacagcctctcctcctgccttcacccgtatgccaggacytggggatgcttttctcttgtttgggacagggtggagaagcagcctccactgtccctctgcaagtgaaggaggatgttcagaggagggggctgtgtcagagggaacggtcaggagggagtttctgggggccctgcagtacacatggtttcctttttcctcacctgctctgtccttcttaggggagctgaactcacggctgagctcggataccaccctgatgagtaactggcttcctttaaatgccaatgtgctcttgsgaagcctggtgaaagtggtggggctgtatggcttcatgctcagcatatcgcctcgactcaccctcctttctctgctgcacatgcccttcacaatagcagcggagaaggtgtacaacacccgccatcaggtgagcgtgcatgtaagggaaccccaaagggagaataaaactgacaggtgaggaggcttccacatttgtggctagaggatcccctagagagagatgttctcttctcagccrttaggggagaagrtatattgtagtatatactacattttgtttgtccagccatccaacaatggatatttgacttcagaagattcatgattctccagaactgtaaacaaaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatcaggaagtcctaagtctgaatgtcagctccaccttctctttttctcttatattgtggtaaaacatacataacataaaatttaccatttcaaccatttgaagtgtacagttcagtgacatttaggaaacccacattgttattgggtarccatcatcaccatccatctccagaacttttttcatcttcctaaaatgaaactctgtacccactaaatagtaactgcctactacccccaacccctggccgctggcaacctccattgtaccttctgtctccatgaattgtgatgactccmggtgcggtacgtaagtggaaccatacagtatttgtctttttgtgactggcatattttacttagcgtaatgtcttcaggcctcatccatattgtagcatgtgttagaatttcctcccttttaaggctgaataatattctgttgtgtgcatatatcacattttgattatccattcatctgtcaatggacatttgcgttgtttccaccttttggctgttgtgaattatgctgctgtggacatgagtgtacacctgtttgaaaccctgcttttggttcttttgggtatatacttagaagtggagctgctggatcatatggcaattctatttaacaatttttgaggaaccatgtattagtccatttttacgctgctgataaagacatacccaagattgggcaatttacaaaagaaagaggtttattggacttacagttccatgtggctgggaagacctcaaatcatggcggaaggtgaaagacacatttcacatggcagcagacaagagaaaagacagcttgtgcaggggaattcccctttttaaaaccattatatctcgtgagacttattcaatatcacaagaacagcatgggaaagacttgccctcatgattcaattacctcctacccagtccctcccacaacacatgggaattcaagatcagatatgggtagggacacagccagatcgtatcaaaccaccatacagttttccatagcggcagcaccattttaaattcccaccagcagtgcataaggtttccaatttctccacatcctcatcaacaccactttctgttgtctttttttttaatagccattctaatggtgattaggtgattaggattatctcattgtggttttgatttgcatttccctaatgattagtaaatattgagcatcttttcgtgtgattttggccacttatgtttctttcttgaaagaatgtctgcaagttctttgcccattttctgatttttttttaagttgtgggagttcactatatgttttgcctattaatttcctatcagatatatgattcacaaatattttcttgtatttcatggttgctttttcactctgttgctagagttctttgatgcacaaacgttttaaattctgatgaagtctgatttatctattttttgttgcctgtgcgtttggtgttatatccaagaaatcactgccaaatctagtggcatgaggcttttcttctacattttcctaggagttttatagtgttagctcttatgtttaggcctctgatccatttggaattacatctccacctttcttaactatctgtggctccttgggaaaactacccttctttcctrattcagacactggggatgggaaaattacctcaaatgaaggttaaaaaaattgcatgtatctcctatactacctaacactgagagctcaataatattttgttcccttgctccttcactcttattccttctggaaagaagagtaaggaagagggagagaaacagtttggtatttttaggtagactagggagcatctcactggctggagtaagatgtgggggcctgctgtctttgcacatcagccctggtgtttgctggccctcttttccaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcrtaaggagggtaagataccagagtggttgtgaaaggagcccaggaaagggggagggcaagggaagaggaaactacagctggttctagaggcctttgcagctcagtctcatagaggcagagagggggaaagaatgggaagattcccagcctcatctctttcttctcctcttccaggtgctgcacttgggkgtrcagatgctgatgctgagctgtgggctgcagcagatgcaggatggggagctcacccagggcagcctgctttcctttatgatctaccaggagagcgtggggagctatgtgcaggtgagcgagaagccaagcctgctctccttttttccctctctttttctttgtggactcctgggccttgggctttatttgttctttttaacaatacaatacaaaaccaaaacccgcaagtaattttgctatggagaattttaaacatatgccaaaaatgagacaaaataatattacaaactcacatgtatacatcctgtgctttaacaatgatcaactcatgcccaatcttgttggatctgtatccccagccacttccccccacccatattattctgaagcaaatccaagatattgtatactttcatctgtaaatatttcagtatgtttcttaaaaatacaaacatctttaaaagtgtataacaacaaagccattatcacaccaaaaaattaacagtagttcttaaaatttatcaaatagtcaattgtcaaatttccayttgtggtatccatgtagtatatgtgtatgagtgtgtttattatactttgcttaaatcaggatccagaaatggtccacatattgtgactggttgatacatcttttaagtctgtctgtctatctatctatccatccatctatccatccatccacccatcaatccatgtatctgtctaaaagtttcccttgcacagtttatttgttgaagaaataggttgtttgtcctgtggagtttcttagggtctggattttgttgactgaatccctgtggtattatatgctcttctgcctctgtacttcctgtctattgatagataaacctagaagcttgtgagattgaggggktttttttggtctttttccagcaacagtactttttaggtggtgatgcattcttcctccaagaggcacacaatgtctggttctctatttgtggcaacatcagccactgatgagcagtacctacatccatgacagaattagggctgcaaaagggagatactctatcattcttcatgtattagctgaagtagtctatgaagggagacttcccctcatctaccatttcattacccggtggtacagtttgatgaggaaaggcagagtgagcatttagatctcttcctacatttaccagttctcaaaaacagctacttcatccagggctttatttaaacattttcctagacacttgataaacatcttttttgtgtagagaactgcgctgggcactctgacggctacaaaggtgagttgggcacagtgcctgcatttaaggagctccccgtctaatcaagcaagacagaactgggcacaagtaataggaagcagtaactgaaaagatctggggctagaggcaatgctgtatggtaggagaakggactrtatatcctttatattgcaaattggaacactggggtattggtgccacttttaaattccrtccaaattgtacatttaaargtggagaatctcttttgagtatggaggaggagcagtgcagttgtgagtggagtgtgtgaggagttgggagggtggtttctggtagaagtgtgtttaattagccggctctcccrttcctgttttccagaccctggtatacatatatggggatatgctcagcaaygtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggtgcctgaaagagggaggaaacctggacccttgctctctgctgckaatgcataattggacatcacagcctatagttcatttgcctctgagaacctrgtcttgcctctgctargaagagaaatggagggattttgagggagaaggggyaggcycttaactctttttctggtyttctaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtgggtgaggagggagargacaggggacaggagaggggagcatgtacagagagaggatgggagatccacgggaaggcgcaccaggtgttcattctgagggaggtaggtggggaggacaaaagggcccctgccttgggggtttacacatagtcctctgcccctgtcccygctgcacaggtggtttcagttgggcargagcctgtrctgttctccggttctgtgaggaacaacattrcttatgggctgcagagctgcgaagrtgataaggtgatggcggctgcccaggctgcccacgcagatgacttcatccaggaaatggagcatggaatatacacaggtatcttctacaaattgtaagcytgctccttcagtaaaaaagagaaaatcagacttactcttagtggtgaaggtcgtgtccctgtarcttgatgtttgctgttcctctgccctttcctccattcctacgtctccttccccacacactgaattcttcagcctccctcttgmtcaagagtctttgtttgcagagagcaatgcagcagtggtgctccctccatgggcagccccgtcaggtcccyaccccatggccctcctcccactgggccctccccgcactgggccctcccacctcccgaggtcctactggaagtacctgctgtgcacttgtccctccttgtgtgttrtctgtgtcacttgtatctgaggaagggaatttctctgatttcctcagatgtaggggagaagggragccagctggctgcgggacagaaacaacgtctggccattgcccgggcccttgtacgagacccgcgggtcctcatcctggatgaggctactagtgccctagatgtgcagtgcgagcaggccgtgagtacygtgagagggcaggggacagtggggcctgggaggggcatgctgggaggatcagmctgtgyagaattgggcagagggaggacgaaggacctactagtagaaacagtctgtgccttcttggggttggggaatggaatccggtggtgtgagggcagccccagttccctcctgggcttccattcctccagctgtggcagtacagcygggagagaagggcagtccaggcctttatctactgccctttcctaccttcttttatttcacaccttctttaccctaaatcataagagatggtgcccaggtggatgtggtgtccatctcattcctgtctttctgaggcactgtgatcaccccttcagctgcaggactggaattcccgtggggatcgcacagtgctggtgattgctcacaggctgcagrcagttcagcgcgcccaccagatcctggtgctccaggagggcaagctgcagaagcttgcccagctcyaggagggacaggacctctattcccgcctggtkcagcagcggctgatggactgaggccccagggatactgggccctcttctcaggggcgtctccaggacccagagctgttcctgctttgagtttccctagagctgtgcggccagatagctgttcctgagttgcargcacgatggagatttggacactgtgtgcttttggtggggtagagaggtggggtggggtggggtgggggctgtctgtgtccaggaaacttaattccctggtgactagagctttgcctggtgatgaggagtattttgtggcataatacatatattttaaaatattttccttcttacrtgaactgtatacattcatatagaaaatttagacaatataaaaaagtacaaagaagaaaagtaaaagtacccattgtttcacttcctggagataaccatagttgctattttgctgcctgtyccatcagtcgtttatctgttgtttgagatagaaattaaccaaaaatgacataaatattcatgagattgccttcctatatccytccttgttcctaccagtgtctgctattttgaagaagctagggtctggagggacagagaacagttccctgattaacagtattaatagtgacattggtaacagctaccatttatagagttttaatgkgagtaggagctatgctaagtgtttttcatgtattatcgtttttaatcattatcyccaaccctatgaggttggttattatccccattttacagatgaggaaactgaagctcaaagaggctcaatgactttcccaaggtggtcgtagtggtggagttggagtttgaacacaggcctgaccctagagtccacaccctgacccaatcaattatattgcatcttgggtccataaaccctaatccataatcccatcaagaaaagctctgctgctcttagctctaaataattcagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatctccaccatcgtactaatcttaatcctccctgcccactcccaccactgaaaatgcaacattgtacacatcactggttgttgggagggacttaccttggaaagttgctattctaggaaagagaaaccttcatattcctggaaacagcaggtagtttccagtgctggcaatgaattccccagaactgctgttttggattttttcttgcctggcagctgttgggagcagggtgcagtgaggatggggtgagagtgggcagtttcttgtgcagatttgcctttctttcatcctggggctgacttgcagctccacacccatccatctctcaaatttcacagagggtaaaataggcatttggagagaaagaactctggcctgattcctttctctcccacaaatgtcctttattcataaaacaggaatartaattcctgtatctcccaactacatggaagctgcagccctcacagaagaagatgatctgagaaattctttgatttcctcagtacagttatacccatgcatcataatactttaagcctggaaggcatcttaaaaataatgcaacagtcaaacctaattttacagagaaactgacatgaaatcacgcagctaatcatgataaagctgggtggaaaacttatcttgatgggcagtacaggaagatgcagtagaccttaagatgtcctgaaagtttcttatctcaggggaaactcccaggtaggctttatgtcagggacacagaaaaatgctccctgaaagtcaaaatattcgggctagacagacaaattcctgtaagtgtggtttgtctgggaaccacagatgtcactaatcctggtttgctycagagttctttttgttcactcctaccccccatcaccatttgattgatctccttaccctgtaatttccccttcttgtcgcttacctgcagtatctttcccacccaggcatgccttattctttctaaaggaaagtatgaatggagaggggaaagcttgggaaactgatagatttccttggatgccaaaacacctccatagcctgtctgcccggccctatgtggaaacagcattgagtttcaagtcctttatgcctccacccagggatagccacttgkaatccacatggcaattgtgaaacaagcaggaaatgcgtaattgtcagaattttgtggggaaaggactagggaataaggaaaacaaagatcttccttgtgttttagagctgtcagctagaggagcacctgcttgagtctgatgccatctaatggtcccagaagaaactgggttttgaacctagagttccatggactcttaggaattagactactactactactaagcattcactggtgcttactatgtgctattgctgtgccaagtatctgaaacctgtcttcttaccttatttttcaagataattctatgtggcaggtattactatctcaattctaagagtgagaaaatggagttttagaaacatttactaacttgcctgggtcacatagctaaggaagaggtggacttgcccagctttgcataaaactcctcaaaagagttgcctatactccctgaytccacttatcttcctactatcctctttttaaaatatattatttatttatttaaataagcaatatatgaatgtggtttgaaattcaaaagacacaaagaagtatacagaggaaagcctcactctcaatccttctcaaggtttgctaattcctcttgcataggcaatccgttcttccagctttgtgtttatctttccagagaagtttactgtgtattaagcaaatatgtatatctttattcttgctcagtattttcgcaaacagcagctgtctaagttcactgttctgaactttattttttaaattaaaaatatatggctatgtagtattctattttatggaagttccatatttcatttatcctgtttccttctactgatggctagttaggttattggaagtcttttgctgttgctagttagtcttgtatagacattgtaatgcacatgtgcaaaaatacaagtatgatacaatcttaaaggggagttgctgagtccaatatatacattacaaatattgatagatattgcaaaattgccttcatagaggctatattaatttatagttccagcagcaacatatgagtttatctgtttctccatatatatatatatrtatatatatatatatatatawccaacagacagtgttaatttttaaaattttgacaatcttctgggtgaaagtagcattgtattgtagttatcatttgctttttaatattatcatgtaagtaacagagatactaaacccagaaggataagggagcaaagatgagaaaaataaacacacacacaaacaacaataacaaatctgtctaaaatattggaaaatcagaatgagaaatgaaatatgactgtaacgataaaaatcagtaatraaaatgactattaaatttaaaaataaggcagagcaaccacaagtgacatgagaatgaggcagacaaagttaaagcacctaaagtctttgtcttgtttgaaaggagggtagagatattgattaccttcagatgctgccacatttggtaaacatgttaaaaatataagactgacttttaactaatataattagaatttaaaattcctaaatcagtaaggggaaattaaataatactttaaataaaaatgtaattgatttaatataagtgatgcaaggaaaacaaaagaagcaaagtaagacatagcaaatacagagcaccatatattgtaacagaaacgaatgtaaatagcacagtgatcacaagtataaatagcttaaatatgggagttaaaggaaagttctcagattagattaacaatatcgcaaaatccagttatatgcccttcataagatcacaagaaacctaaaaacatgaaaatgttaaatcaaaaccagatataagatacacaaagcaaacactaacagaagacagaaagacagcttatgtaattacagaaatatctaaacatatagtctaaaaccaaaggcattagtaaaaacaaagacagccattacatagtgataatgaagtcaccagaacattatactaaaactgaatcagtttgcacctagcaataaaactacaaaatatgtaagaaatataggagaattataggaagaaattaattgagaaattgaaacacatttctcaatgattatagaataagtggaaaaatgaataaggatatcaaataagcctgttgatgttcttgtctgtaacatctaggaatcaaaatatattctttaaaactaataaatcaagtgctcgtatttacacatttaagactacaaaggtagacacacacacagaaagaggaagggagaggatatgagctagttttgtgattgttcattatttaaaactaataggaattatctaaaggaagagggaactaagtgtattatatacaaataaacttatcaaagcaaccttgaaatatacaccttccttaatatctgaaaaggtaaaatttttaaaatgcacaataaagacatagtgaaagatttttaaaaatactcatgtaaacattatacttaacagaagttaatatctctgaattagactgaatctatttgctgtatgaataattataaatgggcttcttaactgaactaaataaatgaaaatatttttaaattagattaagataaaaactstattatttgcaatatgcaaaagacacctaacataaagccactcagaaagatgtattcattattttcaacaaataagatgatgggcaaagacataacaagagaakgcaaacaaaagggaagcagaggtcacattcgtcttaccaaacaagatgaaattcagacactcctcaccaaaaaaaaaaaaaaaaaaaaaaaattgagtgtgacaagaagggcactttataatgtaaagtataaaattcatatgaatatatgagacatgtgtttaagttctaaataccaaataggtagctcttataaagcagaaattaaggtagatacaaggaaaatattcagaaatgtactaccaatagaacactttaattccctttccctggactagaccagttaagtggacaaaaaaataggctgggcctggtgattcatgcctgtaatctcagcactttggtaggccaaggcgggcggatcacctgaggtcaggatttcgagggcagcctggccaacatggtgaaaccctgtctctaccaaaaatacaaaaattagctgggtgtggtggtgggcgcctgtaatcccagctacttgggaggccgaggcaggagaattgcttgaatctgggaggcaaaggttgtagcgagccaagatcgcaccactgcactccagcctgggcggcacagtgagactctgcctcaaaaaaaaaaaaaaaaaaagtatgaacacagaagatagaagatattactatcaataaaaaaatagatatgctacatctatatcaaacttttaaaattgaaaatagaggccgggtgcagtggctcacacctataatcccagcactttgggaggcctaagcagtcggattgcttgaactcaggagctcaagaccagtgtgggcaacagcgaaaacccgtctctacaaaaaatacaaaaattagccagatgtggtggctcgtgcctgtggtttcaactacttggctgaggtgggaggatcgcttgggcccagttcaaggctgcagtgagctatgattgtgccactgcactccagcctgggcaacagagtgaggccttgtctctaaaacaaacaaacaaacaaacaaaaattaaatggctcaatggcatagaagaaaatttttttatgaagcaagtataatattgatgttaaactatgacaatgcacaaatataaaaattgtagatgaatttacttattatactgacacaaaaatcctaaataaaacattscaaacagattctagcacagattaaaaaacacccattaagatcaaggggttttttttgttttttttttctagaaaaccctttggaagttcatgatattttgaatttcaatggatatttcctgggaataatgagttcaaatgaacgaatatgtggaacaaagcatcaccaacatttattttttcaggatgaggtgatggacaaaaccatcacagggaaattgaggcaaatagtacatgtaaaacaatacttcgggtgagtccacctatcccaaagtcgtatcaaagaagtggctgcagattggagcccaaagcctttggttcctcagtttccaaatggattctcactaggtgggatcatgagtttgctttggacaccccaaattctaactatttcttttgtttcttacrtcctttccctcttccccagccccttcccctcatgttacacctcttgctggtttgagacgtcaatcaccactgagaaagaattaaaccagtattttgagctggcaaaattcttagcctagtacaattccttcaattaaactgtagctcaacaatgtgttctctaaaagtatgatttaatattctacctagaaactcagaatatttttcataactcctccagggcagtgtggattatgttgatgtgttaggaggaagtagaaggaagaaaatgaattgagacgtacgttttacttccatgtcaaagtcaccaaaatagcagttgaagggatatttgtgtcaggcaatagggagaataataattttatgccaccctcaaaaaacaaccacacatacacccaaattctctcactcctcagagaaaggggaaggaaagaaaagagagaagcaaaatatgagcttgagtgaaaaatcacagaggagcctgtagctatttagggagggctgctggctgaagtcaggcaggaaaaaaagatcaaaacaccctgccctatttttcaggctcgttcaagtagaagacaaaaacataaatacaggagaaaggaagaaaaccacatctttttcctcttgtctccccagaactgaacagtgtctctgataagcccaggcccttctatcgtagacactgacactatgcacagaaaatgactcaaaaacgcttctaatgggggtgaatctgatgcttcagtttatttaagatgtaccagaggccatctaaggagatccatagcttgctaactgaagcttattgctttctcttcttagttcccatgccaggctctatgccattccttgcttgtcatgtgagatcactgatttcctttggttaggtaggatatgatttccttacagagatctgtcctgacaccaaacagctatgatgaaattccttggttattttccctttttgtgtaccttatcattaccggaatgctaaagctgtaggaataaagtttccctggcttcccaagaaatacagtgtgacagaaacagtacagcctagggacttactagttatgtgaactttggttcattccatccttacctcatctgtaaaagggagatcatgatagtatctactgcaaagggttttgtgtgatgattctctctctttctctctctctcatacacacacacgcacacatttatataatgcttagaaaatgaactcataataagcaattgacaaacattagctattattatgtaggcaagtcagattttagagtttgtgagccttagacacatttacagagaagaaagagcagccctcctaactttctggtccagcgccatatcctccacttcctccccatccccacatcccttgccatttatcaaccccctctctcctctaaatctaaatacaggcccccgtttgatccatattgtctaggcccttcctctcctctccacatggcccttccttcagctctgagggaagctgcagaagccagccatggtgctgtctacaaagaaggggacacacgcctcttccacccgctcatgctgttactgcatctgatcatctccgtgccgtgtccttgttcacttagcctgtgttgagtgtttgtctccatttccaaatgcaataaaacatctgggaaagactaaggtaggtgtgggcaggaagaagggaggaagttagacccagtggcttgagtgccctctgatgcctccttatcctcggctccacacaagccctcgccagtgtgagctccacagccatccacctggaggaggagtactcaaaaccagggtcaaatgccttgtactcgggggtctaccagtaagcctgtggccagccttccacttcatgaatcgtcacatttacatgagagatgtggagggagaggggtcagcctcctagctcctgtcctgtagcagttaagtcaagtcaggccaggctgtggtaaccaagccagtaccttctttaaagaacagttgtttctcattcatacagagtgtgttgtaggtgtgagtgattccctggggcagctgctcttcatggtgactcagctaattagactgcttttctactgggattgtgccatctcaacacaaggctgtcttggttgacttggtaggggaggaggagaagagtcatgcacgaggagttaaattctttgaccgggaaccttttgttcactttccattggtgagaacgagtcacacagctccaggagagtaggaagtctagtttctcgttttccatgggcctaggaattagaggatgaacactagcgatgtcttccacgtcttgctctctttttctttacctgttataatctcccatggagaagaaattatttttctgattggtctgatccaggcctctaaccaagggcatttactaagggtcatagaacagtaaaaggttgcacaattgcatctcacctctcttttctgaatcctgcttaattaaaactttaaaaactcacttacagaccacttcttgctcttcttagttatcaaatatattttcttccaactcctttttgacagatcttgccttgttctcagctgactcccttgcaaccatctaaatggaacttcctcattcccctttatcccctgctaatcgtcctgtctttattcttttatctgaagaagtgtacccttcttcccccaagccttatgctctctatcttagtccatttgtgttattgtaacaagatacacgagatagggtaatttatgaagaacagaaatttatttctcacagttctggaagctagaagttcaaggtcatggccctggaagatttgatgccttggccatcgacttgaaaaaagtcactgaagtgaacttgtggttaccatgataccctgggttcattcttaacatgcacagtataggcaaatcagggccacatttcatgctgaaagatgatgtgaaatgatgagtaaacattgccctttaaataataataacatagatggtgaattacaatttgcacttttggttttatttgcttaaagatagtgttttactgtctaggttttactgaaagaatacttaactaaacacttgagtcaaatcattccagtgtaacagtcctcacaaggaggaaggcagaagggcaaaagtgccaagctattgcctccagcccttctatttttattgattgactgattgattgattgagacagggcctcgttctgttacccatgctggagtacagtggtgcattcatggttcactgcaactttgaacttctgggctcaagtagtcttcccacctcagcctccaaagtaactaagaccacaggtgcatgccaccatgtttatttctttaattttttaaattttatttggacatgggggtctcactatgttttccaggcaggtctctaactcctagcctcaagcaatcttcctcctcagcctcccaaagtgctgggattacaggcatgagccatcatccctgctctctctagccctttttaaagtctctaatcccattcaggaggcctctgcattcatgacttaatcacctcctaaagggcccaccttttgatactatcacattggtgattaaattgcaacacttgaattttgagtgacattcagaccacagcattttggagaaaatgtcccctttcttctcttttttctcttcagtttctcctttctacagataccttgcacttcacttgcaaccttgttgaagtctctcctgtcttaaaagtttcttttcccaaaacaccagaactcattccttctgtctaactgtaactttgtacttgttaccaacctctacccatttctacccctgactccccagcctctggtaactactaacgtactctttacttcgatgaggtcaacttttttagattccacatatgagtgaaatcacgtaatatagtccttctgttcttggcttatttcacttaacatagagccctccaggttcacccatgttgttgaaaatgacaggatttcatgcttttttatggcggaatagtattccatcatgtatatatatcacatactaattaccctgatttgatcaatacacaatgtataggtgtgttggaacatcatgctgtaccccataaatatgtacaattattacgtgtcaatttaaaaaacccaagaaaagtattttttcttagtgttgtttttttctaaagtgtatcccattttttcctttgttttcactttcaaaattcttgaaagactgttttaatctgcggcctttgttttcttgtttccaattcattcttttgaaatatggcttctacctttaacactctgctgtcctcttgaaggttattggtgccctactaaccataaaacacaataatgctctcttagattgtatcctggtgagcctttttgcaaaattttattctttgagaattctctttccatgttttcttttcttttctttttttgtggtcattttggcttataggaaatcgtactctccaaatgttctctatgtcttctatttcttctctgataatccctttactaaatcttcttgaggcatatgcttcagaatgcttaatttacatactcttaattccttcttaatttacacactgcctgtcggcaatgtcaacacccaataagaagggagacctattggtcagaacaggccagggaatagaagaatacataataaacagtctgcctagttcttctagggccccataatatgtcaaacatatatttttacttcttctcccagcccatttttagtatacctaaattactgtcagtgattctgcaggcaaacaatggttgagttgtatgacacaactttgtgaaagtatcctacccagtacctgatgatgcaaaactcttctatcttgattggttgtcaatctgaggagtttccaatcctggggaagccagaaaaacagcgatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccggctaccaggtacaagttacttgtaactgttatttttctagcacaggtgacagaatatgcagccatgaagcaatgtgagatgaaagcacatattaatgagcagaaacaggatgtaatgtgctaagaacagaatcccctttgcatgttagtttcattaaatacaaaagaggaacaaacctggccaggagagatcattattcttagagaatagaaaccgccctgagtttataatgtccattaaacaatacaactgaaaaaaaaatcagcacagatgttaaatgatgatgaaaaattcagatttcccccctggtttagactactagaggaaatagagaagagtatacatgctgagaaattacaggctggaacttcatctgaaattagctactgagtgagggataagtggggttcacccaggaaggtcattcttatggctcagttcagagttggaggaggcttctgaacttagaaaggaaagtaaattaca

SEQ ID NO: 17895 - DNA, 21254 bp, Homo sapiens
ccaaggcgggcagattaccttaggtcgggagttcaagaccagcctgaccaacatggagaaaccccgtctgtactaaaaatacaaaattagtcggacgtggtggtgcatgcctgtaatcccagctactcgggaggctgaggcaggagaatcacttgaacccaggaggcggaggttgcggtgagccgaaatcatgccattgcactccagcctgggcaagaagagcgaaaaactccatcaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatataatcacatgtgtttgtatgaatgctgaccatgtgcagagcactgcgctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaagggaacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaaatcttgacaaaatgtgtttattatgttgacaagttttttggatacccagtaatataaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagagcctctttgagtctacgcaagtattcctgcaagacagagaagtcaaactataccaaatctctggatattaaaaaatgaacacagttagtcatccaataaaaagtatatatcatttacccccatgaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcccctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgtcccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcaccagaaaagactttttacattaaaatgaagtagaatgaaatacaacattgaacaggtcatattgagaggcaagataattgggacttgacctgaattgggagtgatgtgtcctatgttacaccaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttcttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggccccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagacagatgaagaggagcattactgagcaatggaacagaaggataaggaagatgaagaggaaggagacctgcagttagtagctcatttccacagtaaggatgtcctttccacagcaagtgtgtcccaacgagtgttcagcttctagcagaaaggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggcttcaagccctcaccagcttcagggtgggacttcactggggacccatccccttccacccaggaacctgtctgcctcctgctcccaggctgttcatgccaaggagcgcctgaaagtcagtgtccagctgtcttcagacccctctcagcctccctcccacgcttgttggtgcccaagttccaaagggggccgagacggcagggggctggcgtatcagcactgtcctgagcgtgtgcacgctcggccaggctgtgacagtacccaggctcggcccgaccttgctctgagttcagagtgggtgctaacagtggagagaagccaggcagccggagtaggcaccctggagcctgcagtgggcaggggactttgctgggcctctgagagcacagaaaatgtccacagccgcggcaaggtggctgcagctgcaccctgggagctcctgctccaccagttcggaaggggcggggctcctgcttgtccctggctcacctgctcctgagtgtgcaggtccggtggcgcctccttgcaggctgggctgatgggcgggggcgggggggggggggaggaagggaatgttccaggtcctccctgggcccgggactgtgtccggggcagggatgacgtcgctgcaagttcttcccgtggccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactaccttaacaaatgaaattgaagcagagacatgtaatttgcccaaagttactaagttagtgacaaagctagaattcaagaccaagaagtctagcttccatgctcttaacttccaaccatggtgacacctcaaacaacttcagacaaaaaggccaggagaaagtatatttcagagcttaataaacattataattagctgtcaaattaagtatcaagccagggcacagaacataaaagaaatcagagtatggctatgggaacaagacaacaggattataattttacctcttggttctagtttttttctttgttcatatggaaatcgttactgaaaaggtactttaaggatatgcttgttgcaaatcattagctgtatcactgaccaagagtgtttattcctgaaatactaactgattgcctactatctgccaggcacaatatcccatgctataatacaaaattaaacaaaataggattcctcccttagaaaaactcaccgcagagtaaaagaaaaagatacacatctgggtcattataatgatcaggtgctcaagctattcattgccccagtggactggagatacaatggccttctcaagttttggggtattacactcaaattcatatgtaatactggagaaaaggcctaattacaactaaaactggatttcccaccagcctggtggcatgggaatcttggaattaaaattacgtagaatttttaaaagtgatgtatcttctacatctgattttgtgaactgaagtttattctttccaggaaagcatatagatacacgacaggaaatgaaatggatacttgttggggtcagttttatgtatagtttgtattttattttgaaatatgatacactgctattctcttgcattttcttatatgtgactcaccactaaccctatattcccccatttcaggccagttggtcataagcatccatttgcctcagagaatactgggttgttatgacaagaatataaagttggaaagaaatagaatatttgagtctaccctgtaagaataaaaagaataaaaggggtttaaatttatttagaccctattgtttaatcaagaattctggccaggagcagtggttcatgcctataatcccaatgctttaggaggccaaggcaggaggatcatttgaggccaagagtttgagaccagcctgggcaaattattgctcgggaaaaaaaggtcttatttagtattttagtctttacaatgtttttttctattatgcaatattctctcaaatactttatgtccatccacgttgtctgagacatgccactttaacattctagttaygctgtagctgtcattttaccctaagccgttagtagtactgatccacataaaattgggctgtttaggtgtttaactgtttaaatgtataatatatctgatatatttatatattgtataaaaaatcacctaacacaatagatatttactatgtctgctataaatatatatcatataacatataacaatatattataaatgataatatactataatataaaatataataaatatattataaatgtacaatatatccgatataaatatataaatatgtcaactatattatacatataaatgtatatgtataatatatacatatatgtataatacaatgtatttattatgtatatatataaatgtatatgtataatatataaatgtataatatatctgatataaacatatcagatatattatccatctattgtgtcaggtgattctttatacaatatataaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatataaatatatcagatatattacatatctattgtgtcaggtgatttcttatacgatatataaatatatcagatatattatccatctattgtgtcaggtgattttttatacactatataaatatatcagatatactatacagttcagcccatcaaagcaccatattttggggggttggtttccgtgtcccaacactagctacgaaaatattagctattagctacctataactcttcagtagtaaattcaagaaacgtaaagtaattctcttcattaagttcttgccttgtctactaaaaaaatggtcatcaccgatgtggacaatgaagacctgtggggttaaaagctctaactagtatgcctccaagattctttgattgcctgccatcatgatcgaagaataaataacttctttttcatcttatttatttattttttgtagagatagggtctcgctatgctgcccaggctggtctcaaactcctgggctcaagagatccttctacttaagcctctcaaagtgctggaattacaggggtgagtcaccacgactgaccattaataatttctttcaatgacactttaacataggctcattcatctttacctctaaagaaaagtctttctggtctttttaaaattatattttttggccaggcacaatggccaggtgcggtggctgacacctgtaatcctagcactttgggaggccaaggtaggaagattgcttgaggccaggagtgcaagaccaacctggcaaacatctggaaaacatagcaaggccccatctctattaaaaaaaaattaattctatttttctaagagaaaaaagattcccaattcaacaacacttttcaaaaactttatctggcagctactcaggagattgagatgggaggatcatatgaagcccaggaattcaaaaccagtgtgggcaacatagtgagatcctatctcataaaaaaataaaaaataaaaaaagctttacttggaatacaacccatgactctggttataaatacaaaattcttcaaattcatttaaaggaatttaatcctagcttctcggatgaaaaaaggaaataatattcacaatttgatccatcatcagtagacaagttaaatgtgtttcacaaaagcaagacatattaattaagcaaaatcatattcgagtaaccacaggaaatataaatatactgtctcttacctagagaaatcttatagtctaattgtgaagatagtcttcacgtgacgaaaaagatcatcattaatccaaaacatataagttataaagaagcgacatataccagcaattctaaaatctggttagcatcctttgtagaatttattttaaaatgcagatatccaggtctcatcaataaagatttaattaattatttttggggatgtgctcagacatctgcgttttttgttttttgttttcgtttttttgttttttgagatggagtctcactctgttgcccaggctggagtgcaatggcgcaatctcagctcactgcaacctctgctcccaggttcaagcaattcttctgcctcagcctccctaggagctggaactataggcgcccaccaccacgttgggctaacaggcatctatgtttttaatgaactctgtaggtggttctatcatgcagttagttttcagaaccattcacactgacagtaaaggctatttattcccagcagttgaaagaccactaaggacacaggaatggttagcaaagctacttaaagatgccagggctggggccgggtgcgatggctcacgcctgtaatcccagcactttgggaggccaaggtgggcagatcatgaggtcaggagatcgagaccatcctggctaacacaatgaagccccgtctctacaaacaaacaaacaaacaaacaaaatacaaaaaattagccggatgtggtggcrggcacctgtagtcccaactactcgggaggctgaggcagcagaatggcttgaacccaggaggcggagcttgcagtgagccgagatcacgccactgcactccagcctgggcgacagagcgaaactccatctcaaaaaaaaaaaaaaaaaaaaaaaaaaagatgccagggctggctgggcacagtggctcacacctgtaaccccaacactttggtttgggaggccaaggcggatggattgcttgagttcaggggttcaagaccagcccaggaaacatggcaaaacctcatctctaccaaaaacacaaaaattagccgggcatagtggcatgcacctgtggtcccagctactcaggaggctgaggtgggaggatagctggagcctgggaagctgcagtgatcagtgatcatgtcaccacactccagcctcggtgacagagcaagaacctgtctcaacatacatacatgcatatataaaattaaacataaaaacaaaaataaataaagatgtcagggcttatgttgaaccttaactgagagcaagattcaaaagacactgaggcttatttttctttcttatatctatagttacacagggagctgtctartcttggatgtatccaagttgatatctggttttatccattgaaacccacagtgaaaatggtaaataggtgctaggtgtttggatttttttaatccaatgtaagaataaaacaatggtatcctaataatgtcaaagcaacattggtcataatctaaggaaattgaattcatatagtaccaaatatatatttagcattgtgctaggtgctgatacattctagataaaaatattacacatgggtaaccaaaactgtcaaatgacatttcagggcaagatataattaagtaccaaaatcattggcatagtctttaagtactgtgaaatgtagagaaagctgagatgaatggcagtgtagagacagatggctttgcaaatcatctcagatgactagctatccaatgtgaggacacttctccctcaccttcaaacaaatgctaaagacgcctgttacttaatcatatgaatattcaatcttgtatctaatgtggtggtattcataatactctgtatatgttttcatcttactggacaagtgtcttcgaactcatttaaatgaatttaaccccagctttgtttatgtatagacttcttcaatctcatagtctatttgtctctttgtaccccacaggctttctttattcagtaacactggtgatttctcttattttccttagcttgaaagatctagccacgtgagcaggacagaagtgcacaacaaccatatcttgatttctgtggaccaggtggggcccctgccagccttgctagacagacccaggtgaacagtccttctaggggatctcatcaccaggcaagcacgtggtacgagaagagcagtcattaggaaggccatttggaaaagcacatcctctctgttcacgtgagatattttacatcctcattcctcatcgcaagcttcctgggatttggagtgtcacagacaagagggttgggggaggccagtaggtatggatttgtttatattaaaatgagcatatgaatatttatatgtttatattaaaacatatatgtttgtttatattacaatgagcatatgaatatttatatgtttatattaaaacatatatgtttgtttatattaaaatgagcatatgaatatttctgtatacttcagataaacattcttttccataaataagcttcatcatccagaagccatgttgaaagttggtaatcaaggataggaagtgtttccaagggttgtcagtgattaaatcaaccttaccttagcatacatgtatgagagaagttagataaattatacatagagagatagctagatagataatagataaataaggtagatgacagattagatacagatgataaacagatatgctatcagtctagatctattactcacagtcagtygtatcacagtgtaattccatcaacttcatttgcagcaaaagaacagcccctgatgtacgcctgtttcctgaatatttggaaatattaatattaatatagatagagtcagcttgccagtataaagaatctatctctcactataggcagagccatgtgttggatattatggaggaatatgtattattttaatcgtttaaaagactaataaacttctaatctacttttgggagcctctgctcaagttcctgaggttcctactctaaaatccacatcaccctccaactgctccctatgtgagccattagggagcacaatgaattagagaatgaatcctattagcccactaaaaaattatctttcaaaggatgaagactgatgctaaggaaaaagagatgaggcctccctggttccgcattattactccttcctttcttgggttacggattgaacactgaccttttctttcactcttctgcaagacaaccccataagaaagctgaaacctgcttttgtgaaagcctatgattactataagacaggtgagcaaaacagaatmctagataaactcagttctttccagtgtggtgtctttgatggaaaaataaaataaaagccaatgtgtttggggtttttttcttttttactttatatagatttagggggtacaagtatggttttgttacatggctacattgcacagtggtgaagtctgggctttgagtgtagccatcacccaattagagtacattgtacccattaagtgatttcccatccctcttgccctgtcaccctcccacccttctgagtctccagtatctgttatcccactctctatgtccatgtgtacaaattatttagctcccacttataagtgagaatgtgaagtatttgacctcctgtttctgagttatttcacttgagatagtagcaacawgggtggaagtggaggccaaacctcaattcttaaagsaataaaagtgtggtaaacccttgtacatcttgttttcagtttaatctgtctccataacttattttttcttccttggcctacaaaactactgccaaaactacctgtaatatacatgtatattgatatgtaagcctatcagtcgtgcaaaataatccaaagtaccaagagttttacgtagaagtgcttataaataaaggcatacataaatcttaaaaagataatatagcaatgcaaagaaataaagaagagcctaagaactatacaaataattatagtaggaactaagagaggggtgagaactatagcgttgagtggtctttaaacagcaaatgaagaggctgggcacagtggcttatgcctataatcccagcagtttgggaggccatggcagaatgatctcttaaagctagaagtttgagaccagcctgggcaactaagtgagagcccatctctacaaaaaattgaaaaataaaatcagccagcatgctggtacacacctgtagtagtcccagctactcaggaggctgaggcaggacgatcattggaacccaggagtttgaggctgcagtgagtgaaagagtgagaccccatccctaaaatacacacacacacacacacacacaccccccaagtaaaatttcagctggaatataaatcgtgggtattatactgatttatggagagaaktatgctaagtctttcagatgaggaaaacatataagaaatatcatgcaagaaaaaagaagcaaatatggaacaagaactgaaagaacacatacccgcgtgatcccccctagtactttgcttgaacactgtagcatgagcaggctttgattttccaccagagtaacggattatactaatggtatcaagagtggaaattccttgaccatgtctatatatttccccagtgagctgacatttttgtgatcacgcaggccctgattcagtatggtttgcagtccttaaataggtcaaagcctctccacatagccctgtcccgttgaagctcccattctcaagcttttctcccattgtgtgtttcagatgaagcaaatttgctgaatacagtgtcccctgcagccgataggcagtttgctctacatatcccaagccttcattttgctctcaaaagcagtyctcctaaatacaaaatcatctacatcttttattagttgatatcagatttatcatactgcaaggtaacgcagaactatacagctttggagaggaacactaacttcctggaaggtttcctgattttcttatcagaagagtgtaaatgaaattaccctgtgattagggtagatatctgatggattccattctcagccataaccagtttggtctcctttagcaaagccctgctgctgtccatatccaattagaattaaattcactccttggcaagcccgaagtcatcctgttcgctttcctcttctctccacaggcacagagcaagaaaatgtttgaggcttgtgtctataaacaagacttggctggaatccccagacccacgactttttaaaaggatattttgtccctgcaatacagatactgaatgaggttggcaaataaatatgtatttctagagactctataattgattccttcttcatttaatgcaaatttactccatgcgcacttactgcttttcattgtaccctgtatttgcaataaacaaataatggcatccaaattgaggtaagagcacctagcataaatttaggaacaattcacaacagcctcactactgcagaacctcagaatatgcaaagcaatgtaatggcaatctgggaaagtttcactccaagaaaaaacttctaaactgaagattagtgacaagagtgtagagtatatctgagtggaaacattttttgcaaaagcagaagaaatggtttattttagcaccaggtaaaatgactggcctgtctagatagaagctccgtattgcagaaaggtgaaaatttatcaatcaatcaattaattaataagttatgtttaggtgggagtcataatattacgacaatttcatggaattagaaatgcttaacttctggtccaaaatctgccactgaccatttgtatgactttgggttgaaaaacatctggatatcagttttatgtgtgtgacagaatcacgtgttattggagaagtataaataagtacaggtggcgtatcccttatccaaaatacttgggaccagaagtgttttgaattttgaattttttagatttgaaatatttgaagtatgcttaccagttgagtatccctaatccaaaaactggaaacccagaatgttccagtgagtatttcctcctagcatcacttcagcacttgaaaagtttcagattttggaacactttggatgtcagatttttggattagagatgctcaacctgtatagtagatcctctcttaacaccattgataggttcttagaaactgcaactttaaatgacatgacatagaacaaaaccaattttaccctaggctaatcaatataaccaaggaataagatctagtgttcagtagcaaaatagagcaactatagtaaacagtaatttactctccatttaaaaataactagaatagtagaattgtgttaggaaagctcctaacacaaataaataataaacgtttaatgtgatgaatatcccaattataagtgatcattacacgttgtatgcttgtataaaaatacatgtaccctataaatacatgcaactattatgtatccataaaaattaaagattaaagaagtccatgaactattatttttcataaagagtcataggaaaatttgcctttttaaaattttgcacataaccttggtaataaaaattatatttaaattttaaaaataaaatgagctgtttctacagcatatatctgatcacagaaacatcaccaaacttctaaatgaagacccaaaacatttctaatattgaacattgaaataaacatgataaataaataaaaacaaggcgactccccaatttatggtgaatcactgagtgacagcattcatagtgttacatgaccaacagattcgtatgaccagtgcacaataacagaccagttacactgagacagcagggtttgtagcagagaaagggtttaacgttcacagagcaccaagtgaggagatgtgaggggaccctcaaattcacctccctgaagagttctgggctggggcttttaaggggatcatggagggtgaggagctggagaattgggaccattgattggctggggtaaggagaatgaattcatcaggacatggaaactgcattctttggtgagtcagctcctatggggtccttcagaccagttgatgtcagtagtttcattagtatgcagcacctgaaaggatatctcaaatggaaaactttgcattttataatgttcaagttgttatctgtagagcagttaaggggaactacgatctagggtctgtgtgattctagggcaacaggcagcaaacaactaggaggaagcaggtccgagcacaggctgacctagtgcttaatgctgagtgtgctgcaagctgggtttattttcatttctccccctcccttcttccctgattaattttataaagtttatagggatggtttccgtagtggtgatgggttaaatcaaggaagaaatgtttacaaaccaaagttttggtaggaagtagcacctcctaccagcatgcagttcaacaacaaatgagaacaaatgtggtggggtcgcgagcattttcatcatgcatcatttattgccatgtatctgtatgattatcatctacttcacagggtagacatctgatggatcccattcttagccattaatttcacaaattattgtgaaattatgtattcattctttgtttctttttccaagctgtgtattctagttcagggtcacaggtggtcacagcctttcctggtagctcagggccaaggtgggaacaaccctgcacaggacaccccgtcgcaggcacactcacacccacactcacactcagactaggaccatttagatgtgccaacgaacctaatgtgcatatctctgggatttgcaaggaacccgaagtgcccagaggaaacccacacagacatggggagaatacgcaaactccacacagacaggtggccctggccattgtctcatcaacattataacaaaacgaggttgaacaggaacaatcttattggaggacctgctgtacaggaacaagttttctaaggagattaaaaaaatgtagaagcacaaaagagatagaagggttaattttttaaaaggcaatactgagtatctaccatctgcctggcactgctttaagcatttttctggtattaggtaattttatcctcacaatcacattatgatgtagatactattattaatcccatttttaaatgaaaaacagaagtttggagaagttcagaaactttcccaagctccaagtgaaaaatgaggcaagattttaacctaagcattccagctccagagtccatacccttaactacttctcagtgctactcagctgtgaggaaggagacggctgtctcttcttttgagatatcagatgatggtgggaggctgaatgcagaaggacagatgtgttcaaaagaagagaaagtatgtaaaagcaaagcagaaaaaagaaaaatggggcaaagaaaacaggaaaggcatctgtgagacccttgggtgagttcatgtctgagacctgttggcatcagcatggcgtgattgtccgtttcttgtgtgaggcatgtggcactggtagactgtgaccagtgctgctcacgatttgaatttgcccttcccaaagtcagactatgctgagggaggagaaaaggtaacacctacaaaacttcttgcttagagtctctttatttaaagattatgtggccctaccttctttcttcccagagtagagaaagaaaagagcctctcagtgtcctcgaaagagccaatagacttataattggataatacaatggagtccaagattatgaataatccactatcctgtatttaataaaagggtcagagaatctccatcctcagaattggatccagccatgcctgcagacgctcttatataaggcacatgagattcctgttgtaaatctcaatcacaagagagctgcatcagctggggcccagatttgcagggctccccaacaaatggacacaatagagaatgccaccttcgtgcatagtgctgtatttggtgggaaacgaaggaacagagaacatcctgttgattggtctctgactcttaatactctgatatttttgtctaattgcaatgaaaagatctaagtaaggcttaggacagaaaacagagcagttctcaattggggcctatgctaaaagagttagacatggtttaatgttgaaaagtcaggacagtgttgatggcagtgataaaaagtgaggctagagaaatcagttgagactcatttatcaagcgtgttaacagaagttttcatgttattttataagtaatggtcttaggggatttttgggggtgttgattttcccgtatgcagacaagtgaagggtgaacaagacaaagatgagctatactaagcgttagaacagctcagaggagacctgcagtggctagctctctgtagacaggttgtcctgacgtctgccatcaacagacaggaagcgtggagaggattgctcctctccgcagctggcctcctggaaagggttgctcgcctctgcaggtctctgaatctctcagcagagagggtagttcctctctgcagctggtcttcccattgtgtcatctctgtagacaggtcatcctgacatctgctgtcagcagagaggaagccctggagggggctgctcctctctgcagctggcctcttggaaagagttactcctctctgcagctggtaatcccgtctctggaagtctctgaagctctgagcagagagggtggttcctttctgcagctggtcttcccattgagtcctctctccgttctctccatcctatcttgttctggctgagcccagggcttttatggacctcggaggggaggaagtgtgtgccgattggtccatgggcaccatgggtgggcaggaagaggcactacaagtccccactccagttggtgggactggcagcctggcccccagccttcaggcccttcctgatctgaaggtggggccttactgggggcccgcccccttcctcccaggactctgcctcctgccaccattcatggctcccaagtcctcattccaagatccaagccagtgccaggagcagagagaggccaggcagtggaagcagacacccctgagcttgcgaacaggagtgtgggagggaccttcctgggcccatgagggtgcacactgcagagatgcccaggtcctgcgccaggggagctcccacctcggcaacttgaaaggggggaggttcccacgtgtccctggctcctgcctgctccgtggagcgcgaggcccaggtctgcagctgaggattgggcagctgcagctgcacccaaaagagcagatcctgcctactcccggccccctccgggagcacagggaggctcatatccacaagcgcatttgggcggctgtagccccacccaggaggacggggctcctgcctgcttcatagagcaggaagcctgggtctgcagctgaggtttggaggactgaggtttgcagggctgcagcagcacctgggggagcccccaccccaactcagaagaggcgaagctcccactggctgcatggggcatgatagcaagcagccactgccattaataggaagctaatgaaatcttttagagacaacacagcggcaagatcagattttgtttaggatgataacaagtggcagagctagtgtgagagagacaggtggcaaggagattattacagtcatccttatttctcatggaaaattttcctgaaaaatgggctataaggatattccacttcttaaaactgtatttcttaccgcttagggagagccaaaatgctttgcaccaatgtgacacgttttagaccaactgaaagtctacaaagagctctattttaataattaagtctactgtagatttcaggttcagcttcctacgaagattttttttctgaagtttattaaaatcaataattgacactaggtggcaagtcaggatcaacaattactgtgttcccagcgtagttatgcatcttgatttgaagtgaggaatgggggagtactatgataaggttagacacagactaatagcattctgaaagacatatactgatacataagacacgtatagcatatatcagattcatgccccagataccgagcagtattattttcaaatacgttttttatatgcttcccctacacttacttgttcctgtttggatggcttagcagaagctccaagatgcccctttcatatacagtaataaaagatagccacagggtggcagcaaaggttaaaaaagttgagtgctgctacttcattaaaaatctcgtaaaaaataaaaataaaaataaacttaggcaatgggaacagagaagagaggagtaaaataaccatagaaacctgaaatgagaaga

SEQ ID NO: 17896 - DNA, 57759 bp, Homo sapiens
ctcattctagtttttcaatattcttcttaacgaaaaattatttttgttactggtaattttattttttaaaagcatgctggccgggtgcagtggctcatgcctgtaatcccagcactttgggaggccgaggcgggcgaatcaccagaggtcaggagtttgagaccagcctggccaacacggtgaaaccctgtctctattaaaaacacaaaaattagcagggcgcaaaaattaggggtgcgcgcctgtagtcccagctactcgggaggctgaggcaggagaatcgcttggacctgggaggcagagcttacagtgagccaagatcatgccattgcactccagcctgggcaacaagagcaaaactctgtctcaaaaataaataaatatataaatataaataaataaataaaatcatgctgttcaaatgtcataagatactattataaaacaagatttctataagttcaggatactctaagaataagtttttgataattctttaagcttttatgtccagaaatttgaaaagttaattttgattaagtaataaataactttttctggcagctgtcgacacttgttggaggattggggtaacttagatggcataatccaggctataccttcgagtgtaaacttatctgccttgctctgacggcttgctatttgaacttcaaagagatttaaacaaattattaaaacactgtacttgttttgttgtgagaaaaagaggaaccaaaccctatgcttaataataatcatcagctctttcctgggtttggcaaacatgttttcatgtggttggtaccagccgctgatgagggtatctgcctttattttaaaaacaatcattagtttgtcattacaaacatgactaaattgctagcaatgtccttcataatcaagcaagatttgtcctcttctacaatcctttatatataatttatcctccattccaagaatattaaattctaaagtggctgacaataaatctcaaaagaaggcaacacattctacggaagaaaaaggagcaaataaaatagaattatatagaaatgaattagagaggcttgagcccctcaagttctgaaatgatttcactatctggcacatagtgatgatcattaaatgtttgctaaaggaataaaaattcaagcgttagggataattctacagcgagacatacattataagaaagtagttagctttcaacttcaaaatgtttgaaaactacttatgagttcaacatagcattgtagtcattaaaaaatactcagggcagggtgtggtggctcacgcctgtaatcctagcactttgggaggccaaggtgggtgaattacctgaggtcgggagtttgagaccagcctaaccaactatggagaaaccccatctctactaaaaatacaaaattagccgggcatgcaggctcatgcctgtaatcccagctactcggaaggctgaggcaggagaatcgcttgaacccgggaggtggaggttgtggtgagccaagatcgtgccattgcactctagcctgggcaacaagagcaaaactccttctcaaaaaaaacaaacaaaaacaaaacaaaacaaaatccgcagatattttcctagcatgatgtaattcaatctcttgtaatacaaattgatatattataaattacttcttgtatttccttctttcctttttcacgttgaaaaattcacttgggcaatttaggtagtagtagttaaaagtaacccatacatgagctattgggcctgggtagggccatccataatgacatgttcaagcaacaaactggacaaaagaaccttcggaatgcacttggttgttcaaaaatagcaggtggttgctttaaaaaaaaagactatggaattccgatttttctttgagaattttgtttattgcaataggattatcaaagaaaaattaaaaagtaataaaaaattttaaaaaagaattttgtagctacccttcctaaaaaacttacccagattacttcttgacctatactttgagagcagaggaagtctggctacattaactcagtagctctgcaacttctaggtacttttttacctgaacggtgtatcctaagtactgtaattcctgcattgcttgcacatttgcgtttattattccatccctgtattacaataaaattttttttttttttgagatggaatcttgccctgttacccaggctggagtgcagtggcgtgatctcggctcactgcaacctctgcctcccggattcaagcaattctcctgcctcagcctcccaagtagctgggattacaggcacgtgccaccatgcccggctaatttttttgtatttttagtagagacgaggtttcaccatattggccaggctggtctcaaactcctgaccttgtgatccacccacctcgacctcccaaaatgctgggattacaggcaggagccaccgcgtccggccacaataaatattctttacataaactttcaagagaaaaagcattcaaggtacgtgtgtgtgtgtgtacacacttacatatatgtatatatatactcctgtaaaccataattggagtttaaaaaatattattatggtatttacaattttctttcttttcttttcttttttttttgagatggagtctcgctctgtcacccaggttggagtgcagtggtgtgatttcagctcactgcaacctctgcctcctgggttcaatcgattctcctgcctcagcctcccaagtagctaggactacaggcgtgcaccaccatgcccggctaattttttgtatttttagtagagacggggtttcaccatgctgtccagactggtctcaaactcctgaccttgtgatccacccgcttcatcctcccaaagtgctgggattacaggcataagccaccgcgcctggccagtatttgcagttttcataccttcagaggcatataataatttgaaattatttttggaagatctgtcataagccaaataaatatttgagacaacccaggacaattgttaaaattctctttagaaagaaggcagaaatttatgattagggtccaatttgccaccagtggaacacagaaacagctattaagcttattcatttttattgtcataaggacagggctggcatatcaaccaatgtgaccactataacttccaaactcattttaggtcaaatgcaaaaattgtaaactaaagttctgattagcgataaacctgtaagaaccttgaaaatgtccattaattttttaaaattatatttatatatttattattattattattattttgagacagagtttagctcttgttgcccaggctggagtgcaatggcttgatctctcggctcaccacaacctctgtctcctggattcaagggattctcctgcctcagcctcccaagtagctaggattataggcatgtgccaccacgcccggctaattttgcatttttggtagagacggggtttctccatgttggtcaggctgctctcaaactccctacctcaggtaattcacccacattggcctcccaaagtgctgtgattacaggcgtgaggcacttcgcctggccattattattattttttgagacaagagtttcactccgtcacccaggctggagtgcagtagtgcgatttcggctcactgcaacctcagcctcccagattgaagtgattcttgtgccttagcctcccaagtagctggaattacaggtctgtgcgaaaatgcccagctaatttatatatttattatatatatatatatatattttttttttttttttgagacagagtcttgctctattgtccaggctggagtgcagtggcgtgatcttggctcactgcaacctccgcctctcgggttcaggcaattctcctgcctcagcctcctgagtagctaggattacaggcatgtgccaccacatctcagcctctcgagttgcagggattacaggtgagtgccaccatgccccactaatttttgtatttttagtagagacagggtttcactatgttggccaggctggtcttgaactcctgacctcaggtgatccacttgccttggcttcccaaagtgctgggattacaggggtgagccaccatgcccggctaatttttatatttttagcagaggcaggttttcaccatgttggccaggctggtctcgaactcctgacctcatgtgatctgcctgccttggcctcccaaagtgctaggattacaggtgtgaggcgctgtgcccagccgtttattacattaaaaaaaaattttcctagccaactaatgcatgcaagatgtcagtatatattatctgatgtgcactgtgtcaggcactggaatacaaagatgggtaagaaaggcataaaatccttgtctttaaggagctcatattttaatgagaggtgtcctttttctttctgttttttgtttttgtttttgtttttgttttgagacagtcttgctctgtcgcccaggctggggtgcagtggcgcaatctctgctcactgcaacctccgcctcccaggttcaagcgattctcctgcctcaggctcccgaatagctgggattacaggtgcccaccaccacgccaggctatcttttcaggtatttataatatagttttcatatacagttacaggaatagtatgttacagaacctaaagaaaaataaagaagtattagttgaggagttcagaagtgggtttatactgtatgtactaggaattgcctgttgaattaaattaacatttcagaagtaactatttaaatctgtattgttgacactgcagtgaaagcagcgaaacgtgtcagcagatgattaagttttatggttgattttcacacttttgtaacttgggaccaatatcaagtttctgggaaaaacatccttcctctctccccaccctctatcattaaccccgggtttctgcctgttggtgttaagtgtgtccttgggacaaaggcgaatcaatcattcggttttcattttcctcttatcaatctgagaagagttacttcagtttttttcttccggagtctagaaagcgcttagattgttgaattattacatattctgcattgaaaagtctgtacgtcactcgttattttttccattcccaagaccaccagttactggaattatttctgggtgagtggaacaccctttacaagctgctagaggaggtatgcctgtccctaggttattggctttccaatgcctagtcttttaaagaaagcggcactgttcccacggaaattaacaatcattcaattcggagagacttgaaatcttaaggccgaagtggaggaaaaaactggattgttatgggttgggttactatttgagaagggcaagcgggagttagcgaatggctagggtgttaaaatgggactttattaaacgactcattacaactgcacaaaaactaaacctttgctggccccagaggattttttttttacaagcttcaaaaacctaacttcaaacaaaatttaggaaacgtgggattagtataaattcagtctgggtgcttacaagaccacctcctctgtcaccgacagtggggacaggtgtgagaattttgcaaaagcagctttcagaacaatttttcagcgctcaatggtgcccctaacaacttcgggggcggaaaacacgccaagcagcgcagccctcccctcagttgctaacctttccctttcccacctcgcctctccctctccgccgcggcctgcagccgggggggggggcgtttgtttatgtgacgtccgccgtagtaagcagtccccgcccccgtttccctctggccgccgcgtttcccgcgccgcggagcttctccccttaaaaggacaatagaggcctcgggagcgcgcgcggtcgccgggacttctccccctcccagcccgcaacgtgcgcgcgcccgtatgcaaataagttcgattcaagagaattttgtgccgggagccgcgcgtgcgcagagggaaagcggaatctacaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaaggtgagtgactctcaccatgcttctagtgcaaaactgtctcacgaggctttgatttcagtgtttttttttttctcttttcacctccacccacctccccccgtccttccacatacacacaggaagttttgtcttggaggtggcattgttgggagcgctgttttcgtgatcttcagaccccaggttctttggtacgctcgtgtttagtgtgtatttattaattggggagggtatttgaggcaaaccgaaagtctcggggcggggaagtgagtggagcctgggcataattgaggagtcgccggagttgagggatccacgttgaaggtgacaatgacttttctccgccgcagtgttctctcgcggaaaggagcccggcggccgaaaggcccgagaggaaagcgactcgttggccaccgcgcagcggccggggtcggtgcgtccgcgtgggcgcgaggcgcgggcagggtcgggcgccgttgtgaaacctcgtggtttagttgactgcagccctcggactagggtggacaataaacgccattcgctcggaaactaagttgccatccgcttccgagctggcggccgagggtctttaaatcggcctttgggggtcagtgctgggctctgccggagcgcacgcggcgtggcgttgtttgctcaactccggagggatgcggatgcgacaatgagagcaacacgcggtcgcttaaaaacagcccgtcttccactcgcctgccctcttcggaccgcgcccaagagcctctggtgtccggggtgctttcggagcccgaagttttgctcccggtgcgttcacctgtagcgtaggtgtgggcgacaccgcgagggcttcccgtttatgggcggccgtccgcgctgtaagatggccagggaagccaacttggctggagatggaggcggcggcgttgtstacgccgcgggagtcagtgaactcygcagggcactgctttttgtgctctacgtgacagaccacgtgcttcgggctgcgaccctggtccttgtccgaatgtccagccccgcgtgagccgtgggatgcggccgccgtcgggcaggtccggccggcaggacaatgtggtttgctgatgatggcgtcttgccagtttaaaaagcagagtgaaagtcgccaactctccgcccgtgcggggcggatactccgggcgtttctcatcaaggacactgcaaaactttgattaaatgggcctgctcccgaggggagggtcggggggccaggctccggactcttcggggcgcggggtccggacccctacccagggtgatcgtccagtgtccggcccctgcgaaacgctccgacatccctgatgctgcacgtaggcagcgcccggctggacagaaaacaaagggctgcatgtgcccgtgcgggcccccggcgctcggggccgccgcctgggcgtagggccgtgcaggtcggaggccctcgaagttcgggcgagtttcgggaggggcttttgtccctcagccccctcgtggggaaactttggcggcgctacttgtgcgaggtgccatgctggtgcgtagggaggcggcgtgcttccccgctccgggcgtgcgggcgggcgaccgagggaggcggcagtgcccggcgcttcagccctggcgtcgggggttgcgacggccgagggttccggggagcttggcccggactgctcggccggtttctcgtggcccgggagcctgtgtctgggaggtctgtgggttcgcctttgaagtcgaactgttgccatgtttgaattacgtcagggcaaagccatgaggaggaacaagccccggcagcgcggcgtgcgggaggcgcggcctgcgggaggcgccgggccgggctggcgcggggcccgttgttccggcgcaggtgagggaggtggcggcgagcgacgcggttcacctcccgctgccctcgccctcgccccggcgagcggcccccgcaggaactttcctcccgacgcgagatgtcttatttaccaacaaatccaccagggagcattcttacttgctggctcggcgtctctctcggcagtcaccggagtgcccgagggggaagcacgatttacggaaggtggggacccgagggccctgggaggagcggggaggcattttactgctttcagagaaacgggtgagggcggcgagcacctcctccccagccgagctgtggcccgcaagtccaggggacccagccccgacgacgcccgataaaccaccgtggggaagttccggggctccctgttgccctactaagggaagtgaggactgtgggcgaattgtgcgtgcggccagtttctttgtgtgtttctagggggtggggggagcggggaagggcaaggtttgttttggtgtagggggagttggtttcttgaggtggtagggcggtgcagtttgttctggtaactatgaccctagtcagtttctttgtttttattttcttcctgtaaccttccattacttcaggcactcggaagattaggatttactcttgagttaaacagggaccctatccgagacagttttaccccagcaattctttctcccccttcttaagttgtcctaaggagggttaagaaaagcttttctttttcttttaataatttaaaaatgaatttgaccttgttattcagagtacgctgaaagcacctgtttttgaactggaatttgccagacttgaaaagccttttaaaattttatgtcgcaaaattgaacacatttagttgcccaatctaaaagtctgggagtttgtttctggtggagtttcggagaaaaccctcatggcatttaaagtatttatataatgattttgggaagggggatcttttttaggcgaaaggtatgcgtgactcagtgtttggtggttattcagtgccttaggatgaccttgaagaagcaaatgtttagggagttgggccttttggaaacattgtaaggaggctggggagctggctggggaggaagctgctcaggaagatgacacagggtaacggctagcttcttcccagatcccgtgaactgtggttgaccttctggttacctctcctagatttttcttttcaagctaaccttttctttttttgtatgtggccccaggcatagctcaaaaattatgctggtttgacacatggatgcttctttggtatttggggtttgcctgtagtctagacatccgatacccaccaccatatctgttgcttctttcctgatttctcctgcatttgaatcatgtgtaaggcctagaatctaagtgatcattactaggaaataatacccttgaatgcccctgcccccacacacctaaaaatcgatactagttgaaatccattttttttcattattttgttattaataaacctatttttcccaagttttggttgaccaaattacaataccaaaaggcaacctatattagtacatttctgtagtaaatagaaagagcatgtyaggaaaatgaaaaactttggacctatttttcccaagttttggttgaccaaattacaataccaaaaggcaacctatattagtacatttctgtattaaatagaaagagcatgtcaagaaaatgaaaaactttggatttaataactttggctttcctttcgcagctatttctctgggtcctgtatttaaaatgcatatgaggtgctttgcaaatacgctgagattgtttgagttgtttttcttaattagtatttcatagctaagttatggctagaatttccatttcctagcagatttcatatactacatacagagcttaatggtttttgttttactaattagatgatgtaaaacagagatttggattatcaatgtgaatgaattcagggtgggaaagacccacagacaaggtctctactgccttctctttgtattgcttttgtgggaggttggagatacgaagttcaattggtagaatattctagatcactggtggacagcaggccccaagtctgtctgtccttgcacagtattcttaattctgtatatctggaacctgaatggtcaatttttttttttttcccccagagtggttatcaagtcctgggaaatcctgactcatagggctcaaactcagacatatttatgtcagagaagcaatttaagaaccattttacatgtaaaataaaagtttttcactggggaaagcataaacttttaaatctaaaccaactatacagggctcttatgaggataaattaatcaatttaccatgccaggcacatagtaggttgctttaaaagtatgtcattttcgttttttcttaagagatggtaggaatataattggttgagcagaaaaggaacacatgtattgaggcacgaagttttgctgttcagaggtttctgggttagtaatgcttgggtttcaaagctgtcatcatcttatagtcactttgtgatccagtttttttcatctgtaaaatggtagtaatacctattttaaataagttgtaattaagccagtgacatgattgataaatattagctgtgttgtcctcacaacactgggaagtagacattttacagaagataaaactgaggcctgtgtcagttatcgtttctggggaaacattaagtaaatttttagtggaaagaatgagtgtctttggtcccctcccttaccttaagaaagcagttctgggaagacactgcccttgactcttggttgtcttttcaattctgattcaaccattttacatcagaaagtcctgcggaaacctggaaaatgtcatttttctttcttcctgatttctcttgtccacaagattgtcttgtatttcccacacttaagttttgattttggggtgttataaattgagacttttttgttgtcttttgtttctccagttttttattgaatctgcaactaggatttttctgtattatggaaataatctggaaatgtcatctagtccaaaaagggagtttgttttcaaggtagggaggttttctctttgcctcagaaatactaatgtcacaggtacaccgctgttacatattcaagtatgaaagttacagttgaactaaaagaatttatttctagctttgtatttagttgttttccacctattataagtttggtttggcttactgttattttaatttggtaaatgttaactgtgctgagttgaagtagctctcatttctcatttctccccacactagtctaatttccttccccctgctcctgcttgaaataagcaagaaacattttttcctatagcttttaaaacctcaggttttttttcctgcaaaagtctatagaccaaatgttaaaaaaagactcctttttaaaaacattaaaaatatttctatgatcaatagtgcaaacaatgactcctttcaaaacattagtttttaaaattcacgtctttattgtagacaccatttcccattccatgcccttaaatatactgtttatattaatcttggctgccccactctttgagtagttagcaaattctacccgtttctgtgtactatgtacagccagcacctggttgtaatacaagacttagtttctgctctacagcggtttactattgagtagaggagataatgcagtaaacaagaagtgaaatcttatgtggtaggtgttctaataaaggtatggaagggttttgtaaaataagtaattcttaagagaatttcccaggtcaaggggatagagggtaagccgtctcaggcagaaataacagcctgagtagagggtggctagttattaaagtttgtttgacactcctagaatatcagaattccaagttgggagcagctggtaggcaggagcagatcctgaaaagctttgaattccttgccaaggagtttagatactatcatgaagccagtgttggtaccttggaagggaagattagtagttgaactttaggaagatatcacatgtttaaaggatgtagggaagtcagttacaaggttctgacaggagttcatgcaccatgatgaggaacaaacaggcagtggggatggaagtgaaggaagaaacagaatttctaaggacttcacaataaatttgatggagggccatgcagagggtgaaggaagagctcagttggcttccaagttgtttttgtgtgactgtggatgacaaccaagataggtaaatagaggaagagcagatttggagggaagattatataatcaattctcagggtatttaaagattggaatggattggtggtcagttggccatatttatcctagagctaaggggagagattggaccagggaatgaataataggtattaccaataaggttggttagtaacttcctgcgagtggattgcccaaagacagaaagcaaaatgatacctgaaatgtaagaggaaaaaaagagagaaagaagaaagattggtgagtaaaaagaattgtcagagctgagtgcataccttgtgccgatctttgtgttgatgttgtgttgatgctttacagatactattcaggagatttggatttgtcattattattttgagactgagctttgctcttgttgcctaaactggagttcagtggtgcgatcttggctcactgcaacctctgcctctgggttcaggcaattctcctgcctcagcctcctgagtagctgggattacaggcgcacgccaccaggctgggctaattttttgtatttttagtagaaacggtgtttcaccatgttagccagactggtctcgaactcctgaccaggtgatccacctgcctctgcctcccatagtgctgggattacaggcgtgagccactgtgcccggcctgtcattattttatagatgaggaaacaggattagtgaggttaaggaactttcctgaggtttgggtcaaatcaggtgtgtatactatcatgtatccattttcttaacatttttctcaagtttgaaaatgggagaacagcttcatagaggagtatatggggcttttcatgaccttaaagtctccctgaaaaggctaagttcctcttttcccacagacctgggcttaaaagaaaatctttagtaatcagaattttaccttcagttaaatttgttgtatatatcttgggatagatagcatttatttttctgtaatgtgcaactcttataaattcaaggaaataaacagaatttcccaatgttacagaagggcaaataaaattaggagtgacttcctatttagttgtaaagacagaagcagaaatatactccaaattgactcattgcagacccaagtatggttatattttctaactcataatcatccattaaaagcaaataaatattctttctgacactttcagttttttttttcatgtactggaattcctcttaatctagaattgggagacctagttttgtttctctttttttttttttcgctctaccaaaattggaggggcctggtgttttacactatctaaagcccagagacttgaatttgtaattttatttttaacctatgccatttcagttgaagacttgtttatttctgagtttgacctctttcctatataggatgagttttaggctcttctgccaagtgtggattccatagacagccacagttataaatgctttaccatataatttctcagagacagggcacatgtttgaagaggctgttggcaaacaagtggggtctgctacccctttctcagttttattctagacagatttacatttatcccttaaagttagctaaattcaggaattttgctgagatgtaggctgctatctagaagcaggtaagaggaaataatgtcttactgctccatgggtttccttaactgcagatgaaacatgtctcattattggggaatactgcagccaaatagcctagccgcgggagaatacaaagcatttagtcctgttgaccgtttgtgaaaagtgttgctccagttacactgttagtgtttactggatgctgtacttaaatgtgattaatgatagcatatgattgactaaaatggtgtcagtggtggcattaccaattacaggaactcaagtatccccacagtttgtgatcgcgagtattttttcgtgttatttcttttcctttcccatcatcatgatttctagtttggctctaaagaaatgcatctccttcacttcaaagttgtctttggttgcttagttctttttgtctttgttcactgctgcttccttcccactttacaaatctttcgcttgtctcctgtctgcagtttccttcccattctgctctgtgtgtatttagatcttaccagtctatttcgtagtctctcccatggagtgtattttctaatttgtatctctccatctgtatgtctttgaggaagtttatttaagctctctgtgcttttttagattactcttaaggtgtgtcttgataaccaaggttattggagagtgatgctcttggttaaaaaaaaaaaagcaggaggtagtaaagtgaaagtaagcttcttttatgcttgtactcctcagaggcaaccactatttactatttttaagaaccaatttaaaaagaagtttgtgtagttacagtctcattttaaaaacatcctgtgagattatactgtattactactgttcaacttgctttaaaggttgaaacagcgtgctgtggtgtttcaaccataatttaaccagtctgaaaattcgttgacatttaagtcacttcaactatcttgtgttttttttttgtttttaaagacttaggccagttgatttttagaaagaaaaaaatgataattagaagctagggttttggtttattggaaacttaaggatagtttcatttgggaggttgttcccctaatttgtgcatatcagaatttcagttcccaagatgacttggacagttgtgaagttaactgttatttaccacgtttgactattgctctcaattttcttccatctagtccacccagtggtattactgagttttgaaaggtacttttgaatattaaaaaacgctttacttctgaatatataaaaaagccagaagaaggaatctagaaagtggaattggggaagttagagtaaataatgatgtccttyaaagcatgcatgccaactaaggtgaacttaacatatgttaaattcatcgtaataagaaccctctccatatccttaaatgtgagttaacacccttataaagatttaaaaagacaagaaaatagttgaattaaattcatcaccttttctctgtctcctattccatattaaaaagggtactaaagctctaaaatttgcatttcagtatttttcattctgtttcctggttggagcttaaaatgaacaagtatttagtattgctgagatttataagagataatctttaatcttatttatcagaaaacttttcttaaatagcgtctttaatataaactatcgctgtgaaactctttttctttcctatgtatattattatattcagtaaacttatgtgtttaattagatgtaaaattagacgttattcttgatctttggcttcccaatttcattagatgggattagaattgtcccttttgtgtctttgatatattgtggttatctcatccctttcttgactcatcagcaccaaggttagattcattaagttagattcattaagatcattaaatttatatgaaacccacagctttaaagtagaagaaaaccctacaaatcagccaaaacagatgtttagaattgattgttgtgttttaaaactttatttttttgtttatatatattgtccatataattagttatctttttaaattgcttttgctgacttagctattacctttaatcttttttaactttgggatattcagtttatttggtcagagctataattatggcatggttttttttttattttttatttttgagatgaatttttgctcttgtccccaaggctggagtgcagtggcacaatctcggctcactgcatactctgcctcccgggttcaagcaattctgctgcctcagcctcctgagtagctgagatttacaggcgtctgccactactacgcctggcaaatttttttatatttagtagagacagggttgcgtcatgttggtcaggctggtctcaaactcctgacctcaggtgatccacccaccttggcatcccaaagtgctgggattataggcttgagccaccacgcccggccatggttgattgtttttaactgttacagtattaaaacaatttttgggtttttggctaatagtagtcaaagaaagaatgccagtgaaagtgctttataaaatgtaaagtgctatacaaatgacaacttaaaatttaagcaacacatttattacacctgtgaaagcaaataaaagaaaaaactgatcaacacagtcctcctctaaatttctttctggcccaggaatgtgtgtatattgcaaaaacagctatgtcagagataagcgttacaaactcccataaataggcatgttttaactgtaacctttcaaatcctgaggaacttctcaaaatgtttgtcctatttgaagaaacttcagacagcatactgtagacagatagatgatgatagatggtgtcagaagaaaagataaaactggtccaagatggctgcagtttggacatatgcataattaaaccactgcctacaaactaaagctgaccccttgggtttgtaactggagtttgttaaatattttactgacagatactggttgtaaacttgtttatcagatacagaacaaaggcaggatggaatcaatcatccttccaccagaccctaaggtgcctacacaattattaacttttctcttctacccactcaaccacatatttacttgactttaggcataacatcactgaatatgaaccaaattctcaactattgcttcaccataccgcacatattttcctgtttaaaaaatatataaagactgtgcctcatgcagtctacttcagagcacaggtaataagctactggaacttgtgcttcctgggtgcgcatcctcaagctttgtgtttgcaagcagcacattcagattcagaacacctcctgacttagtcaatctaatgagaaggtattaaaaattatggagaacaaatcctctaaatcgactaaatcccctgcaactgcagaacatctgattccacctttagaaaccccagctgggttaatatacagtacttggggtgcctcattgtgtaattacttaaacaaatggaccaggatgactgaagaatgactccacatcacaatggcctaaatgcagatcctttgatatatgcagaccaggatggaaggtgctagtgcaaaaattaagcaaccagaatggggaaactacttccagtggtatcttgaaagtagcaaaagtgggtaggatgatctttcttccttatagaatgctgataaacaacttagaggtgttaacagatagctctcaaatatactctcctattaaaaaaaaaaaatcttcagaagtacctctctttgggcctccttcaccacctacaccttcactctatcttcatctttcttttttttttgagacggagtctcgctctgttgcccaggctggagtgcaatggcgcgatctcggctcactgcaaactccgcctcccgggttcgcgccattcttctgcctcagccttcagagtggctgggattacaggcgcccgccaccacgcccggctatttttttttgtatttttagtagagacagggtttcaccgtgttaggcaggatggtctcaatcttgtgacctcgtgatccgcccgcctcgcctcctaaactgctgggattacaggcgtgagccactgtgccctgccactctatcttcatctttctaactctccaggctggatctgatttttcttcttctgccatctctttctccttgtctgccacttgttagactgtgacaggaaacacggctccaaaggcccctgctcttgttgtccttccacctaccctggcagcaacctcttgttcagaagtgacggacaggaactccacaggaatgcttcctgtggttgcctcattctgggaacagcctatgataggtgggggattcctaattctctttctcttttttttaagggattaaaacatttaattggccgggcgtggtggctcacgcctgtaatcccagcactttgggaggctgaggagggtggatcatctgaggtcaggagttcgagaccagcctagcctggtcattatggtgaaaccccatctctactaaaaatacaaaaaattagccgggcgaggtggtgggcacctgtaatcccagctacttgggaggctgaggcaggagaatcgcttgaacccaggaggtggaggttgcagtgagccgagatcgtgccattgcactccagcctgggcaacaagagcgaaactccgtctcagaaaaaacaaacaaacaaacaaaaaaacatttaattacacatatacacmcagatattacacatattcagtgcattcagaatcccagcaggatgtttgtggaaattaacaacttattctgaaattgttttgataatgaatagggccaagaatagccaagataatcttaaagaataaagttgaaagacttatcaggtatgacttataaagctgtagtaattaagatagtattagtggataatatacaattatatgaaaagaatagagcattcagatacagccccatattgaatttatgacagcagtaccactgcagtgcaataaagaaaagagtgatcttggctgcatggggtggctcacacctgtaatcccagcacttcgggaggccgaggcaggtggatcacctgaggtcaggagttcgagaccagcctggccaatatggtgaaaccgtctctactaaaaatacaaaaaaaaaatagctgggcgtggtggcgggtacctgtaatctcagctacttgggaggctgaggcaggagaatcgcctgaacccaggaggtggaggttgcagtgagccgagatcgtgccattgcactccagcctgggcaacgagagcaaaactgcstctcaaaaaaaaagaaaagagtgatcttttcattaaatggtgctgggtgatctacatatccatggggaagagggccagggaagaatctttgacccttacctttaatgccatgtaaaaatatcacaaattctagaacaattaaaatctaaatttgaaaggaaaacaaacttctggaagataataatggagattattttcccgacctggaggaaagcaaagatttcttaatcaggacgcaaaaagagctagctacaaaagaaaatgctgataatttgtactacattaaaattaggaacttaagttcctcaagactcagttaaatgagtaacagtgaacagagtaaagacatctatgaaacatataaccaccacaggtcttgtatccagaagataagcacatgactgaagaggatacctaaatggccaataagttctaggacccatttggaatcagggaaatgcttatcaaaaccacactgagataccactgaaataacaaatgactgataccaagtgttggcaaatatctgaaataaatggagccttcatacaatgatggtatgagtgttaactggtaccatcattttaggaaacagtttagcaagatctactgaaggtaaatttacacattttctatgacccagcagttctattcctagaaatacacacactcacacacacacacacacaaaatacgtaaaacaatgttgaaaacacattacttgtagtagccaaaactgaaaatgtcccaaaatgtctatcgaccctagaatggatatgctgtcacacaacggaattctatacagtgaagaaaaataaaaaatacagcatggataaatctcacaaatgttgaacaaaagaagccagactgaaagagtacattctgtatagttccaattaagtttaaaaacaggaaaaaccaattgatggtgataaatgtcagttgttaccattgggaccagggaacagtgactgggatgacacctgtagactgctggtaccatcctctttctgatcaaaagttacttctcctttgccagctttgtcaaacagctagctgaaaggctaccataaacaaagtatcaggggcacccaggaccaatcaaaaggccacacattcttgaaaagatactagtcattaaaatggaaatagctggtggatgccaccttcatcaagtgatcaaacttagcatcatcaacgctgggacaacattcctcccatctttggtctgacccaccaccccacttaaaagttccacagtctttgggttaggctggctttctccagaaatgttcaagtatggagtgataaagtcaytgggagacatgaaaaattcaccatttttctcaatgcttgcatacttcaaaaatattgttataagctcagttggatctgctctctcagttaaagccaccttggcagccgccatgcttggccctgggtccagggggctgcgggacccactcactggcttgctcatgctcggtcccagtggttcacttccagtaccagcagcgtgtgtgcccggcctgcctggagtcctgattctctatcaaccctagtcgaaggccaaattatgggccatagttaaggaatttcctgacccttatgaagatcggatttgctttaccaaagaatttgaactcmcaattaaaatctatgacccaggtcattctgacatttatcggcttgtctacatgctggtttcagctgcttaagctaaggaatagctagaaaaagcacagtgtggttggatcccctaacagatcttgttcctgaaaatccagtatgacctctgccacagccaactccccagctttcagaagatggctcaaagacgcgtgggtatgagcagcttctctgttaaatgccattcccttgtttttttcaaaagatcatagattacggccggacactttgggaggccaaggcgggtggatcatgaggtcaggagttcgaggccagcctggccaactggtgaaaccccatctctactaaaaatacaaaaatcagccagtcgtggtggcacacacctgtaatcttagttcctcaggaggctgaggcaggagaattgcttgaacctcagaggcggaggttgcaatgagckgagattgtaccactgcactccagcctggcgacagagtgagactctctcaggaaaaaaaaaaaaaaaaagatcgtagattagattaaaatccagcgatgctgccagaatccagatgggcctgttgtagatttttttacccactttgataaaacatgaaaacaatattgcagatgtcaatggacaactttgaaaacaataaaaatgacatattattaaaatttcccaaacaatttgggtgatgcactacccactcttgtcaaatgtcacatgactgactaggtgatggccagaactaatgactggtcaactggctgaccagttgtcctgcacaatgatgaaaaaggaaaatcaaaaggctgtacacttaacaatggtaacacttaacctcttaaaactcccaggctaggaagtcttggtcctaagaactcttctccccttgtctgtcactactacaagaaactaggcattttaaaaggaattgcaggacattgaaatggaaacaggatgataaactggaaaactaggactcctctgaggaaatagggggttttcatttctcccaatatgctgctttaactcactctttgggagaaattaacacaatagtaggcacaggagctcctgtatcagttataaattccaccttacttgaaaaccccatttctcagaggaatgaaaaagttaacatggtgggtatacctaataaacccatcccttgctttaagttcacatctttgctttagtggttcattgggtttggcttcctcccaagggctgtgaatgtgatacccttagccaatcccatgttttcctgatatgcccagaagtacctgtttaaccttctggattgaaatttccacgacatccataatgctcatctctttttccttaaagtgggaaatgttgctggaactgaaatcatgggattggggaaagcaaaccaaaaaatgccctcataatatatcacaagttggccgggcacggtggctcacgcttgtaatcccagcactttggtaggctgaggcaggtggatcacctgagctcgggaggttgagaccagcctgaccaacatggaaaaaccccatctctactaagaaaatacaaaattagccgagcgtggtggtgcattcctgtgatcccagctactccggaggcttaggcaggagaattgcttgaacctgggaggcggaggttgcggtgagccgagatcacaccattgcactccagcctgggcgacagagtgagactccgtctcaaaaaaaaaaaaaaaaaaatcacaagttgatgttagtggtgtaaagacaccttcatgtgattgggaaaatgagaaaacaaaatgaaatataataaagggaaggaaaccataaggctccttttaaacttcaacttttctactaatgccagaagctaagcttttacttgaaactatttcttacctgctgtggtcccagtctaacataggcataggaaagatactctcagctactccaataaaggttgagattaacactaagaatcccttgcttaacgtaaaataatagccactatggcaagaagccatagatggagttgccccaatcatgagattatcttgagagaggttttattattccctgcatcagtccctgcaacacccccattttccttgtcaaggaaccaaatgggaaggggatggagatttgtacaaaacttacgggctgtagacagtattataatacctagatatccagtgcttcttaaccttcatacacctgtctgccataccaaatatcaaggatgatagtgttctttttttttttttttttttttttgagacagaatctcactctgtcacctaggctggagtacagtggcacaatctcagctcactgcagcctccacctcctgggatcaagtgattctcctgcctcagcctgccaggtagctaggattacagatgtgtaccaccacacctggcttatttttgtatttttagtagagacggggtttcatgatgttggccaggctggtctcgaactcctgacctcaagtgatccacccgcctcagcctcccaaagtgctgggattataggtgtgagccactgtgcctgtccctgacgatatttttcagttgcggatctctgtagtgcctttttaaagcatccctatacatctaggtagtcagtatttgtttgccttttcctggagagaatgacggtatacttggactgtgatgtcacagggatatacagcgccccacttacttttcccaaatactgaaatatgaatttagcagactcggacttctctcaggggatcctcatccctcatccagtgtatgcatacctcctcctttgctctgacacactttcttcctctgaagaagaaaacttgtacttacttcaacaattgaccattacattaagggtaaactttaattttgtctttctcaagtcaaacatgtggcacatgttatgtcagccaaaggattgagcatcaatcctgatagaatcaaaggaatcttagcttttttgatgcttcctactaaaaaatagcttagagggttcttggagttggcctgctgttgtggaagctggatactaaatttttattgtgtgactcaacccttttgtacctgtttaaagaatgaccagcctgatcccatcatgtggactcgtgagggacagccagctgtgcaacaaattaaagaaagattagtaggccaggcgcggtggttcacgcctgtaatcccagcactttgagaagctgaggtgggcagatacttgtggctaggcgttcaagaccagcacgggcaacatggtgaaaccgtgtctctactaaaaatacaaaaattagccagatgtggtggcaaaatgcctgtagtcccagttacatgggaggctgaggcaggagaatcgcttgaacttgggaggcagaggttgcagtgagccgactgcattccagcctaagtgacagagcaagagtctgttgttgttgtttttttttaaaaggttaataaatgccccagcaataagacacccaaactatgaactttctctctttctgttcatgaagatggggggaacacatttggtatgttgactcagacctataggctattatagtcagcagttagatccaatgactcgaggatggcccccttgtatgagggcaatatcagctatagcccttctatataaaactgttggagagatagtcatggggtcctctcccttactgccttcattccgtattcagttgagctacttctgaattcccatcataactcaacacttgtctttcaatagattaacttcctattaggtcttaattttattatcctctaatgttaccatctcgttgcagtaatcctaaccttgccactctctctctctctctcttttttagacagggtcttgctctgtcacccaggctggactgcagtggtgtgttcacagctcactgctgccttgacctcctgggctcagttaatctgcctgcctcagcctcccgagtagctgggactacaggcttgcaccactgcacctggctaatttttatattttttgtagagacagggcttaccatgttgcccaggctggtctcaaactcctgggctcaagcggtctgcccaccttgagtggcacttgtggatctctagtgcctttttaagcatccctatacatccaggtagttagtatttgtttgcctctacctggagagaatgacggtatacttggactgtgatgttacagggatatacagtgccccacttacttttcccaaatactgaaatatgaatttagcagaccacaaagtgctaggattataggcatgagccactgcaccaggcctggccagtcttctgataagacctctcattacttcatcctgatgacacacccaactttttaccccaaggacagacctacaagaatcaccactagataatgctaagacagaatggtttacagatgtatcttacttgaggggagaaggtggtaaggttaaagcaggatgtgccatggtcattgaagctggtcttcttcaggctaagtcagcccaactggctgaactgattgccctgactcaaacttgttaactagcaaagaataaagtagcaaaaattatgcccctatgcatctgatggtgctcatgactttggaatgctatggaaagagagagggtatttaaccttctcagggcaacccgtaaaaaaatggactagtcttggatctcgcttttggcaattataaaggttccaggctgctctgaattaaacacaacacagagtcaaggtaatcactttgctgatgcagtagctaagagtgctgcatttgagacaccagtccgatccttggaatgactgtgagacttaaacagttaaatctacgctaaaggaaacccaagacttagctttcatcgaagaaagatctacctggaaacaaaaggggggggtacttttcccgcaaactgaactatggtatggacctaatgataaacccattatcctagtggggtatcagatacccctcatggaacacatttacagcttgacccattggaattcagataaaatgatatcctattataaacaatattattggagactgtcatcatggcacagaagattgatttacagtgtaccatctacccaaaacacaatcctggaaaacccctttatggggctcaggatcattttctttttctacctagaccttttgagatgtggcagcttgattttatctagctgccaccatcttaagcatataaatatgtattggtaatgatatgcatgtttttgcattgggtaatgcaattgcccatcctgctgatgggcaatggtagtgggtaaaatcttattaagggattaccccattatggggagtccccttttgaacttcacagcaataggggaacttattttactgcccaggtcattgagcatttgtaaaatttggggctgggcgcagtggctcatgcctgtaatcccagcacttgggaggccgaggcgggcggatcacctgaggtcaggagtttaagaccagcctggctaacatggtgaaatcctgtctccactaacaatacaaaaattagccgggcatcgtggcgcacgcctgtagtcccagctactcaggaggctgaggcaggagaatcgcttaaacctggcaggcggaggttgcagtaagccaaaatcatgccactgcactccagcctaggtgacagagcgagacttagtctcaaaaaaaaaaaaaaaaaaaaattggcctatatttccgtattttgattgtgcctaccacccttagttcctctggattggtagaatggaacaatggaataataacacaattggctaagtccccggattggtagaatggaccaatggaataataaaaacacaactggctaaatttatggaggcttttcacctctgctaggctgaaggcactccccttggtattgctcaacctttgatccatccctttatcagctctcttctcatgaaattgtaactggaagacccaggcacatgggaatcaagatgactgatacaaatttactgaatggggacatcttgcactgttgtaagggacttgttcaccagctcatgaaaagccagaccttagtgcaagacacgtcccacagtgcgctcctgggagatgaagattctggtcatgacctccaacctggaaattttgtctgttggaaaagacatctcataaaggactccctccagccttggtggaggggcccttaccaggtatcgttgactaatccatgcacagcagagttaaaggttgtagactcacggatccatatctctcaccttaaaaaggcacaacttcctgaatggaccatgactcccaccaaagatccctgtctctgattcaccaaacagcttcaaccctgaaaccaggacgagaagttgacaacatctgagtggacagctaattgacctaagacttcagaccaggcctgtatgatctcctgtctaaacattcttagagtattatatttactttggggactattggccttgtctgctttgactcagattataggatatataacctggttaatgtttctgtacacatgatggccacctatgtatatacacttgacttttcagggtctctgctggggatggaaaaatagttcattagccaaactctcctaaagtgtggcagatggaggcagtctctcagattgctggatttgtcaccagcttccaagggccattcaagatcattacatgctacttgttgcaccagagattgatttttctgacactccaaatgttaccatatacttacatcagttccctccaaatgtcactttccaaattcaaattcagcttctaaagccaggccatattttcattctgtgcttagtaataagccctaagtctcacccttccccaccgcccccaggtctatctatcagtaagccaattagggacaaattctctaacttatctagaacacaaacttaattcctcatcttttccaggtccctgcacattcctggcctcccaccgttactgtcataactggcaactgaatgtccaaaggagaaaaagcaaagcagattgtgccagcacgtctcatttgttatatatcatgcttatgcaggcctttgtaaggcctgcagtaaaaccaatccatggctcactcatgttttaaacaacttacctattcaaactattatgaatgaatagttaagagatacattttggtatgtggcattgggccacacccaccaactcaaggatgggcacatagtgtaaatagctggcaaaatagctggcaaattgaagggcgctttttttttttttttttttgagggagagtcttgctctttcgcctaggttgtagtgtggtggtgtgatcatggctcactacagccttgacctccctgggctcaggtgatcctcctacctcagcctcccgagtagctgggacaaggagtctgtgcagtagctcacagtgcctgttgcacttacatcgacacctcgggtgaagtagagacttgcacagaaagaatttccaagcaagctaaatggttacaagaggcacaaactactgatcttctcaatgatctatttaattggcttcctatttcttccagtctgcagttcaacccctttttcatgggtaaagtgccgacgtcataacaaggtttgagggaggcacatctcacacgtgtgaatgcccagtcatcacacttacaaatgacaaaaggatctcaaaccttgatatagtctctatcctacttctcttactatcacttaaattactcatggtatttataaccaacttacgtaagtctattgctaaaaccagaattataggtcaggtgcagtggctcacactcaatcctagcacttgggaggccaaggtgggaagactgcttgaggctaggagtttgagaccagygtgggcaatgcagtgaaaccctatcttgataaaaaaaaaaaattaacaccctccccgcccattatggtagcacaatgtagatagaattatcctgtaagcgtagcagcagattctactacatacccctggagtgtccacctcaggcctacatcaacctcatctcacctctttccctccaacgtgggacatgacttcctgggaatgagccttcccaatgcagaaggacaaaaggacatgaagtatgatcatttgtgttctctaaagagaaattttgatcaaaagggggaaaatgtggaaatacaaggaaaaatgggttgacacagcctcttctaaatatttgttctggctgaagaatgtgtacgtgcaaaggcagctatgtcagttagatcagtgttagaacctcccataaataggcatgttttaactgtaacccctcaaatcttgaaaaacatcttgaaatgattttttttttctatttcagggaccttaagaaaacatattgtagatagacagatagatgattgatgatagtgtcagaagaaaagagaaaagtgagccaagatggctgcagtttggacatatgggtaataaaaccatggcctattaactaaggctgaccctttgtgcatttgtaactggagtttgttaaatattttactaacaggtactggttgtaaacttgtgtatcagatatagaacaaaggcaggatggaatcaatcatccttccgccagaccctgagatgcctacacaattattaatccttctctcctacccgctcagccacatacttactttaccttatgtgtaacatcactgaataccagtcaaatcgacaagagtgtaattgttgcttcactgtactgcaggtatccccctgtttaaaaaaatgtatgaataccgtgcctcgtgtaatctgctttgaaacacaggttataacctrttggaacctgtgcttcctgggcgcacatcctcaagctcggcctgataaactttgtttgattgagattcccatcttggtctctcaatttgggttgacacagctagtatgagactggcatccgagatgatgagtttacaaagatgataaagacaagtgaattcctaactcagttatttttatttttaaatatctcaaaaacaggcttactgagatctttcacgtaccataaaattcactcatttatataccataagattcactcttgtaatgtgtacaattcagtggcttttagtatactcagaattttgcaaccataccactatttaattttagaagacgaatgacagttcataatcagtattttaagtttttcttgatttttggctttatctcacagcttaattttcctcttctttccccaaacacatggttaaggatgagattgtatggggtctgttctcagctgtaactattaatcaattagaaagcagatagtattacctttcttcctttaaaacatagtgcygagtgatatgatgcctatgagaatagaggcaaaattcacagatagtttcatagctgatggtgtcatttgaacaaataagatagattgtactggaggaatcatttaatattgcacaaatttggtactaggaaagcagtattctaaagaaccaccagattgcttgaaaaaacaaatctccagtttaaaatcaagttatgccacgcccacccagtactttgttaaatatataaagtaacytggtttcagagaccattttatgtccttggttttgctctagggattaagtagtgttttttttttgttgtttttttaaacatttcatgggtttgtagatttttggaaataatttcagttaatctcagggcttcccaaaccttgaaatggttaaacaccaaccactgcttaacttggttgttgtaaacaaagcccgaaatgaaacccctgtgtatttgctgcagattcccaggtgcctcttaagtgtgaggataagctcagaaaaggcttaataggtttattaagttgtcatccattaaaaggttcacatgctccttgtgtgttgcataaggacaggtgtctgccacctcattgcatttctcactgagcattgcctaggagagggtaagccctaggatttagatccctctcagatgttcaggcagaataattttgtcaggacaaaagtaaggtcacggaactatatgaaaatggattatgaatcctaagayatcagcctattctcccctatgtctaagaagaatattcctcagcttatgactggaatgtcttgctaggggtgctgggtaagttttgtggaggtccccaccagcagaaaaaaatcattgaagaggaacacttaattcacaatggctgctgattaaaaagaaagcctcaatattcacctataaccctaacatccttaacagcttagcagtgtggtaactggcacaaactatggcgtcttggtcaaatccaacctcagtgaaggtagttcacatcctagagatgagctgaatgctgatagctttgaggacttgtttatttgggggaagggaaagagatggtgagggtagagataggaatctgtctgtcgtaataggatttggtctgtgtattaatggaatgaactggccttttttgctctgcttcttttgtccttgctgagaagggaggctgaagtttccaagagttatggatgaagttggagagtattagaggaactgttctctgaccttcttgatggtaatgcaagctgttgggcgagtttggagaagagcgcagggtggtgtgaggacgagggccgtattaacattttgccttaaaacaggaatacacaaattaaagcaataactgctactctgctttcttgtttctgcaatcttctgtcatttgacattgttttttccaaagcaacatgcgaccattttcttcaggattttcttttcagttatcatatgggtttgttgttggattgagaaaaaaaaatctgcctcatttgagcaggcctctctagatcttttcttatgactgtgtagagggtacttcctcatttttcttcctctcaaagacatcaaattcccaagcatttaactaaaattattatcaactaaaaatgttttttttaaaacagttcttagaggtaactgtttagacttaattattgaaatgcatgaaggccttctgccttgcccccatcccactcttttgcctgcctctctcaccaacaaaaacatggcagaggaacagtttattaacaatagcctgtttgaaagggaagcttcagtttttagctaattatttgctaataaaagttttaaaaaaattttcttttaaaagttgtaaaacctctgtctatatttcaaaacccctcaataccaaaaaaatacacataaaaagcctggatatttggttctgaatcattttcattaatacttgctatattatactaaccagaattggaatggaatgggatcagacgagataatccaaagacaaatacagccatatgtcacacaaggacgtttcggtcaaccacagactgcatatatgatggtggtcccaaaagattatgataccatatttttttgtaccttttctatatttagatgcacagattcttaccattgtattacagttgcccacggcattcagtaccgtcacacgctgtataagtttgttgccttggaacagtaggctatcccatatagcctaggggtgttgtaggctattgccatcttggtttatgtgaggacactgatgtctgcacaaggatgcccaatgatgcatttctcagaatgtgtccccattgttaagcaacacatgactgtactgaagctttaggtttactcatctaagtttatttctaaaacaactttaaaaagatagtgttctgtggtaataactcctaaaactatggacacgaaagtgatattaataattttcttggccgggcacggtggctcacgcctgtaatcccagcactttgggaggccgagacgggtggatcacaaggtcaggagatcgagaccatcctggctaacatgctgaaaccctgtctctactaaaaatacaaaaagttagccgggtgtggtggcgggcacctgtagtcccagctactagggaggctgaggcaggagaatcacttgaacctgggaggcagagcttgcagtgagcctagatcgcgccaccgcactccagcctgggtgaaagagtgagactctgtctccaaaaaaaaaaaaatttttttcttttattgttgctttatgtgataattttgtgataatttatagttagaccctcatacatacacacatcctctgacttgtccattggagtttagtttctatattcattgccttttcatcacctctcttagtccggttgttttggtgagctggcccttgatttggatattccaaattacttttcctaaggtacagatttactgccagctacatatttgcatccagccccagagctgttttcattccttccttgacgttgagattttttttttttttaacaggaggactgcaatttatttcactctacgtctctgggacatttgcctcccactgttactactctcaggcacaaagccttgtagaagaggtccacaaacctctaacaactaaggggcagatcagcggtcagacaacatgagctcgttctttttttgtcttaatgataataaggaattattattattaaattctaaccttggatttttgtgaattttacatcttcccttcagcagtttcaattcaggggcaaacttgactgcttagaacttcccatttatcacagaagaaatcccctctgaattcccattaggcaaagtagtatgggctgatgcatagtgagctagttgtgtgcttagtatcaaatagtattcatggtaaatgctcaaaacttccccagaggggaatcacgttaatgcaaatgtgcaaaataaaaagrtgtgtcttaaatttaaggatgcatccttarttgtgtacagcttcattattttacaggattgtttgtggcatttcttacttcaaaacctgattttaaaaaatgcttctcttccccatttttagattgcatgtttgttaggcgagttaggaggtagtagagtcctccttaaataactaggcttttctttgtgttttatacgcttgccttgatagtgccaagaatggaggtcgatccaggaggtcttcccttgagctgcctgcctgtcttggtcatataacaccaagttgcttgggggtggggtggagcagagagaactctttaatggttccttgttacagccctcaacaaagatatgtcaattcccttggctttacagactatygcccagaagaaaagatgtttggttttcacaagccaaagatgtaccgaagtatagagggctgctgtatttgcagagctaagtcctccagttctcgattcactgacagtaaacgctatgaaaaggacttccagagctgttttgggtaagatcacctgatgtttgtactattcttagagtgaaaaaataccacagcatacagaaatatttgtaagcaaggtgattggaacaatgtgctaataataaaaatcacttattctaatttaggctgtgtaagtctcctgctttttaaatgaatcaaacaatgctgacagcctacttttttccagattatgaggagctaccacattaatcgtgaagccccttaaagttgtagctagacaaacccttttgttgttgacttccttttgtggttaatttttaaaaaggcttttaaaaaaattacccttgactgggtgcagtggctcacaccagtaatctgagagcattttgggaggccgaggcgggcggatcacgaggtcaagagatcgagaccatcctggccaacatggtgaaaccccatctctactaaaaatacaaaaataagctgggcgtggtggtgcacacttgtagtcccagttactccagaggctgaggcaggagaatcacttgaacccaggaggcggaggttgtagtgagccgagatcacgccactgcactccagcctggcgacagaatgagactctgtctcaaaaaaaaaaaaaaaaaaaaaaaattacgcttgaccgggtgcagtggctcacgctagtaatcccagcactttgggaggctgaggcaggtgggtcacttgagcccaggagcttgaaaccagcctgggcaacatggggaaacccatctctacaaaaaatacaaacaaaaaactcaccagacgtggcggtacatgcctgtagtccwagctacgtcggaggctgaagtgagaggatcacctgagcctgggaggttgaggaaatgaagatactaaaataaaaataaaatttaaaaaggcatgcatggttggcacagacctttttgacaccttcagaatagttaaaaagtccaggattaacaataaatgatcaacaaatgttttgataagaaaaagtggtgaaagtaatttctaacatgggaaatcattctttttttcttttcttttttaaagagacaatgtcttcctatgttgcctaggctggagtgcagtagctattcacaggtgtgatcattgtgcaccacagccttgaacttttgggctcaagtgatcctcccgtctgagcctctcgagtagctgggactacaggtgtgcaccaccttactcagcaatataatcgtttgtttgtttgttggtttgtttgagacagagtctcactctgtcacccaggcagaactgcagtgtcactgtcatggctcactgcagccttgacctcactggcctcaggtgagcctcccacctctctctcctgagtagctgggactacaggcatgtactaccatgccctgctaatttttctatttttttgtagatacaggattttgccatgttgcccaggctggtctcgaactcccggctgcctcagcctcctaaagtgctgggattacaggcataagccacctcatctggccattttcattttttaaaactacagtgcctctctggttttgtttgctgcgaaactggaatattatggcacattattttacttgccaaaggttagcattttgatacttatgaaatatctacacaggccgggtgtggtggctcacacctgtaatcctagcactttgggaggccaaggcggacagatcagttgagcccaggggttggagaccagcctgggcaacatggcaaaaccctgtctctacaaaaaatacaaaaattagccaggcgtggtggcacgtgcctgtggtcccagctactagggaggctgaggtgggaggatcacttgaacctgggaagttgaggctgcagtgagccataatcccaccactgtactccagcctgcgtgacagagtgagatcctgttcacccccacgcccccaccaaaaaagaaatatatttacacatttcaagaaagattaattaaacagcaatgtttaaaaccgtgataatcagaatctcttttaggtcttgagttttactctttaattttaaaagcatttttttaaattaaattaaaaaaaaaaattttaaagtagagatggggtctccttgtgttgcccaggctggtctcgaactcctgcactcaagtgatcttcccaccttggtcttccgatgtgctgggattacaggtgtgagccaccacaccagcctatttaattatttaattttttttttttgagatggagtctcgctcttgttgcccaggctggagtgcagtggtacaatcttggctcactgcaacctctgcttcctgggctcaagcgattctcctgcttaagcctcttgagtagctgggactacaggtgtgcaccaccacaccaggctgatttttgtatttttagtagagacacgggattttgtcatgttggccaggctggtctcaaactcctgacctcaagtgatccacccatctcagactctcaaagtgctgggattgcaggcgtgagccaccgcacccagcctggcctatttaattttaaaagcatttcttatttcaaaataaccaaattgccgtacatagaattggtttgttgaatctagaagataattttatttctgaaatattctatagaaacaatggaatgggatcatccaggatgattaaattgtatctataaaccatacatagatacagttttttccccaaaagaaatgtgcttgcatgaattctttaaggtaagggagactgataaaggtttgattgttttcttatcagattgcatgagactcgttcaggagacatctgcaatgcctgtgtcctgcttgtgaaaagatggaagaagttgccagcaggatcaaaaaaaaactggaatcatgttagtccatctttcttttttctcaattatacctctactgtatttaaagtaacattaatttccccctaatttaggaagtaatatatccctagggtagaaaagtctgaaaagaataaagaaaaacactagctgctgttcagatataatggcctaacattttggcatctttagaacagaatagcctggtgtggcatttccttaaggctgtatccaatatcccccttctggagattcacagtaagcattcacctgtttttaggcttaactcagtaattcccagagttaattagacatgaattctttttcttaaatctctttggataacatgatcctttgaactcaggttggtactaatgaacatgtagatcagacttgaatttgaattttgcctttaccacttactagttgtggattttgggcaggttatatttattcatgaagtgcaaagataatagctctcttacagagctattgtgagaactggatgagatggtgtatagaaagtataacacagttatcgttcacactagccttacattgtcctttgatgacagtgttatgttattataataggtcatgattttgaagatgataacaaccttcctttttacatggggtagaaatctgcagctaataaatgtgaatgaatacctaagaaacaggaccatatggggcgagatcaatggctgggctagactgtgggagaacatgctattgctgtcgtgtaactcacctcagagattaaggtgtaaagtgaaaaaagcataaagaataggcctgaagaccttgattccaatcttctcccctctccacccctcttacccatttactcgcttggtgaaataaggcaaaatgcataatttatctttgccttgttttccttctgtctaaaattggagtaacaaaagtagctctattttttgctttgtactaaatataaaaagtatatgaaagcttttcgtaaactgcaaaacattatcctgtagaaatggagttgtttttaggtttgattcttaacctagctgggtcatccagtaatgattatcccatatacaaatctatttaaatttttttccaatagactcccactattacccacttcacaggaaagaatatctttaaaaaccccagtagataaatattatttattcccttatgtcatgtgatgattaaaggtgcacatggagcttcatcctcttttcagtataaaactgtggttctcaaataggcacggatctgaaccaaagggatacactggtgtcattttaaaaatattattaaatattcagtattttcttccaggtggtagatgcaagggctggacccagtctaaagactacattgaaaccaaagaaagtgaaaactctatctgggaacaggatraaaagcaaccagatcagtaaactgcagaaggaatttaaacrtcatagtaagtttgatattacaacattagtacttaataattgttttgttatttttggctgggggtggtgtatggcatgtgtggatcattttttcctttattgctttttataaagagcactggaaggcaacgttgacttggtagagatgttatcttatttctgtgaaatgttggcactttttctgattttgatgtctcaagagagtatttctactagctaaccacttcagattgtactgagaccaccctgatgtctttattgacatcttaattttctagaaggtgcatttctagctcatttacttgatttttatccataaggaaattgagtcctgcagatgtgcaagaaggtacgtaaaggggacaatctgagaccaaagtccagattttctggaaagtaactttagaaatcataacgcacatattgaaattcagccaacctcagggcttgctttcaggtttaaggggcagtgtgtgttgtgtgatagaatgagaaaggaatgtctaattaattaatgtcaggtcacatgctattattggaagttttggggggttgctgtaatggcacatctgtattttggaattgagattttagattttgaaaaggaaatacactgcatataatgttattgtctaataaatatctctattacccttggggtttgaaggagcattattgaaccaaacacattagtatttttacagcaaaaagtagcagtattcacatttagtggaataaatagatggtacataggctagtcaggtttgtctgcttatagtcatagtttaggtcatgccagattttgtggccaaataggttaggaatatactttctgtttccagagctttctcagaattgcggctaggggttgtggatctctattggagctctcagtacttttaaaaaatctatagggccctgttagagagaacattatcaatcaagacatggttatcatgcttgttttagaataatggaaaaagacatctaagtttagtgacggtaaagtgaggagtgcaggagaactcaacattttttgagcattttggtatactaagcactttacatatgtaatctcagttatttccatcttagagctcagaataggaggcacaaagaggtgatttaaacttgatctgggccacttaataagtggtagagatgtaaaatatttaggaaatataaatttgtatatgtattttaattatacacttacctttcctaaccagctctcaaccccccatctccctaaagatttaactctaccttccattctcactagatattttcttttatttcttttttttttttgaaacagggtctcgctctgtcacccaggctggagtacagtggtgtgatcttgggtcactgcagcctctgcctctggggtacaagcaattcttgtgcctcagcctcctgagtagctgggactacagacatgcaccaccatgcctggctaatttttgtatttttagtagagtttgggttttgccatgttgcccacgctggtctcaaactgagctcaagcaatccacccacctcggcttcccaaaagtgctgggattacaagtgtgaaccatcacacccagtcctcactagatgttttaatgaacatttgggaaacattaattttcttttatcacttgaaggccgaggaactgattattcatatgtatattcttagccctttcccttaattatagagaaagtgatatctcacttttgtcttacttaagggaatattcagtgtaattttagatttttattatgaaactgtgctgtgtagtagttagagactgaaaataaattcctttgataataaggtgtgtagattgtggaggctcagactgaaacagggtgttcaccaggtacagtataaattgctggcacctttgtgcattgaagcagttgggaaacatgtgaatttttatatatcacccactaaatggtctgtgcttctggttatgtgtttgcttctgtgtatcctgcacataccaggcctgtattctcttctttctttctttttttttttttctgagatggagtcaaacttgctctgtcaaccaggctggagtgcagtgcagtggcacggatctcagctcactgcaacctccccctactgggttcaagcgattctcctgcctcagcctcccgagtagcygggattacaggtgcatgccaccacacccagctaatttttgtatttttagtagagacagagtttcgccatgttggccaggctggtcttgaactcctgacctcaggtgatctgccctccttggcctcccaaagtcctgggatttcaggcgtgagccaccgtgcccagccctgtattcccttttcaagacattttgtggtgtactgaaaaggcattggacctagagttacagatctggatttgaatatcagctcttgtcactagcaaatgtgtaactctggagtcacttgacgtttaaccataattttctaatcagagaactggggataatcaagtaaaaaatggctttgtaaaacaaaataaattcgtctataaatgttagctattctttttgtgtcatccttttcaaaatctgcagtgatttctgcttactataaaatatggttgagaattcctagaaagtgtttgaaggtcctatttttgtttgagctgagtcagttcctggagtgtttttggcttccacagctttgctcattgactttgcccattgtccctaccgacttgatgccatctaatcactccttggtgccttctaaatcctacgtaatttttaagacttaaaattgcagtttgggctgggcatggaggcttacacctctaatcccagcactttgggaggccgaggcaggtggatcacctgaggttgggagtttgagaccagcctgaccaacatggagaaaccccgtgtctactaaaaatacaatattagctgggcgtggtggtgcatgcctgtaatcccagctacttgggaggcagaggcaagaaaattgcttgaacctgggaggcagaggttgtggtgagccgagattgtgctattgcactccagcctgggcaacaagagcaaaactccgtctccgaaaacaaaaacaaaacaaaacaaaaatggtcagataattgaaatttcaaatagtttaaagatattaagcacttcctaggagagtgagttttcctcagcagcatagaggtgtctgttgatgttaattatttaggaagtcttaaacatcccactagactcatttttttaaaacctgctactcttgaggattttgtttgctaagttaacatattaaaaatactaacggggctttcttttagatacctaattttatgctgttttatgtaaatatttgtaaatataaaatatttgtgagctctattcagaaaacgttttcttgactgggtgtggtggctcacacctgtaatcccagcactttgggaggccaggagttcaagaccagcctggcaaacatggcgaaatcctgtctactaaaaatataaaaaaattagttgggtgtggtagtgcacacctgtagttgtagctactcgagaggctgaggcatgaaaatccaagaggttggaggctgcagtgagctgagatccagccactgcactccagcctgggcgacagagtgagactctgttttaaacaaacaaacaaacaaacaaacaaaaacaaaaacattttcttggctaggtgtgaccatgcctgtaattgcagcactttgggaggccgaggtgggaggatcgcttgaggctaggagctccagaccagtctgggcaaataacgagaccttgtctctgctaaaaattaaaaaaataaccagccgagtgtggtggtgtgtgcctgtggtcccagctactcaggagactgagacgggaggattgcttgagctcaggaggttgagactgcagtgagctgtggtcatgccactgcacttcagcctgggtgacagagtgagatccggtctcaaggaaaaccaaaagataaaaataattaaaaaaaaaaaaaaacccaaattttctttagtctgtttctttccatgcagcatgtaacataggatttgatgccttataaatatttaataagtacttgattggttatctgaatggaaggattgctctgtcaacgtgtcctgggatgggcaaggtgtatggtaggccccacctgtgtttatgaggtttatgatactgctcttgctgtgacgtggcagtacaacagccttatagcacaatgactgttaactaagaaacttattttctggcttgtacatttatctgacatcttcacataaacaggcaaagtattaaatcagggttagctctgcatctaatgaactgcctttattccttattaaatcaggatcttttgttttctctttataggtataatgtcattattctttggctgctttcaagatttttctcttggtttagtttatagaggcttaattatgacgtgttttggcatggatttctttgggtttattctgttgggctttggttagcttcttgagtcttaggtttatgtctcgccaaatttcacaagttttcagccactatatttgagtactttttcacctctattctctttttcctctccctccaggactgcaatgacatgaatgtagatgtatgtttgactaagctccacaggtttctcctgctctgttcatttgttttctgtgtcgttcatatggggcaatttctgttgttctttcttccagttcactgtttgttttctctctcccctccatgttgctcagcccatccactgtggtttttattttctttattgtatttttttcagttacaaattttccatttattttttccttatagttttctatcttatttttactgaggcttcctatttctttgccaagcctatgttttcatttatttcaaacatgttcataattgctcactgaagcatttttgtcgtggctgctttaaaatcttggtcagataattctaatgtctttgtcatcttagtgttggccttttcatttagtttgagatcttcctgattcttggactgatgtaattttttattgaaacctggacattttcagattatgttgtgagactctgggtcttatttaacccttctattttaactggcttttttgacacccctcagggcagggaaagagggaggggcctcaccaccctattaccgccaggtgttagaattccagtttctctctcaacctccattgacatctgaggttggggggagggggaggctccttgttactactggatgtcaggagagagttcaggctaccacctggtgagggtggccttgtacttagtgggccataatgaaaatcctgacttcgctaggcttcctctgacaccaccctggtataggtgttggggtgcttcctaagtcttgtgagggtggaaatgtaggctcttcacctcagcctctgctggggttaggaaaggtgtccacagttttttccgtgggtttggctggaacaggaaggttagtgttcagaaatgttttctgtctggctaggctgcccttttcctagttctttgctagagagatcaggttttaattggggttttggatttttgttttgttgttgttgttttgattgtctgtacacattggcatttctgggtggctgctgtttcacttccaaagctggggattatgaggcaaaaggaaaatccagaaaaactaaggaacctaccaccatggcttgccttgggtcttgagctccctagatgatcatcaccttttggagtctcaggtttgttttatatataatatccagggattttagttgtataagcaggaggaataggaagtatgtctattccatcttcttcacttctttaaaaaacacgttagtctgaatatcttcaaatatcagtagtgcatagaaaatgaattattttttactttttcttttttaccaactctttcacagtgtcttatgctgaggtttagttgcaattacatgtaatgaaattgaaaattttattttttctcttaatctttattgcagattctgatgctcacagtaccacctcaagtgcctccccagctcaatctccttgttacagtaaccagtcagatgacggctcagatacagagatggcttctggttctaacagaacaccagttttttcctttttagatctcacttactggaaaaggtaaaagaaacaaagtatctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaattgattcaggccaggtgtgatggctcacacctgtaatcctagcattttgagaggccaaggtgaggggattgtttgagcctaggaggttaggtttgcagtaagctatttttgcaccattgcactccagcctggtgataaagcaagactctatttaaaaaaacaaacaaacaaacaaacaaaccacaataggcaagttgtactaaacatccaggaacagatgattggagcctatgcactggcttttccagactatggataaaatagggcataggccccaagcatttttaaggctgatataagtttgataccaaaacaaatatatcatcagccactagggttattctaggtatgtaagattggtttgaacatgagacgatcaactaatataatttaccacattgacagtttcttttttttttttttttttgagacggagttttgctcttgttgccaagctatagtgcaatggctcgatctctgctcactgcagcctctgyctcccgggttcagtgattctcctgccttagcctcccgagtagctgggattacaggtgcatggccaccacacctggctaaatttttgtatttttagtagaaaaggggtttcaccatgttggtcaggctggtctcgaactcctgaccttaggtgatccacctgcctcagcctcccaaagtgttgggattataggcgtgagccaccgtgcccagcccacattgatagtttctaaaggaaggtgttgtcttcttagtggtgcaaagaaggagtttgacaaatttgaacattcctttaaggtttaaaaaaaaaaaagttttagcaaaataggaatagaaggaaacttttttacttagacaacaggtatcttacaaaaaggacaaaagtacataatacataattgtgataaaatgaaagcattttctctatgatcaggaacaaatcaagagtgttgactatcaccatttctattcagcattatacagaaggttctaaccaatacaatattggtagtagtgtagtagtaaacactttagaacagtgcctagtgcatagtgtaagtactttaaagtactttaaaccactttgtttgcatttatttaatctttttttttttttttttgagacagagtttcactctgtagcccagactggagtgcagkggtgttatcttggctcactgcaatgtccgcctcctgggctcaggcaattctcccacctcagccgcccaaatagctgggtctacaggcacgcaccaccatgcctggctaatttttgtattttagtagagatggggtttcgccatattggccaggctggtcttgaacttctagcttcaagtgatctgcctgccttgacctcccaaagtgctgggattacaggtgtgagttactgcacctggccttatttagtctttatgacaattctgtgaagcattatgtgaaaacacaggtacaaagaggaagtactttgtttaaggttacatagtaagtagagcaggatttaaatctaggcagtttggcattagaatgatacattttatcatagtgttaggaaatataaaataatgtagtaaaatatcaaaagccctttggaggagttatgtaaaaatcatacaatattgtcgaataacatttatttatgtgtgtgtgtgtgtgtgtgtgtgtgtgtgtgtgtgtgtatgtatatatataaatatatgtctatgttgagagagagagactcactctgtcacttaggctggagtgcagtggtgtgatcttggctcactgcaacctccgcctcctgggttcaagcgattttcctgtctcagcctccggagtagctgggattacaggcatgcaccaccacaccctgctaatttttgtatttttagtagagattgggtttcaccatgctggccaggctgatagtgaactcctgacctcaggtgatctgctcgccttggcctcccaaagtgctgggattacaggcatgaaccactgcgcccggccgttgaataacatttaaagacacctaaataaattgagaggtatagcacattcatagatattattaaactgactgttagggagatgatcactttgtagattcagggtaattgcagtcaaaatcccaacatatttatggaactttacaagctaatttataatttatatagaaaagcaaagggcccaaaataggcatcttcagaagaaaaagaaagatgtggataaacttgccctaacagaaatcaagacatattatgaagccatggtaattaatgtgttttgggactaggaatagaaaaataaaccaatggaatagtatagagagcctggaaacaaggccacatatgtatatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtgggaaaggatttttttatgacagagtacttaagcatttaaaaaaacctccaggtttaattacattataattatgaacttaaattcatcaaataataccataaagaaaatgaaatgatatccagcacatatatctgacaaaggattagtatctggaatatacagacaactcctacaatggaagaaaaagataaaccaacagaaaaatggacacacttagaaaggaatcatgaaataactcattaaatgataatgtgttcaaactttttgaaaatcaaggaaatacaaagtaaaatttcaatgagataccattttatactcattagattggtgaaaaaactaaaataaagtctattaccaaatgttggggagaaggtatggaatgatgagaacactgtcagttataggtgtaaatagttataaccatgtagataaatggccgtttttgagtaaagttgaagacgttcccattcctatatgccagcaatataaactagtaaaaacctttaagatgtgtccactgatttatacattaaaataagagtagataaataaaactgtgttatatattcacagggtagaatattatacatgttaaaatgaaataaagctctataacaatatgtatggatctcaacgttgactaaaacattgcagaatacattgtgattctgtgtgtgtgtgtgtgtgtgtgtgtgtgtgtgtgtgtaatggataactgtgcagtatgattagagatgccaacatacggtgaaaccatgaagtataaagaaaagggagtgataaacctaaaattaagtggggagaggatgagatgaggtaggatgggactgtggaggggcctgcagggggcttcataggaaatgatcttttttcccttagagtatgtggtctgtaggcattctcattgtgttgtcatttttgatgcctttgctaacacacacccttttttgtttttttttgagacagagttttgctctgtctcccaggctagagtgcagtggtgtgatttcggctcactgcaacctccacttcctgggttcaagtgattctactgcctcagtctcccaagtagctgggactacaggcacgtgccaccacgcctggctaatttttgcatttttagtagagatggggtttcgccatgttggccaggctgatctcgaactcctgacctcaagttatctgcccacctcagcctcccaaactgctgggattacaggtgtaagccaccacacccggcccacacatgtatttttatctactcagtatttaattaaaaattaccactcaagcacttaggagttgataaagaaaaaaaattaaatatatataaaaaattgctagctgcatcagcctgtttatggtggctgatttttttttcaagagttggtgattttggaggaaatagttaacaacatcaggggcagcctttgaaactgactgctgtctttcaaaatgccgtcttcctcaatatttgagaagattccagtgtggcctttaaggcaactgggtaattccccttctctagctaattggggttactctaggagccctttcacttggaatgtgcaagattgtagaagcacaactctttggttatattggactagttataatagtgagtagatttcttttgtattcctatttttcttccttattaatgtatcttgttctccattttttcttttagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacrcactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaggagctgttttgtggctttgtttgacaggtcttcagtaagaataatgtttttggctttcacatatactcagtttaagtgcttagtattaataacaagccatgaagggaataaattcctcttcactgagacatagactttggaataaaagacattttaactgatgtgcacaattattaatctagtggataagatggatttaaaaggaagaacaaaatgttcccagtactttttactgtctgtggttttattactatctatgggcatagtgggaagcatcattgagactttagggaaactataaaagttggaagggtggtggcatcaggggttggatgctggttctcaagttcctagctctgccccttgttagtcatttgagttaaataattaatgggaatatctacttcacaggattatgaggaatcctaagaggtgtaatccatatcaaacttttagaaaccagttgttttattacctgggaaaggtaataaagggccagactttttatactactgttagtatttaaatttgggatagtctggatgccacctaatacagttactatgaaattaacaaggtaactaaggaagttgatagtaccagtattatctattgctatgtcctaaattaccatagatttagtggcttaaaacaaatgcgtctcagtttctgtctgagcatggtttagataggtcctttagaaagctcatggtctcatctgcattctcacctggtgatttgggaagaactcatttcagcctcactcggctggcagaattcagttcttgccactgcaggactgagtgtccagacctctcactggttgtcagctggaggcccccgcttagttccttgccagctgggtgctccctgcatggcctggctgctgactggaccactgacatgattactgtcactaccagcaagtgtcgagagccaagctgccagcaagaggggtcttttcaggtcctgcccatatccaaggggagaggctcatacgaaggattggataccaagaggtgcgggtggggctaatgggaaggcacctagagtttgtcacagctttttttttttttaactgaatctctttaaattggtcgtctcgccctacaatgcaaatgctttgtgtagcaagtaaaaagaaaaatggctctcacaatatgaaaaaccctggctgggcactgtggcttatataaacctgtaatcccagcactttgggaggcccaggcgggtggatcccttgaggtcaggagttcaagtccaaccaggccaacatggtgaaacaccgtctctactaaaaataaaaaaattagccaggcatggtggcatgcgcctgtggtcccagccactcgagagattgaggcaggagaattgcttgaacctgggaggtagaggttgcagtgagctgagttgggccactgcactccagtctgggtgacagagtaagactccacctccaaagaaaaaaaagaaaagacctactgttgggccagacacttttaaacattgtttaagtaaccctgcaaagtaaaaaaaaatctatttaccggtaagaggaggtgccaggaggtcatgtaacttgaatgaaagaatctgcttttcttatttgaaagcctttgttctctaaactgtctcctgtctgctgcagtaatgctgtcctaaccctcattggaaactattccctgggtctcttcttgcctcccttctttctgaaggctgaaatgaggggcaagtttaacttttgcagatacgttgatctttaacttaaatcaaattctgttttttaattttgataatgttcaaagtacctattatctgtctttttgtggagaaaactgctggaggtttagtgaaacgatatcttaaaacaattcatcaaggtggctgctctgcagtgaacaatagaaggtaccctgggagctcttctattcagcgtccctagaacagtttcctagtgccccagatttagcattgtagtggccaggcaatcatttttgtgtgatgttcagtgaactcggaagggaggagaaagccaaattagatcaaagatagataatttcacaggctcatgttctcaaagaaagggatctgcgggttctgtctaacaatttctcaagctgtggagtttggttactcattgtagtcatgagaatgctttaggtatcaaataccttacaccctggttagaaactgcttgttattgtatgttgactagggggtcttagacaaacttagttgcaagctttagcatgaaagaacttagtcattcagtttagagagagacaaaagatttttttgcgaaagcctgctctttatctgaaaggggaaaatgatttattctgttttacagcatttattctctaaacttctatggcttatattagcttaactgtgtctccaggtattggcttttttttttttttttttttcagacagagtcttgctcttgttacccaggctggagtgcaatggcgtgatctcggctcactgcaacctccgcctcctgggttcaagcgatcctcctgcctcagcctcccgagtagctgggattacaggcgcctgccaccacgcccagccaattttatatttttagtagagatagggtttcaccatgttggccaggctggtcttgaacttctaacctcaggtgacccacttgcctcagcctcccaaagtgctgggattatagacgtgagccaccacgcccagccagtattggctttttgcaaataaaagagaaggattgtttttgcttacatttatatttaaatctcaaaataattaaaactaaaaaatctcaaattatttagtaagttcctggtagagttaaaatagaaacctgaaaaattatactttttttttttttcctttccttttcttttttttttttttttttttgagacagagtctcactgtgtagcccaggctagagagcagtggctcaatctcagctcactgcaacctctgcctcctgggttcaagggattgtcccacctcagcctcccgagtagctgggattacaggcatgtgccaccatgcctggctaatttttgtattttttggtagagacagggtttcgccatgtttgccaggctggtctcgaactcctgacctcaagtgatctgctcgcctcagcctcccaaagtgctgggattactggtgtgacccaccatgcctggccatactgtttttttttttttttttcccctcaagtaagtgtatacttggcctccaattaactttacaaatctcttcaatgttgatctgtcactgatggcttcttcatgagacattccaaagcctttatcttatttacccagcctctccacagtacttaatacgattgacagtttctttcttgaaatactcttggttgaaaacacactttctaggttttccttggacctcagatgctcactggcccaggcttcatcttcagccttcttcctagattatctccattccatggtcccagataccatatgaaatatgcagacatctcccatatctgtctctagagatttttatcagtcctgctggcaggaaatagatggcttactgaaattggataatttgaggaaagtttaataaaaggacctttacaaagttgtatgtagggtatagggaaacctcagggtgagtttagttcttgggactagtaacattggagtcctgttactactactcctgggtctgaagattgaatagagggagttggttaatggaaccaggagaccaacaggctatctaaaaagagtgggggcctggaggaagcagtaggagtaaatattctcactctccagattggccaactccatcattagtgccttcacacctgtttgttttctctgacccgtttccctaccatcctataactaggcaacacctacttatttatccttcaggtttaagctgaggcattacttggggaagcattccagaataattcctctttcttccaacacacacacgtacaaaataacatgctacatgggttccaagagagcatgaagcactgtttagtcaccactacagctcccagaggggttgattaggatatattaatagcagggtcacaataaatatttatattgattgattgcttacaacctggtattttcagaaatcatattcttagaagagttgaatttatcccaactgtcttgaattttattcaagaatgttaaaaaatactttgaagaaattttaagtacacagaaaagttgaaagaatagtataatagtataactttcacctagatccacaaatgcaacattttaccatatgtgctttatctaatttcttttgctgaatcatttgaaagtaaattgtaacaccatgatacttcacccctaaatacacattcatctaggaataagaatattctcctccctagccataatgtcattgccatatctgagctgattaagaataactcaatatccaatatgatagatctgtatggaataaattgtccctatcatcccaaagtgtcttttaaaacattttctcctcatccggggtctagtccaaggttcaggcatacttttggttatatctttcctcttttaatctagaatagtcctctgctttttctgcccatggcaatgaacattttgaagtgtctaagccaattgtcttgtaaaatatcccctatcctggatttttctggctatgttttattattattattttttattttgagacagaatatccctcttttcccaggctggagtgcagtggcatgattatagcttactgtaaccctgaatgcctgggctcaagcaattctcttgcctcagcctcctgagtatctgggactacaggcctgtgccaccatgcctggctaacttcttttttggtagggatggggtctcactatgttgtccaggtttggttgttttcttagtagatgtggattttacttttggcaaggatatagcatagattgtgtggtgcctctgttactgcatcatgtcaagaagcacacaatgtcaggttgtcccactgttggtgatgctaagattaatcgctgggttaagatcgccagatctttttccattttaaagtatatatcttttcttttgtaaatgaacaaaataatctgtggggtaatactgtgagacttttaaaacaacctttcattgagcacctacgtacaaggccctactaagtgttctaagtagtcccttgatgcttgagaaatcgtgtggctagaatcgtgaagtcctttttgagaatcgtagcatactaagattgtggggcttttttcttgtcatttaattgtgtgtgacttttattttctattcagaaataagtatgtagtggatgggggtaagggttatgtttggcacgtgagcttattagttaatatcaccagggcatagatgaataaacaatggaattagagtcaggagacttgaatttaaatcctggttttgctacttactggctttatgatctttgataatttttctctgagctcatttcctttgtaagtggaggaaataataccaaacacagctgtagtaagagcaaaatgaggatcatagagggcctggcctataataggtgcacagtgataagcacctaatgataaacttgttccctcatttgttctttaatctttaggaatgaagtctaattggatatgctaagaatgaaaacttttttgatctgtagttatgatgaacacaggaaaggtcttaaacagttcacatcaacaaccacccctctgcccccataaaaaagctcaaagctttcttaggtttcagtgcttaaaggagaatatgtattcactacaagattattatgctttggcagcacatgaatcccaggattgggaaattgtagagagggcatgaagctatgccagatataattaagctgcacaaaaagtatgttgaaatccagagggtggccaagataggctctcaggatgattttttgaaggaatgattatattagattcagggagtacatgtgcaggtttgttactgggctctattgcgtgatgctgaggtttggggtgtgaatgtcactcagatagtaagcacagtacctaacagtttttcaacccttgtcaccttcccccttccagtagtccccactgtctgttgttgccatctttttatgtccatgagtacccatggtttagcttcca

SEQ ID NO: 17897 - DNA, 14427 bp, Homo sapiens
ttctctccatgttgcaggtctataacttgctaccagtaaagagtccatttacctttagagctggaggtcctgcggatgaatatgatgaagagtgcaacaacgcaaaagacacaactcacagcggaatcacttccacaccgaagcaagtcctggagggggatgacatttacagtatcttcacggtaattttttttccccaaaaacataacaaaaactgatttctacgtgtctgtttagatggagaaacaatggacttctaagctctaggatcttttctcccctccctctaacaaaatgataactaacagaaaaatattgaaatctcagagacagataactctgtggacacacagatgttcacacatgaacttctctaccaccttaaatagaaagtggtttacttttaggctgcaaaccttaaccaaatggatcccaaagctgcttaccaccatcgtattcccctctcagtgactcttggggattccaatatgtaagaaaaccaaaacaaaatattttccataatgtgtctgacactcttggaaaggtgagcaccttgttggaggccatcatctcagtcatttgcaccataaacacttgttgaatgaggcggggcgcggtggctcacgcctgtaatcccagcactttgggaggctgaggtgggtggatcacgagatcaggagatcgagaccattctggctaacaaggtgaaaccccgtctctactaaaaatataaaaaaaattagccgggtgtggtggcaggcgcctgtagtcccagctactcgggaggctgaggcaggagaatggcgtgaaccccggaggcggagcttgcagtgagccgagattgcgccactgctctccagcctgggtgacagagcgagactctgtctcaaagaaaaacaacaaaacaaaacaaaacaaacaaacaaacaaagaaaacacttgttgaatgaatacaggattgaatacataaaatgcaaaacttcagtcctcacagggcagtaaaattccaggaaaatttgaagttgtctttcattaagaaaagattaacaaaacttgtattagaaatgttaagatgtcttaaaaatgtaattctttagtattaactataactgagcagaattatccaggtcgtgaaattaaatcttatcactatcaaaaagcactaaaaactttcatcataccttcaggaaaatatgtcgttcatctgctagaggtctacagcttagctgaaagcaatttaaatctctctcttctggaccttctggaatcacaaatcagatggtagaaggatgaaaagaatacttcttggtttattaaccagctgtttaatctctaaatatttatttctggtttatttctttctgttgcgtacacaaccctcactgacaactgtgttcaagagtcccacagtttcccaaatactctgagataaaatagcaaataatatttatctgtgactaacattgaagaagggggaagctggaaacaggtggactgtagacaaccgtgggcatctgaatgtgggttttagatgcagacatttgagacgactaaaagaaactgagaaaaaagaggaaaggaccacaggaacgagttaagcatagatattcaggaaaagccatatcttctggtaaaacataaacaaaacagagtttactaagattgtaaagaacaacctccgatatgcaaaccttcaatttaaaatgacaagaaacaagcaaaaaaatgctctttgtaataaagccataaggagagctgtttatatgcatacacagacatagatatttgtttcatggggaaaaagaagagaagaaaacatctaagtctaaaatattcagttttatggatgcaaaaaagagttaaggagcattagattataccagacaatatttagaaataagaatcagaaacgggtttgaattcccactcctattcactcaatagcttaatgaacttgaccgtctatgactctgttttcatatttataaatagctctcctcattttgtgtaattttcatgatgagcgtatgaactatatgtaacataatagtgaaagtacaatacaaattcaagaaactacttacagtctcaagattggattgccgctatgctttaacaacttttttcagtccataggattagatatttttaccaactcaaaaatccataagccaactttgtgtctaccacgaggattgcgtatcagcataataggaggtaaaggtgtgatttatttgtctgacagaatagaagaaaaatggtgctttattgggttggtttaagatgaaaacctgtttttctaagtattggatcttgagactgcagcaacttcttggtaagttagccccaaataatactttttcctcaaatagaggatttttaagcaattattattttctctttgacatcaaaatcaactacctttttgtttttgcttttaatagtcttgccattttagatcttccttgtccatgatggagtcaatacctgaattagtcagaattagattcaatggcagtaacaaacaaactcccacatctcagcgggtaagcacctaatggtttggtttttgctcacacaaaatctacttgtgagttcagacactctccagaacagccccgtgccaaacagtgagtcagagagaaccagtctgctttcctctggtgactctgccatcgccaacgtggctttcaaggtcatacccatggggaaggaggttgcactagactcttaaagccaggagtgggaatggtatacatcacttccgcccatgttcctgccctgaatgcaaaggaggctgagaaatgggaaggctcatgtggatattaactgtctctgtcatatcttcttatggaaagagaagggatttatgtaatattgagcaaaagagagtaacgcaacttttggcagatacgctacctctgcatagtctctttgtgtgtttcaagtatacctggaaatcaggaaatgttgcaaaaggcctaactcaaaattcttttctactgccatcaggcctagagaaatttttctctgcatgcttgaatgtctaccaaatttactttttaataaaaaatgaggatggcagtaaaaagtgttaaaaaaaaaaaaaaagaataaacacattttaatacagcagattcactgcctgggaaggcaaggagtaatgttctaattgaaaacaaaggagtcattaaggatatttcctcaccagaaaaaaaaaaaatcctgtatagtgaaaaaagaacactgtgttaagaacaaagggacaatttttcatcacactcctatctgctatgactatgtgactttggaaatttgcagactcacttaaccttttagaggctcaatttctttaaatctgaagtcagaatgacaacaccaaactcattgaggtattgtgaccataaaatgaaaaaaaaaaaatcatgattcctttaatggcatgtttgtttaaaaaaaagaaactgaaaagcatgattaattgactttcatttcaccaagtgtgtattttctttccaacctaagagaaaacagatcaatggaaacaaaggtatgattcagaaaacctgaaaactcagagtacatcgttacactttgaccccaaatgttctgtaatattctatgcaaatttttcttttggtatttgttgcttatccttttcttccttctcattttcagttacagcactttaatctgtctgtcattatttcataactagattactgaaaaaccattctaatttaacttccttgcctccagcttttctttacctctatctgtcctgcatactcttaaacactgcttttctcatgtcacttgtttctcaaacatagtcaatacttccagaattcataagattattgcatttaaggttttgaaagagcacatctaactctattatcttatatatatatcatatatgtatttataattacacacgtatataattatctttaaaaagtgatgccccagagatcagaagatatattatagaataatattataataaagatatttaagataatgttaacaatatgtaaagattatatatatcttatatatatgtatatcttctgatttctggaatatcaatttcttttttatcaagctaactaactcccacttaacagaccttattcatttgtcctagccttatgttttattatatattataccttctgtttacctaattatgggaaacacaccctgaaaatagccattctactctagagggtaaatttttactatccctgtgaagcacccttccacctttgtatatatatttgcacagtcctttcctgggaataactccccattctcctccacctcccatccatgaatgatcatcttaggttccgctttggtaaagtcttttccggcctaactaaagttgattgtcttttcattcctgactccccattgtctatactacatactttactgaatcctgttgcttattgtttatgtctccatattaattcaatgtcgaaacaaacaaacaaacaaaaaatcattcccgaaatcatcttgcttagctaatatccattcctcttgtttgattctcgctgcaaacagaagacatgtgaacacaatttcagtgtaaaagcaatatttggtgtattaaattactctttatccttcccttcaccagttgagtaatcatcttagagagagctacatttgtttttttttaatcaacttttattttagattcaggaggtacatgtacaggtcatttgtttttatttataaagaaaaatatatttagctctagattctatttgaagaaaaaataggattagcctttttataggaaagtgaacaaaataacaagctggtaggttaaattgttccaataataaacattccctgagcgtatgaccttattccatttgagaaataaggcagcaataagaaattgatgataaaaatgaggttcacactgaggcctgtgtgttgtcttccaggaccaggtctgcgaggtgtacccccaggagccgtagaaataatgtacccaatgatcgaagaagaacctcagatattgcaagtgaaagagatagtccggaagtacttccctgagacctggatctgggatttggtggtagttgagtaagttgtgtgttgcctggaatttagtttaggagagggtttgaatcctgctgtatgactgatgttatcctggattcctgatccttttagttctgctctgctcttttctggtaaatatttaggtttatagttcatttatctcataattaaacaatgctaattttttttctaatttagtctattgataactaaaatagtagaaagtaggatgctaccagccctcttaaataaaggaaagggaaggggaggggagggagattgaaagaaagaacaaaaggaaggaaagaatgaaagaaaagaggaagaaataaagggagggagggaaggagggagtaagggaggtagggagaaaaaaaactttaaacctcaccaggagcaccaacccttagatcaagtttagcatttaccacactaggttactgagttatcatgttctaggatcagccatgctttgtgttaaaaaaaaaaaaaaaaaagatttgcttatactcctcttctctgctccttcactagctcattaggtataagtgagctggtgaccaggtccctgaaaccatcacagagtggaaggccagcgcattctgcttgtctggaaccacagggtttggcctctctcctatcgtgtctcttcaagccttccagcctttcttcctagaactcacccttccttattctgtggtgcgaggagaagccttcacactcaaagccactgtgtttaactgcttgtccacctgcattcgggtaaggacacttctctggaagtgaatgagaatagaagatagtcaccattcattaccaggtctcctaggtaacccaggaaatcagaactgcatatgatatatcctaattttggagcagacctggtactaagagaaaaggtacctgacaggcccaaggtggtaaggttatattcattcaggctcctatatctgtgtattcctaaattcagacattatgtccacctgattgtttcatgtttttcactaaacacctctttcttctgttggcacaaggctaaatcctaaacacttatcctaattcctgtcagtttttcaattttcttgtttcaaacacctaaactacaaagtgtctgatagagctgaccatatttgcacagcttctcagcgcctctggactcatggacattgtccctcwgtccatttacctgatgcacagagcatcttttgcagtattcatgctgttctgcatcccttcataaacttgtggttgggtgtgggggacaggtcgttgtgcagctggaggtctcttccgctttcctggctgttccaacagagaagaatgaagaatctcactgtgtctgtagaaatgggcggaaaaccgtgtcctgggttgtgactccgaagtcactgggtgagtagtaatgctattagcaaattccacttcgtgtgcttggatgatttgttttctgcacygaccccaatacacactttttctcctcctttaataytaatcaagaggaagacaaccactggatacactggggaaactggaaaagaagaaactgttcaatatagaatcaccgtttaactcttaagaactttattccccaggaaaggtgaatttcacagccactgcrgaagccatgcattctcaggaagtgtgtgacratgagttgactgacgtcccrccacttgcgcagaaggacactgtagtcaaggccttactagttgaggtacgtaagtctactctctgtgagtctcagagcccttattatttcatacagtattatctaacatgcatctcacagtgacatttaattcccaagaatgtggatagatctacaatccaatttttcaccaccattttctcctttgctttcaagtgtttaatttttcttttatacattcagtatcgctttacttttttttttttttttgtcaatataaagcctgaaggaatagcaaaggaggaaactttcaacacgctgccctgtgcatcaggtaagtgtaatatatagagaaaaatttcatgttaagtgacttgccagagtatgcagttgtggaatgtcttttgggggcatgcttttctctgagagagagagagaaaaaaaaaacaactcttaccctcctccaaatctaaggacatttgatgaaaaacattgtcctgccccactggctgctctgaaaagccgtctttgcattgtgcstcgtcagcctccttgctcgccgcagccgcctccgccgccgcggactccggcagctttatcgccagagtccctgaactstcgctttcttttttatcccctgcatcgcgtcaccggcgtgccccaccatgtcagacgcagccgtagacaccagctccgaaatcaccaccgaggacttaaaggagaagaaggaagttgtggaagaggcggaaaatggaagagacgcccctgctmacrggaatgctaatgaggaaaatggggagccggaggctgacaacgaggtagatgaagaagaggaagaaggtggggaggaagaaggtgatggtgaggaagaggayggagatgaagatgagggagctgagtcagctacgggcaagcgggcagctgaagatgatgaggatracgatgtcgatacccagaagcagaagaccgacgaggatgaccagacrgcaaaaaaggaaaagttaaactaaaaaaaaaaggccgccgtgacctattcrccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggagggaaaaagaaccaaaacttccaaggccctgctttttttttttcttaaaagtastttaaaaaggaaacttgtattttttatttacattttatatttttgtacatattgttagggtcggccatttttaatgatctcggatgaccaaaccagccttcggagcgttctctgtcctacttctcactttacttgtggtgtggccatgttcattatratctcaaaggagaaaaaaaaaacttgtaaaaaatgcaaaaatgacaacagaaaaaccatcttattccgagcattccagtaacttttttgtgtatgtacttagctgtactataagtagttggtttgtatgagatggttaaaaaggccaaagataaaaggtttcttttttttccttttttgtctatgaagttgctgtttatttttattttttggcctgtttgatgtatgtgtgaaacaatgttgtccaacaataaacaggaattttattttgctgagttgttctagcaaaaaaaaaaagaaaaaaaaaagaaaaacattgttctgatgaaaatcacttggaatgagcctcttagggaaataaatagaaagtactttttaggataaattattattattgtattttaagaataaagaaatgggcatagagaaataaaagacttgcttaaaagcttaaaagctcttgcctaataataaggtctaaggctgttgacctcaggacaggattctttctgatacctctgtgtttctcaaatgtcttcctaaaccatgttcaaaatattgaaatatctgtgtgacactagtatgatttactgttcaattgacagtttaaatgcactcatgtttttacttaaacaagttattttaagaggaactccaggttactaacttgtatagaaaaccagtattttaccaatatcattaatatagcaatacaaaaattaccactatattgaaagagaaggggaaaagctaacacttttttaagtttatttaaattatcattaaaaacccaactctgtgccacctataatcatcttgacgataatgctcagtctgcagatctctcttctctatacgaggatcccttgataaaatcatctagtcaatggctttaataacaactatgtacttgtgtccaaaactgtacaactttgatccacacctttttcctgaactcaaactcatgtattcaactgcccactctccacttacaggcttgtaggtctcataggcatatcaaaatcagcaagtttaagactgagtatctgctcgtcctcacaaacctgctcctccctcaatttccttcatctcagatgatgaaaaatccattcttctatttgctagggagaaacactttggagttctttactacattctttcccctatcttccctacccaatccatgcacaaatctagtcgattccaccttcaaattgcatccagaatctacccacttctctccatctctactattctagtcctttctcttgcaggctctcaatagctttctaactggtctcctgatcatctcttcttgttccccttcagcgagagggatcctttaaaacatgtgtcagatcgtgtccctcctcttctctaaccctttcaggaatctcccatatcccccctaagttaaagcgtaagtttttaatgccacttagaaacccttgctaccccatgacttcacgtcttcctaatctctccttcgcttaacccgttccggccacactgacctctttcttcctattggaatacacccagcatgcttcagtctctggagtccttttactttttgttcctttttcctggaagtatcttcccccaggtttggataaatctggctccttgacttacttaaagtctctgctcacacaggactttttatcaatgagcttttccatagggagccccctccccacttcctgacctgccttgttttactagctcaccatagaaacacttgccctgctttaattttctctatagcacttatcaacatctagtatactaaatatactcttgcttttttatcgtagtcttcccctaaaaatgaaatctccaggaggccaggaaatttgttttgaaactttcggtatcattgcacttagaacctggtacatagtatacactgaatacaaatgaatggaatgaatgtaattcttgaaaagcactaacagtagcaggaattaatataaaccatgaagagaaggaaataagcataccataagtatatgcccataggaaaagccatagaaatttagcacaaatgtatatgatgaatatgaatttcactgagagatgaatcatggctttaagggaaacttggattgtatcaaagaaattatgtaataactgagccaggcatggtgactcacacctgtaatctcagcagttggggagatggaggcaggcaaatcgcttgagatcagaagttcaagaccagcctggccaactctgtctctataaaaaatacagaaattagccaggtgtggtggtgcatgcctgtaatcccagatacttaggtggctgaggcacaagaatcatttgaacctgggaagcagaggttgcagtgagatcacgccactgttcttcagcctgggtgacagagggagactctatcacaaaaaaaaaaaaaaaaaaaaagttatataatgacgaaggaaaataaaaggttggatctagatgatgtagagaaacatgattcataacaaaaatagaacatttctctcactttcccctcctttatatgtgtgtttttcttctttcattagatactggagtacctgaaaaggtgtcactgaatgttccttcaaatgtggttgaaggatctccaagggcaacatattcagttttaggtgattctttcagcccaagggaagcagctgtctggctgtataattctagtgcatgggcctcaccatccacgattaatgaagtttctgacaacaggcaatggattgagagaaagcactaagggttacactatgttacagttggaaaggggcttgaatagatgttgtgctacatattatgccttgatatattctaaaaagaaagggtcacctctcagtgccctcatcttcaagcaatttactaggtggtaatgcttcctagtcagtttgaaaatggttgtggttgagttttaccagacatgtggcccatgagaaaagatagatcacctaccattcagtttcttcccccctttctccatccttaaaccgtctattttctcaccttttgttttcctccctatttcttgttttttcaccttttttagtcttcttgtccttttctctataggttatttggcctctcagttagctaataatctattttcctagcctaatacaaaccatatctgatttctttacaacttttattccacaggtgatatactaggctctgtagtgcaaaaccttcagaaccttcttcagatgccctatggttgtggagagcagaatatggtcctttttgtccctaacatttatgttctaaactatctaaatgagacacgacagctgacagagaagatcaaggccaaagccactagctacctcatcagtggtgagagattacctcaaaaagaagagccataatctcttaaatattttttggtgaacgaaaatcaacatctgtttcattaagattcgatagtcattgtcgtgattttcaataaaatgtcccaatatacaagtagaaaattcaatagtatcatcaagcctgtgattgggggttgcgggaaattttaactaaatattagttaccctatgattcctaatagcactgagaaaaaagctcaataatcctccaatgtctttgccatttcaataaatctatgaacacttcctcttcagggtaccaaaggcaattgaattataagcacagagatggttcctacagcacctttggggacaatgatggtagcagtcagggaaacaagattattttttccctatgctctctgtagatccatgacatttcaggattctagaaacagctactctctaatatctggagttttttgtggaaaattgttagtctttaaataacgcatatgctgtatgtatcattcctgttgggtaatctcaccgtttcatctctgaaagcttacctgctgtgataacacagctgaaaatggtgaaataaggatcttctaaatggaaatataaagcagaaaatgtcattctataaaatgacaggggaagaagctcccacactgtgcattaaagaaggaggggagggcgaggacagaaggagaccgtgatgcagtaaagtcaggacaagtcattctggaaatgcagttttcatggtggggaggcttggaggctccaacaaatgtttcacaacaaaaaaattaaaaagcatcaactcagagaaaccaataaagttgagatataataaaagatattgaggtgtttgttggactagagtatattcagctcttaaatactatttccccatcaatacctcccagtaatctcctccactgaattgtgaagagcaatgtctggaggcagtgcacaaagtgagctatgaaagtgaggtggtcctcatgtgtgtgtttctgttttgctcgacgggctcactgcatttgtgctcaagtcctttgctcaagcccaatcgtacatctttgtggagagctcacacatcagggatgccctcacctggctttcacagggacaaaaggcagatggttttttcgaaggctctggatcactgctgaacaatgccattaaggtgatgccttctctgtttttcttctggtccctgaagatagtgatatgtgggaggaaatgatgtttgaattgagtccttcagtcttagcgacatagatttcaggaagaatggtggactctaaatctcctgaaatctagcaataccttagtagttttttattgaatgaaaatagtgttcaaaaaaacctcaaagccgaacatactataaaaagtgagggaaggtgatctgggacagactcaagaattttagggtagaggaggaaggggagaaaatcaacaatctagcacaagacaagaaacaatctagcacaagacaagaaacactctagtgaagatgtcaaaaagaaaagaagtgttagcagatgctgtctcatgactgttgaagtgtttgagtctctctgcctctgatccttacacggtggggtgaacgatgaggtgacattctctgcctacatcaccattgctttgctggagatgcctctgcctgccactgtatgttcaagcacatcctctgtacctccttcacacacgtaaagaataaaattataatatggtgaatccctgagggaaattaattgtgatttttatggtatttaattttggtacatttcactggaatgtaaaggaccagatccttttggaagcagcagaggaaactcctctctggtcagaactgtgaggttatacaggcacattaaggtttttaatctgcagttagcccgggaatagctcatttgcctggttctgctgttttacaatagcctttcgtcttcttcatagcacgcagtggtctgcagtgccctatcctgccttgaaacggcctggagctccacctcagaggcccaaggaagtgttgtctataccaaagcattattggcctatgcctttgccctagcaggaaacaaagtcaagcgaagagagttgcttgaatcattaaacagagaggctatgaaagaaggtaagagctgctactgcaaagtttacttctgacaaccaccagtgaccaaaagaagggacaatacctctaccgagctcatgcttaccatgctatcttaatttaatgacagaataattatcattgatctaagacccgaattctctggataacatggatcattttattaatccacacagtatagactctatacagtcccaccttctaatatcacacacacacatgtagtagacacaaaggctcaatgttattccctggaactttactttcttgataaagatttgtttgatagtgactatttaatgctttcactttgtttaatgctttcacttcattaaaatgaaatgtcaatttattaggtaaactgtaattataattatcacttatggattagattttgaaatcatcctttaagctaaaaattctacccttttctatgtcaaagaggattcgatccactggcaacgtcctgggaaacttcacgaagctaagaccctctattctcaaccctgggctccctctgtggaagtagagatgacatcttatgtgctccttgcctatcttactgtccagcctgccccatcttcagaggacctgtctgtggcatcacgtattgtgaagtggattaccaagcagcaaaatccccaagggggcttctcctccactcaggtctgtgggaagactctagaaggaaacataaatatattcacatatatgaagacacaaccatctgggagttgaataatggaatggttagtatttccaattcacactttctccatccctccatcagcagacaagttccagccttactatcttatgtatggattac

SEQ ID NO: 17898 - DNA, 23013 bp, Homo sapiens
  misc_feature (1)...(23013): n = A,T,C or G, or insertion/deletion polymorphism (see Tables 1-2)
tttgagaggccgagatgggccgattgcttgagcccaggagttcaagaccagcctgggaaacatggcaaaacctggttactacaaaaatacaaaaaattagctggatgtggtggcacattcctgtagtcccagctactcaggaggctgaggtgggaagttcacctgagcctggaaggtcgaggctgcagggagccaagatcacactactgcattctagcctgggcaacagagtgagactctgtcttaaaaaaaaaaaaaaaaatcaggccgggcacggtggctcacacctgtaatcccagcactttggaaggccaaggcaggcagatcacctgaggtcgggagtttgagaccagcctgaccaacatggagaaaccctgtctctactaaaatacaaaaattagccgggcatggtggcacatgactgtaatcccagctactagggaggctgaggcaggagaatcgcttgaacccgggaggcggagattgcggtgagctgagatcgcgccattgcactccagcctgggcaacaagagcgaaactctgtcttaaaaaaaaaaatcttcttaaaaggggtggtgaggattacacaaaacagggtatgcaaaatgcttaacagatgactagctcctggtaatgctccatacaagtttgttgtaagttactactgcccaggatcatatgaccaagcacatgagaggctccagctacccttcaaggaagaggagacagatgaaatcagatcatggctgagacattcctgttttctctctctttttttttttttttttgagatggagtctcactctgttgcccaggctggagtgcagtggcgctatcttggctcactgcaacctctgcctcctgggttcaagcgattctcctgcctcagcctcccaagtagctggaattagaggcgtccgccaccacacctggctaatttttgtattttagtagagatggggtttctccatgttggtcaggctggtcttgaactcctgacctcaggtgatctgcccatctcagcctcccaaagtgctgggttacaggcatgagccaccgcacccggccctcctattttctctcctatcaggcctagttttcttttcttttctttctttctttttttttttttttgagacggagtctcactctgccacccaggctggagtgcagtggtgtgatctcagctcactgcaacctccgcctcccaggttcaagcgattctcctgcctcagcctcctgagtagctgggattacaggcacccgctgccacacccggctaatttttttgtgtttttagtagagatggagtttccccaagttggccgggctggtcttgaactcctgacctcatgatccgcccaccttggcctcccaaagtgctgggattacaggtgtgaaccaccgtgaccggccaaggcctagttttcctaagtgtctttatgggaccctcacacctgtacaccaaactccttcaagaggcaaactctctcctaagagggagacaaaagaaacagggccagtggtttcactgtagacaatggtctatctgtcctgcagatgagtcagaactaagaccccttgaggaatcatgttgctttggtgccggctgtctggtttctattccatatcctgtgccgcacccttcccccagccacagtgacatctggaggctctgaccacagctggcaggctctgtggtaccgcagaggccaatcttcaacaggaagtcttgggggaacatttcttcccccaaaacaccaggcctctgggcctgggccacttctctccctcagacagcccagggtttcgttttatttttattttattttatttatttatttttatttatttatttggttttatttttatttatttatttttatttttatttatttatttatttatttatttatttatttattctttttgacggagtctcgctctgttgcccaggttggagtacagtggcgccatctcggctcactgcaagctctgcctcctgggttcatgccattctcctgcctcagcttcccaagtagctgggactacaggcgccccccaccacggccaggtaattttttgtgtttttagtagagacggggtttcaccgtgttagccaggatggtctcgatctcctgacctcgtgatccagctgcctcagcctcccaaagtgctgggattacaggcgtgagccactgcacccggccagttttgttttttaaaaagccgtgagagggctgtcaggaggcagtgctcctgggcagaaagaaggctggcaccagtttctaagtctccattccgccaggcggacaagcctctctggcggttgttggttatcacttgtaaaatataaacagtaataactgtcctccctacctcacagagtgtgttgcgagggccaaatggaatgtgactgttgaagtacttaggaaagttaaaaagctccttcctatggaaggtggcatggaggcgccggggggattccatgtcaaaagtcccagttctggccgggcgcggtggctcacgcctgtcatcccagcaccttgggaggccgagacgggtggatcacgaggccaggagttcgagatcagcctggccaacaaggcgaaaccccatctctactaaaaaatacaaaaattagccgggcgtggtggcgcgctcctgacgtcccagctactcgggaggccgaggcaagagaatcgcttgaacccgggaggcagaggttgcggtgagccgagatcgcgccactgcactccagcctgggcgacagagcaagactccgtctcaaaaatagacacaacagaagtcccagttctgcccctggttgtgcggtccgcacttaactaagaggctggcatctctgggaacagcctccgggacccgcgcgctggtgcgtgctggagggagtagggaggggtggggcggtcggcatcgccctccgccgggcccggctggagctggctggagaccctttcagccccgggaggaagcggagcccagaccgagccagagcggagcagcgggagggagggcggggaggccgccgggcaggaagcggggtcccgcccgggcctctggagccacgtgcgcttgtttccgtgctggggcgatcacgtgacccgcgtcagctgacccgtcacggtggagcccggtgctcgcgcccggcagcctctgccccgccgcgcccggagcgcaggacccgcggaggggtaagcgcgccccccgtccgcctcttcgccgccgccggcttcctgcggccgcctccgccccagcccctgtcccgcgcccatcccagccccgccggcctggcaccccggaagccgtcgccagcagggccgtggctgggctcagccccgcgctgcccccgggcggcctggaggagatggcccagggcagcggggggcgggaaggcgctctcagaaccccggccgggggctggcattccccgccaagcccagacatgcaggagctgctccggagcgtggagagggacctgagcatcgatcccaggcagctggctccggccccggggggcacccacgtggtggccctagtgcctgcgcgctggctggccagcctccgcgatcgccggctgcccctgggaccctgtccccgcgcagagggcctgggagaagcggaagtcaggactctcctgcagcgctctgtgcaaaggctgcctgccggctggacgcgcgtggaggtgcatgggctgcggaagcggagactgtcctaccctctgggcgggggcctgccctttgaggacgggtcctgcggccctgagaccctcactcgcttcatgcaggaggttgccgcccagaattatcgcaacctgtggcgccatgcataccacacttacggccagccgtacagtcacagccctgccccctcagctgtccctgccttggactcagtacggcaggctctgcagagggtctatggttgctccttcctgccagtgggtgaaactacccaatgcccttcatatgccagagaaggcccctgcccccctcggggcagccctgcttgccctagtcttttacgggctgaggccttgctggagtcgccggagatgctgtatgtggtacacccttacgtacagttctccctacatgacgtggtcaccttcagccctgccaagctgaccaacagccaggccaaggtgctgttcattctcttccgcgtgctgagggctatggacgcctgtcaccgccaggggctggcgtgtggggccctgtctttgtatcacatcgcagtggatgagaagctttgcagcgagctgcgactggacctgagtgcttatgagaggcccgaggaggacgagaatgaggaggcccctgtggcaagggatgaggcgggcattgtgtctcaagaggagcagggagggcaacctgggcaacccactggccaggaggaacttcggagcctcgtgctagattgggtccacggccgcatcagcaacttccactacctcatgcagctgaatcggttggcaggtcggcggcagggggaccccaactaccaccccgtgctgccctgggtggtggacttcactacgccccatgggcgcttccgagacctgcgcaagtccaagttccgcctcaacaagggggataagcaactggacttcacgtatgagatgacacggcaggcattcgtagcaggcggggcgggcggcggggaaccccctcatgttccccaccacatctcagacgtgctctccgacatcacgtactatgtgtacaaggctcggcgcacgcctcggtcggtgctctgcggacacgtccgcgcgcagtgggagccccatgagtatccggccagcatggagcggatgcagaactggaccccggatgagtgcattccggagttctacaccgatccctctatcttccgctccatccaccccgacatgcctgacctggatgtgccagcctggtgcagctccagccaggagttcgtagctgcccaccgagccctgctggagagccgcgaggtatcccgggacctgcaccattggatcgacctcacgtttggctataaactccagggtaaggaggctgtcaaggaaaagaatgtgtgtctgcacctggtggacgcccacactcacctggccagctacggggtggtgcagctcttcgatcagccacacccccagcgcctggctggggctcctgcccttgcccccgagcctcccctcatccccaagctgttggtccagaccatccaggagaccacaggccgggaggacttcacggaaaacccgggacagcttccaaatggagtgggccggccagttttagaggccactccctgtgaggctagctggaccagagacaggccggtggcaggagaagacgacttggaacaggccacagaagctctggattccatttcccttgctgggaaagcaggtgaccagctgggctcctccagtcaagcgtcccctggacttctctctttctcagtggcctcagcctcccgtccaggccgcaggaataaagctgctggggcagaccctggggagggtgaggaggggaggattcttcttcccgagggcttcaatcccatgcaggccctggaggagctggagaaaacgggcaacttcttggccaaaggcctagggggcctgttggaggtgcctgagcagccccgggtccagccggctgtgccactgcagtgcctactccacagggacatgcaggcgctgggtgtcctattggcagagatggtgtttgccaccagggtgcggacgctgcagcccgatgcacctttgtgggtacgcttccaggctgtccgagggctctgcacgcgccaccccaaggaggtccctgtgtctttgcagcccgtgctggacacactcctgcagatgagtggccccgaagtccccatgggagcagagaggggcaagctggaccaactgtttgagtacaggcctgtctcccagggcctgcccccaccctgcccaagccagcttctcagccccttcagctccgtggttcccttcccaccctacttcccggcactgcacagattcatcctcctgtaccaggcaaggcgtgtggaggacgaggcccaggggcgcgagctggtgtttgctctgtggcagcagctgggcgcggtgctaaaggacatcacccctgagggcctggagatcctgctgcccttcgtgctctcactcatgtccgaggagcacacagctgtgtacacggcctggtatctgtttgagcctgttgccaaggcactgggccccaaaaatgccaataagtacctcctgaagccgctcattggtgcctacgagagcccctgccagctacacggccgcttctacctgtacacggactgctttgtggcccagctgatggtgcggctgggcctgcaggcatttctcactcacctgctgccccatgtcctgcaggtgctggcgggcgcagaggcctcccaggaggagagcaaggacctggcaggggctgctgaggaggaggagagcgggctgcccggggccgggcctggctcctgtgcttttggggaggagattcccatggatggggagcctcctgcctcctcgggcctggggctcccagactacacgtctggcgtcagcttccacgaccaggctgacctccctgagacagaggacttccaagccgggctctatgtgactgagtctccccagccccaggaggctgaggctgtgagcctgggccggctgagtgacaagagcagcaccagcgagacctccctgggtgaggagcgggctccagacgaggggggtgcccccgtggacaagagcagccttcgatcaggtgacagcagccaggacttgaagcaaagcgagggctccgaggaggaagaggaggaggaggacagctgcgtggtgctagaggaggaggagggggagcaggaggaggtcaccggggcatctgagctcactctgtctgacacggtgctgtccatggagacggttgtggccggcggcagtgggggagatggagaagaagaggaggaggcactgcctgagcagtcagaaggcaaagaacagaagatcctccttggtaagttcccaggtctgggaggtgttggtcaaaaacacctcctgctggccgagcacagtggttcacgcctgtattcccagcactttgggaggctgaggcgggcggatcacaaggtcaggagatcgagaccatcctaataacaaggtgaaaccccgtctctactaaaaatacaaaaaaatagccgggcgtgggggcaggcacctgtagtcccagctactcggaaggctgaggcaggagaatggcgtgaacccgggaggcggagcttgcagtgagccgagatcgcaccactgcactccagcctgggcgacagagcgagactccatctcaaaaaaacaaaacaaaacaaaaaaacagctcctgcttctccctgcacactggcagagcacctactctgtgccaagcagtggatcgagccaggaccaccggcaacacaaatgtaggcctgccttcacagagctcacacccagcagacgagatgccgcagtgcagacagtcttaagcaagtgtattatgttagtgcgataaagaacatggctgcattcctaggagggagtgcaacatggagcttttcggccgggcgccgtggctcacgcctctaatcccagcactttgggaggccgaggcaggaggatcacttgaggttaggagttcgagaccagcctggccaacatggtgaaaccccatctctactaaaaatacaaaaattagccaggcgtggtggcgggcacctgtaatcccagctattcaggaggctgaggcaggagaattacttgaacccaggaggtggaggttgcagtgagctgagatcacaccactgcactgcagcttgggcaacagagcgggactccgtctcaaaaaagaaaaaaaaaatggtgcttttacatctagttttcaagggtcagagcaggcttccttaaaaggagagacagttgaggttcaaggaggagtaggaagaaggtagacaaaaatgggcaaaaagaaagtctgaaggctgagggaacagcatgtgtgaggctctgaggctgtcatgttccattaaagaagagaagcgggggaccgggcgcggtgcttcacgcctgtaatcccagcactttgggaggctgaggcggatggatcacaaggtcaggagattgagaccatcctggccaatatggtgaaaccccatctctactaaaaatacaaaaacttagctgggcatggtggagggtgcctgtaatctcagctatttggaaggctgaggcaggagaatcgcttgaacccggaggttcaaggaggagagtcagggcggtggaaggtggaggttgcaatgaactgagattgtgccattgcactccagcctgggcaacagtgcgagactctgtctcaaaaaaaaaaaaaaagaagaagaagaagaagaagagaagcagggaaaggccgttatggcgagaccgagggagtggagggaagagaggccagagggaaggtggccagggccgggccaggccttgttaaggagtttcagaagacccacgggcaggctaacttcctgcgggtcgtgcctgtggagaggaacctgcggcagccagagtcccacaggccagggcctgggcacctctgccgctgttacgtggagggggtggtgtgggacagccggcccgggctgggctcttggcagagctgcagccgcaggtggttgagtggggtgccgtggggtggggtgggaggggtgatgagcccctgttatctgaggagctcagggcctgctcccaccccgcagatacagcctgcaagatggtccgctggctgtctgccaagctcggccccacagtggcctctcgccacgtggcccggaacctgctccgcctgctgacgtcttgttatgttggtaaggaggcctgcggtcagtgctggagatgaggctttctcccaggccctctgcctagcttcagcgctctccggcggggatccttcccacccctccctcaaaccaccccccggccaggtgctgggtcccagtctaagtgccagccttgggtagggccaggctgggcccccagctagagtgagctcaagcggccagcacagccctgcagggccaggctacccccggccctccactggcgactcagggctgctggcccttccgtggcaggacccactcggcagcagttcacagtgagcagtggcgagagcccaccgctgagcgcyggcaacatctaccagaagaggccggtcctgggcgacatcgtgtcagggcctgtgctcagctgcctcctccacatcgcccgcctgtatggggagcctgtcctcacctaccagtacctgccctacatcagctacctggtcagtcgctggtttggcaggcccggggctgggaaggctgaggacctgagggccggcccgggctctcttggtgccagggggtctgtggggctgcccggccctcatctgctcggtggctctaggtggccccagggagtgcctcaggccccagccgactgaacagccgtaaggaggcggggctgctggccgcggtgacgctgactcagaagatcatcgtgtacctctcagacaccacactcatggacatcctgccccggatcagccatgaggtcctgctgcccgtgctcagcttcctcacctccctcgtcacggggtaggcctctgccccagctgatgtagggggaccggcccagcggaggggctgcccaggagggggtgggaagctcaggggagaggacgtaacactggactgggtgtcaagagtcctggttttgatcccggctgtgtgaccctgagcaaaccacacccttttcctgtgcctcagtttcctcatctggtttggaccagttggtcttggagctctttcatttaaagcttttgatatgtccgggcacggtggctcatgcctgtaatcccagcactttgagaggctgaggcgggaagattgcttgagcccaggagttcaagaccagcctgggcaacaaaatgagaccccctctctaaaaatatatataaaggccgagcgtggtgtctcacccctgtaatcccagcactttggggggccaaggcgggtggatcacgaggtcaggagtttgagacccrcctggccaacatggtgaaaccccgtctccactaaaaatacaaaatcttcgctgggcatggcagcaggtgcctgcaatcccaggttctcgggaggctgcaatcccaggttctcaggaggctgaggcgggagaattgcttgaacccaggaagcggaggttgcagtgagctgagatcacgccattgtactgcagcctaggcgacagagcaagactctgtctcaaaaaaaaaaaaaagtatatatatawgctgggtgctgtggctcatgcctgtaatcccagcactttgggaggccaaggtgggtggatcgcttgaggtcaggagttcgagaccagcctggccaatatggcaaaaccctgtctctactaaaaatacaaaaaaaattagccgggtrtggtggctcatgcctgtagtcccagctactcgggagactgaggcaggagaatcgcttgaacccgggaggcagaggttgcagtgagccgagatcgcaccactgcactccagcctggatgacagagcaagactccatctcaataaaaataaaaataaataaagattttgctagattctggtcaagtcctgcagaacggcgggctggagctcatgagctctgtttccaggttcccaagtggggcccaggctcggaccatcctgtgtgtgaaaaccatcagcctcatcgccctcatctgcctgcgcattggacaggagatggtccagcagcacctgagcgagcccgtggccacctttttccaggtcttctctcagctgcatgagcttcggcaacaggtgggcagatctgctgggccagggcgggctggggcgggggctgtggacctgggtgaccccctgggcatcttgctcataggatctgaagctggactccgcgggccgtggcgaggaccagggtgggccagggtgggagctgtggacccggctgaccccctgggtgtcttgctcataggatctgaagctggaccctgcgggccgtggtgagggccagctgccacaggtggtcttctctgatgggcagcagcggcccgtggaccccgccctgctggacgagctgcagaaggtgttcaccctggagatggcatacacaatctacgtgcccttctcctgcctgttgggtactgccccatcacgttccccatcacagtcttcgtggctgtctcctcccttgggaggccccattctctgcccttgccccagagtcagcagtgggttctaagagccagcaggatgggtgagagcaaagggatttggcctcagacccctacccccaaggtgacacacaaacaaggactgagcagtagccagcaagagaggcccagaagctggcctgtagtgtccctggggaaggcaggagagtcagggaggtggactggcggtccgcaggagctggcgagagggaaggagtggcctcctgtttacgaagcttcccctctgggccctgcacggtgctgtgctgatcgtttcagcgtgtcatctccctggagaggacagacagccttgtggttacacctgttatcatcctgccactgaaatctaagcttgggaggccagggcaccacctgtcttgttccatattctattcctagtgcccagcacggcacggcacatatagaagatgctcatgtgtacatcacaacggaatgaatccacatttcactgaggaggaaactgaggctcagagacagagttacttgcccagagttgcagagccagttcctgccccatcttctgtggctcccgagtccttggatgggtgatagcagccgcctgccatcttccctgtctcaggacctctcccactcctatccaggtgacatcatccggaaaatcatccccaaccacgagctggttggggagctggcggcgctgtacttggagagcatcagccccagcagtcgcaaccctgccagcgtggagcccaccatgcccggcaccgggcmcgagtgggacccccatggtgggggctgccctcaggatgacggccactcagggacctttgggagcgtcctggtggggaaccgcattcagatccccaatgactctcggcctgagaaccccggaccactgggccccatctcgggggtgggtggcgggggcctgggcagcgggagcgacgacaacgccctgaagcaggagctgccgcggagcgtgcacgggctgagcggaaactggctggcgtactggcagtacgagatcggcgtgagccagcaggatgcccactttcacttccaccagatccgcctgcagagcttcccgggccactcgggggccgtcaagtgcgtggcacccctragcagcgaggacttcttcctgagcggcagcaaggatcgtaccgtgcgcctctggccgctgtacaactacggcgacgggaccagcgagacggccccacgcctcgtctacacccagcaccgcaagagcgtcttcttcgtgggccagcttgaggccccrcagcacgtggtgagctgtgacggggctgtgcacgtctgggaccccttcacaggtgagcgggcccaggtgaggcctgttctcttcctgctcctgcgccccaccaggcctccaggaagggggcccgagggtggggctgtaatgctgcggagtttggggagacccagcgaggccgcctaggagaacagttagggcttcgaatctgttagacttgagtctgaattggctccaccggcttacttgctgagtgaccttgagcaagttcctgctgctggaagcgtctcctttcccatctataaactgagaatcagaaaaactggcgtagaagataacacacagccgggcgcagtggctcacgcctgtaatcccagcactttgggaggctgaggcgggtggatcacgaggtcaggagatcgagatcatcctggctaacatggtgaaaccccgtctctactaaaaatacaaaaattagccgggcgtggtggcgggtgcctgtactcccaactacacaggaggctgaggcaggagaatctctcaaactcaggtggcagaggttgccgtgagccgagatcgcaccactgcactccagcccgggcaacagagcgagactctgtctcaaaaaaaaaaaaaagaagaagataacacatgtagggttttggcttcatgtgtagcagatatttggtcaatggttgcttattttttggcgtcaccatagggagaaatatggttaaaagggggaaagggatggtgtcggggaagacagagggaggtggcattgggtcagcagcactgtgcagagagaggaggttgctttggggatgggagcctggccgggccatggaagcaggaaggtgggagagtcaagaaacatctttaggccgatgcagtggctcacgcctgtaatctcagcactctgggaggccaggagttggagaccagactggctgacatggtgaaaccccatctctactaagaatacaaaaaaaggccggacgcggtggctcacgcctgtaatcccagcactttgggaggccaaagtgggtggatcatgaggtcaggagatcgagaccatccaggctaacatggtaaaaccccgtctctaccaaaaatacaaaaaattagccaggcgtggtggcggacgcctgtagtcccagctattcgggaggctgaggcaagagaattgcttgaacctgggaggtggaggttgcagtgagccgagattgcaccactgcactccagcctgggcgacaaagcgagactccrtctcaaaaaaagagaaacatctttagcattttctaaggatccctgggggacgggaggcaggtgtgcggtgagttgggggattagaagctcccagggctcttccgtcagctgctgggaccccagatccactgtgactttccttcccagggaagacccttcgcacagtggagccgctggacagccgggtgcccctgactgcggtggctgtcatgcccgccccccacaccagcatcaccatggccagctctgactctaccctgcgctttgtggactgcaggaagcctggtctgcaggtcaggggggtccagttccctgagcactcgcctggttctctggggacctggcaaggaggagagactccccaaaaacagaaagccaggatgttgttctggggccctagttagtttctctttggtgctagatcacccacagccacacatcctgcggggcaggactctggcctgtgatgggggtggggttctgggcttttcatgccccctgatgagggtcagaggctcaggccttcctgctgtgtgggcttgggtggtgggcagggccttggggagtgtgagatgggaaggtggtgcctcagctcagccgccctctccctgcagcacgagttccgactgggcggtgggctgaaccctgggcttgtccgtgccctggccatcagccccagtggccgtagtgtcgtggccggcttctcctcaggcttcatggtgctcctggacacccgcacrggcctggttctgcgaggctggccagcccacgagggggacattctgcagatcaaggtgacgggccgggtctccctccccttgctgcccaacccccgcccctgtccagccatcacccctgcttagggtctgcctgcccgggttcaggctcgaactggtctgtcttatatacctggtccaggactaactgggcagggagggtagccctctcggtccaccttgggagccagttgcactgcaggggtctcagcaggaggcaggccatgggggcgggagccacggggcagtggggcgggagctatggggcagggctgaccctgttgctcatggcgatgttctaatgagtaacccttgtccatatttgtcttgcttggaggatcaggggtcaggccctgtccgtgacctagttcaggttaaataaagctgagctgggaggctgtttactgcctgtagaccgctgagcagagtccatggccctgccgggctgccctggctgggggcaggagcacrcctgggcatggggatcctgyccccgtctccttcccctccccctccctccattctcagtcacaggcctcrgggagctgctcagggaggcccaggaggggaggaacagggcttcgtgtgggaggatttctgcaggcagctgggactttcctccccagcttggctggaggccaggagtcttgcattgccctgctgacagcaggctgtcgctggctccctccagagccccagggaaccctcagctcaaggtgcccccaaattctaactttccaagaaagtgtcaggagggctctggggtcagcctgggtgttaatcccagctctgctgcttgctggccccatgaccttggtatggttacttcacttctctgagcctcrcttttcctgtttgtgaaatggggacaatggcagcatccaccgcatagggttgttacgaaggtcaaggtcgtcacgtgcacgcctggcaccatgcctgtgcgtagttctcaagttagagtgacgactgggttacggatgctgagcgtattaaaatgaaccaacgtgaatatggtgtgtgtgggagggtggcggcttgtcacccacccaggacggcctgtctccctggagagaaactgcggagggaactgggaaggccttggggcccaagggtatgcagaaggacccaggctcctgctgaggctctcctctcccgggacaggcggtggagggcagcgtcctggtcagctcctcctctgaccattccttgaccgtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccrctcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaagggktgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgaggcttgtctttttttttttttttcaatagagatggagtctgactatgttgcccaagctggtctccaactcctggggctcaagcgatcctcctgcctcggcctcccaaagtgttgggattacaggcatgagccaccacgcccagcctgaggcttatcttgctggtggtgtcagggtggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagtgaggagcagcacagtgagggtgggaggcggcctgatgcagggagtgaggagccggacagtgagggtgggaggcggcctgatgcagggagtgaggagcaggacagtgagggtgggaagtggcccgatgcagggagtgaggcgcaggacagtgagggtgggaaggagcctgatgcagggagtgaggagccggacagtgagggtgggaaggagcctgatgcagggagtgaggagccggacagtgagggtgggaaggagcctgatgcagggagtgaggagcaggtgtgagggcgggaagcggcctgatgcagggagtgaggagcaggacagtgagggtgggaaggagcctgatgcagggagtgaggagcaggtgtgagggtgggaaggagcctgatgcagggagtgaggagcaggatagtgagggtgggaggcggcctgatgcagggagtgaggagcaggtgtgagggtgggaagcggcctgatgcagggagtgaggagccggacagtgagggtgggaaggagcccgatgtagggagtgaggagcaagtgtgagggcgggaagcggcctgatgcagggagtgaggagcaggacagtgagggtgggaaggagcctgatgcagggagtgaggagccggacagtgagggtgggaagcagcctgatctttgcacgggctgccaggcttctggttcatacagccccaggtcagtttccagaaccctcgctcttgggtaggggaaagagacattgctctggagtggcaggacggtgggagaagttgagtccctctcatttctcctccctcaccccctgccttccatcccagtctgaaggcagccaacctgatcctgggcttggaaggttgggggtgggcttcctatcctgggctctctgcataggctcttgtggcttcccctttcctcccctcaggagcgggaggcagctctctgggagaagaaaggacattgggagtgagaatctggatgtgcctcagcccagctctgtgtccttgggcaggtcacatggcctctctgagcctggctgaaccagggataatccacacctcgtggggtctctggaaggcttaacacagtgctaggttcctgtgctttctggatccgccctcttggctagccagatccagtctcttcaactctctcctcctgaactttctctttccaggctcggggggggggacccaaatatagggggttctgcgtggctgcctcagggttagatgccctggtgggaaaggggcttctggcttcaagatcaatgtttaactggatgtgcaagtcaatatttaccagaagagaaagcaatctgaacaggggttggctgagagtaaaggtcctggtgggaggggaggggtgggctgggccagctggagcctgggcagagagtgaggagcacccaagtggggccagaggaacgttgtgtgtggcagcaaggagcccgcagaggtatgaggggaggggctgctcggcctgctccttgggtaggagaggaggagggagctgcctccctggctgaggggtctgggatttattcaggaggcctgtcactccccagcctcttctgggacttgaaaaactggagcctgttcttggcaagaagattctaatgcccaggtcggagtcggggccctggccaagggctcttgtgtgggatgggggtggggccggggggaccaaaggatcctccagaagggttggccccaagatgggggtgggctggaggtagctgagacctgctctgacttatcctcctgagaccaacacctgcccttcccagagccagcctggagcagaggcctgtgatgctcctaagtgcagaggtggctctggccagagtcattcactgggctctgctgctgggtcaaaaggcagctctctggctgccttgccacccatggtgagacctcagggcctcacaggtatgtccagccttgtgggcaagacctgaccagcctgagaaagacgggttggggccaggcgtggtggctcatgcctgtcatcccagcactttgggaggctgaggcaggtggatcacctgaggtcaggagttcgagaccagcctgaccaacatggagaaaccctgtctctactaaaaatacaaaattagccaggcatggtggcacatgcctgtaatcccagctactcgggaggctgaggcaggagaatcgctttaacccaggaggtggaggttgcagtgagccgagatcgtgccattgcactccagcctgcatgataagaatgaaactccatctcaaaaaaaaaaaaaaaaaaaaaaaagacaggctaaatggatgcagcaggctgggtaggagctctgtgttggagctctgcggtggaggcttcagggcaggcttcccagaagaggtggccttgagccaagctgaccccagccatcgggggagtgccaagcattgtactcagggtttacaaagatggtcttatttatttttttgagacagagtcttgctctgtcgcccaggctggagtgcagtggcgtgatctcggctcactgcaacctccgcctcccgggttcaagcagttctctgcctcagcctcccgagtagctgggattacaggggcccaccaccacgcctggctaattttgtattttcagtagagatggggttttaccatgttggccaggctggtcttgaactcccgacctcaggtgatccacctgcccctggcctcccaaagtgctgggattacaggcttgagccaccgtgcctggtcacaaagatgggtttttgcgacgcgcaaaggctcccgaccggagcacacgccggctgacctgactcgaggaagaggagccttcacgtgcgtcctgcacccttggccctgcgagactaccgtgaaccccgagaagggatcaggcgccgatctgaccaaccggaggcgggataagccactccctaatannnnnnnnnnnnnnnnnnnnactgctgactctggggcaagggcagagaatggggcctcccaagggaggagacagccacaaagactgtgatggggaacgtgatggggcagtacccaacaggcaggagaagggcac

SEQ ID NO: 17899 - DNA, 38998 bp, Homo sapiens
ttcccaatgtgctgggattacagacatgacccactgtgcccggccttaatctattttatcatgattctggttcactgcaaccgccgcacctcttgggttctcagcctccctagtagctgggattagctaatttgtcagtttaattcttaaaccagctgcagaacctaagagagtagaaggaagttttcctctcctacactaggttgtatgttagttttctgttgccactggtaatgatttgggacacaacaataagccacaaatttagtggcttaaaacaacacaaatgtattatttcacagttctgtaggtcagaagtctgacatgtggcggtggctaacgcctcccaaatcccaacactttgggaggcagaggagggcagatcacctgaggtcaggattttgagaccagtctgaccaacatggagaaaccccgtttctactaaaaatacaaaattagctggggctggtggtgcatgcctgtaatcccagctactcgggcgactgaggcaggagaatcgcttgaacccgggaggcggaggttgcggtgagccgagatcgtgccattgcactccagcctgggcaacaagagggaaactctgtctcaaaaaaaaaaaaaaaaagaaaagaaagaaaaagaaaaagaaaaaaggccaggcgtggtggctcaggcctgcaattgtaacactttgggaggccaaggcgggcggattgtctgagctctggaggctgaggcaggagaatctcttgaacctgggaggtggaggttgcagtgagccgagatcgtgccactgcactccagcctgggcaacagagtgagactccgtctcaaaaaaaaaaacaaaaaaacaaaaaaacaaaaaccctgtctctactaaaaatacaaaaataggctgggcggggcatggtggcaggcgcctgtaatcccagctacttgggaaactgaggcatgagaattgcttgaacctgggaggtcaaggctgcagtgagctaaggtcacgccactgcactccagcctgggtgacagagtgagactcaaaaagagtctcaaaaagaacataataaaaattaaaataaataaataaataacataagaaaaaaagaaagaagtctgacatgcgtctcactgggtgaaaatcaaggtgtcagcagggctgtctgtgttcttttctggaagctctggggaggatccatttccttgctttttctggcttctgaaggcttcccaccttacgtggcttgtggcccccttccagtgtcaaagacagaaatgacaggttaaatacttctcatgtcacatcactgaacctgtctttcctgcctccctcgtccacttttaaggacgcttgtgattacactgggttgccaaggtaatccatgataatctccctattttaaggtcaactgattaacaaccttaattccaattgcaactttaatttctttttgccatggagcataacgtattcacagatttcacagatggggacatccttggtgggggggcattgttctgcttaccacagtttatcagtagacaagagagaaaacagccaatttagggaaataatatatatatctctattttctgctgagacatctccacagtgtctttacagactgataactagagctatttctctagttaacaaaggcagagtggccttccattgcaggtatttaccatggcaaatgccaagcttctttgtgcaaatgtttatgtgtgtgctaagcattttaaatagatcttttgcatcactctattttcacactgtgaaggatataatgtagttatgagctttgaagatggacagacctgaatttaaattctgactccattacttattacacctatgaaccttgagcaatttacctaatcttccagagctttaatttcctcatctataaattaaggattaaaaacagctagcagaaaaggttattgagttgaatgcaataatgcatgtgaggccatgagcagaggctctaagtatattttgaattgtttttccctttagatgttttcccaggtacctggctctctgggcctaggacacataatcccagagggtataaatctagtgcttggtcccaacatggttttgctccctaaatactgaaatagtagacaagacgacacacctgaagcccgaaagaggtaaatttagtatacaaggaagggaatactctttgtcatataaaataatagtaagttcactaaactaattaatgcataaactcaactaaattgtgagttaataaggttgtgatgtaaactgaataaaacataaagaatggtttagttctatttggtgatcacaaaaatatattagttactaaggaaaattaataatagcctgtgctatgtgtcaggtcccaatgtgaagtgctttacaaacatctcacttatttccaccaactaccaggtgttacccctgttttactgaaagcaaaccaaagttaaggaaaggtgcataacttgccatcattataactgtcaatactgatgaagagtatgttatcgtcagtcttatgctccttaaggatgtaggggtacttctatatcttttgcgggcaatgatggatggaatattgggctgaaccaattagtatgttaattttaaacttctgcttgaagaaaggatctatggtaggtattagtagcgagagatgagaggtatccttatatcttttaatttcatattcttttcctatgagagaagggcaagaatctaggaaattaattcagttaactaatatttattggacattttctattttccagggattacgaaatatccctcttctacatttatcatttagacttcaattgtcttcactgaaaactgaggggcttagttttaaagttctttttttttcctttaaatatctaagagcctataaatccactcaatcttcattttctcccaactagaccttaaagtggcatgcagaattatagtgagacacaggtgggctgtgtatggtggttcacagccacagttggtggtggggagagtaaaggttatgatttccttttttctctacttcttcctatccatatttgcataaaaacatggtcacacattcttacttgattacttgtagaaagacacattccaaagatactaacacctttagggtaaaggacatctcttccttcacaatttattgcagaatgctaggtttacaggagaagcttgaggaatgcttaagcaatgttcagttgatatgaaaagttctattagcttaacttctagtctatttgcttcagttgctgccaaacatcgacagcctttcaaaccaggatccttccttatttagagaagtttgcaggagggcttccatttccatacaccggattaaatgcttttccttctcacctgtttaggctaatggccttcagtgttatgcagagtaaagacattctgtagcctccattcagaagaaccattttgtttgaaaaagaaaagtctaattcaagcagagtcattaaatgaaaatgagaaactttagaaaaattaagaaaaaaaagttgagtattctctagggaacacagattgttttgctgtttagaccgagataagttcttcaatgcctgctctcaagctgatttagtctatgaaaatgattttcttatggatggaggctttcctataactttactttgctgttgatatatttcttttttatactaaatcttttttggtgggaactgtttagacctatgaccttagaacactggcctgacttggagaaaaatgaacttgaaaagaatcctgtgatatatggagcacacacctttacatataaaaattaaactactggcccataatcagtatagctcgcctcatgatagattattctcaggctaaatttataacaggcactcaacaaaagtattcatcgcttatcccctaacattatctagtagctataggagccggtgacctagtaaataataaaaaaaaatctttaggggtggaatgtaactatatgcagtagcggtaattctgctccatttgtaaggagggtgaaatgcgatatggtcatgtaccctcttggtacacaagttccataggctatagaaaaacaagtccataccctctgatatctgcattccttattcttgttatagcttacaaatcttctttagacacttaacagtgataattctcccagggaaactaaggaagcacatgagtcatgtttcttaactttaatgttgtataatctgaaaattatctatagatgctttttttttccattggtgctagaaaattccgcctaggctcaatcgatatccatttctaaacttctgcaagaaagctttaactgctttgacatgccaaaaatccaggtgtgaattaaacaacgaatgctttacctcgttttcaccactagttctaccagtcagaatcttttcaaatcatcctcagccagtgcctgtcatccacggcctggtaacacaccctttcacctcctcataccccgtgtcttcgcttttccagtcctttggctgccctccggtttcttccctcacatacctgtctgactagttcctagaagcctggcagaaattgttctccgattttaatctggctgccacaaatgaaagaccttggagtccaaatactcctctctcaaagcaaaatctaaatggatataatttataagcaaagataacacttctgtttttttctctataaacaaaccatgcatgggcttttaaaggagaaaaggaagagtggattgacagagaaaataactgtttaggatagaggttaggaaaagactgagagcaagagaaaaggcatcaatcccagttgttaatccacgaggcatcccccagacccttctgtaaaggttaatgaaggcagtaaggcagttatctctgtttcgtgcactgatgcaatccaagcttccacggtttagcacatagtagacgctctataaatatttattgaatgttgaacgatgagagagtaattaaaaaccggtaagttgatatcataaatacaacgacaacggctcccctatcaaatgtttagtgttcccagagacagccccattgttctacatctcgttatactctggccttttcccgtttttgtcattcgaactcatatacatattgaaatcgaagcacacacaaatccctgaaatgacaaacttaaatgctatccaaaggaagttacattaggttgctgctttgaaaatgaagtcaactcctaatgggttagctgtttctgcagcattctttcccgccttcttggagttgaggtgagggattaaacaatcaaccttctctctcctttctctcattctcaaagtttttctcgccttttctttcctttcctttgcttcatttcttttcccagtctatcgtttctctaggggtcgttgctttgctctttctccctctctgtctgttggtccctttgatcctttctttctaccccttattcccagcagctccagaaaataccttctttctccccgtctcacgtcacttccctcccttctcccatctccctctcctctccgagaggtgcgttccccactagaggccagcactttcttagtttcgtccttccaaccggcgagcagaactcggagagaaagaagggggtaaaaaagaggagaaagagagcaagagaggaaaaaacccctgggcctggagcgcagaggcccgggagctgcgtcgccatggcaacgggcgccggcaggaaacgagggacgcgcgggagggagggggcggagggcgccgaggggaggcggagggacggcggggggggggtccggctgccccggaagcacctccccgcagccccctcctccagcccggcccgcagcccctggcctgcggcccccaccttctcggccgggcaggaagtgacaggcccggagcgagccccggaggcctggctgagccgcggccgggcccgcacccggagcggcgggaggggcggggagccgcggtcgcgccgggcgcctcccaccccgccctcggcgcccccgcccctccaggaaggggaggaggcgaggggagcccgccgcggaggccgagcgagcccccagcccagcctggcgactggggaccccggcacatgaggtggacgcccccggggaagacttgggtgcacagccaggcgagaaggtaaccgggcgaccgagggccggggaggggcaggacctctgggggcttggctgcgcggggatgtatcctcagccacctccatctgtgtaacgccccaggtacctcccccagttgctttccctgcctacctccggcgctgagctctgcggtccttcggctctgcctgtccgagtcttctggctattcattctgctgcgcttcatgctgtctgtccgtcaccytagctgcctctgactgctcattttcttattcatttttccttctctgactttggtccttccagccgagcatgctgtctagttatctccctgctttcgtggtccgctgggttcctcagcctccagttccttgacttctgcctctgctctctgtatgcacatgtcccagctcacttgggtcagttcattcccggcgcaccactggatcyacccccttcccccagtgtatttgatttctctttgaaacatcattttcatcaaggttctatatagaacgaggacccttgggcgtctactccctgttctcttgattattaccgtgtctttggcacagtcttccctgaaccacccccttctcccgtcccccttcctatgtcccatcctttctgcatgataagagtttcgtgcttagggatattgactttctccaactctcggcccaatgctaagtccacctcaatgtcccattctaactcccttcggtaggtctgtgcgcctacccaaccccatgtatgcccacatgctaccttttaagatgaccatggcttagctactctgggggcatctgtggatcagcttctcactgtcttccagtttaatttggaaaattttgatacctggtgctgcccaaactgtttgttgtctccatttttttatatttaatcttgtagtcataatgttgatcacaaatgaatacatttatgtgcccgggatccaggaatcctggttttggtggcagtttcccttgattttattgagacttttaagttggtccctttacatttttatttctagttsacaatccaaaaaaaattattaatcagaattcagktttgggaagacgaggggtcatacggtttgtattttcacatgtgaatgtaggaattatgttctctatacctagcaaaggggtctcgtgtctctgagtccagtgaactaaatccagtaatctataaaactgtgccgtgctgcctctaatccttacccactttttttcttcacatgctgataatgaggattcatgggtctgtatctgtttagtgctttgatattttggcaaaagatgtggggagaaggtagactagttgaagctgatatgatttttcctatgtactttttgggtratatacatgtttgcagtgacatttgctagtcctaaatgaaactaaagaytggggggggataatagtgtgattggatgatactgggaatgagataataagaaatatcctcagctttattgccaaggccaagcagtttgatactttgcttgtttgtttgttttggatgcaatccctaagaccagtccattcaccctaatgaaactgttgacaacacttagcagaaattctggtttgatgtttatattcttaagccagataatattttggtgacctgatatttctagtggcccagtgcctcagaagtagagaaaatagtgtgtagcttaacaaaagagaaaaacaaaaaaaaagaatgagtaaaaaccttattgtcatttagtgctgctttggaagaatatttcttcttctcatctcctgcctctttgcttggttcttagcaatgttttcatatgtgtctttttgcaaatgtaagtgtagtccccagtgggtaaattctgacatgttagtagattataaagttgcatcttactttcttgaagattttcattgtgtgtatttctatgtttcatacyccggagtcatttcttaaaatgatatattacattcagtatgaagcctyctttgcagtgaggaaacaggtataaggaaggaaagcaacatgcctgaggtgttattagtagcctgagctggaaccaggcagctatttgggctatgtgggctgtaggtgagctcttctgcttcctagttttatgaccttccatgacccactgaatgtgtctgtatcttaaggtcctcctccataaaatgaggataactactcactatcatagtgaatgacactgccttaattacagtttggtttgaagaagcatgtgttagtccaaagacttgatacttactagggcaacttctttaacctcagaaaaccttatgtctcaaattgtagaatgaggataacagtgttgactttacagcactactatgagagagatacagcataggtgaagtgcctagcccagtgaaaggaggcaactagtggctctccagtatatggtgactcatttggatgataacgatgcagatggagacaaaaatgagataaccaaaacttttaagtggaaagattttaaactgttaaaaaatgctatgggaatgtaaggtaactttggtattgtaaggtgccatctcacattctggccgttttatttaatgacagccatgagggaatacgtaaaggttgtttcttttgagactgcatagcttcaaaagatggtagtattgggaagacatggttgcaagagtgtattgaagatttgggagttttaagatgagaaatcatggcttatggaagaggaggaagattcttagatacttatggatttcctgtgtttttgaataataacatgagataacagcttgggatcaagatataaattttaaccttttactgcttccctctaggtcttgagtcagacagagcaccagccttggggaccctggaccactatcatggagactgagagcgagcagaactccaattccaccaatgggagttctagctcagggggcagctctcggccccagatagctcaaatgtcactwtatgaacgacaagcagtgcaggtgagactcagctctgaggggccatggtctgtgagtcttggcttgtggtaggcagtgatgctggaaaataattgtactcagttctttttcaacaaactggggagagttgggttagatgatgactaagctgtcttccagctctgagaatcttaggagtttacaaatgtttaggcaagcaaacagtgaaatcyggtctttcaaataaggatttaaaaaacacattcagtccatctagctagattctaactaaccctttctcatactggattgccaggtttttaatctttggccattcttgtaaatccccttgagtaatagaagtatcatggaactctttagagatttatttttaaacaaacagcaaattccatgtttttattaattctgttaggaaatgaggtcttttagcaaatattttggttactagaataactatacatatcataaaaatagttctaattattaaagaataagaatacagtaaagtccagttagcactaaaaccaaactactattttcatttcataaatctgtattagcatactgatatgtaaaaatgccaattagttgaattcgttgaaaattttacgtgaaggaatctttagaagccactatttattttttcattatttccaacccattagggctgtattacctttactgtatacctaaaatatacttttacattttctccttttttttttgagacaaggtctagctctgttgccctggctggagtgcagtggtgcgatcagtgctcactgcagcctcagactcccagttctcctatcttatcctcctgactagctgggactataggcacactccaccatgcccagctttttttcttattttctttacattaatcggcattttgtttattttcacccgatctagtctttgctatggcatgtatttccagctcccaattggagaaacaagtttgtataaattgcactgctttacttttcttaacatcctatggagaataaaccatagaattacattcacgcgtcacttaatgacaggaacgcgttttgagaaatgtattgttggacgattttgtaattgcgtgactgtcatagagcgcacttacacacacccagattatgtagcctactccgtacctaggttatacagtataggctgttactctgaccactcctgtgtatgtagtctgccattgaccaaacagtggatatgtggtgcatggctgtaattgtttcttccggtttttaaaggactatatagacttactgaggcagaaggatctctctgtttttttgagatggagtttcgctcctgttgcccaggctgcagtgcaatggcgcaatctcatctcactgcaacctctgcctcccaggttcaagcaattctcctacctcagcctccctagtagttgggattacaggcgcccaccaccacgcccagctaattttttgtatttttagtagaggcggagtttcaccatgttggccaggctggtcttgaactcccgacctcaggtgatctgccctcctaggcctcccaaagtgctgggattacaggcaggagccaccacgcctggctcagaaagatctcttgaggccaggagttcaagaccagcctgggtaacatagcaagaccccatctctaaaaataaaaaaaattagctggacatggtggtgcatacctatagtcctagctacttgggaggttgaggcagtcaggaggattatttgagcctaggagtttgaggttacagtaaactatgatcacgccactgtgctccagcctggtgatagagcaggttgactttgctctaaaaaaatgaaggaaaatcagccgttgacgatttagcccaaactcccatctcctctggtttctgtccttcccatggccccctttcacacaaatacagtgatttacatagaataggagctaggagtggtccattctaaatrttttatcctctcttttcctaggctctgcaagcactgcagcggcagcccaatgcagctcagtatttccaccagttcatgctccagcagcagctcagtaatgcccagctgcatagcctggctgccgtccagcaggtgagaggtcagcagccagctggcccgagagggaggggacaggcactacaggtgggtaggggagattttttgggcatatagcatcctatactaagccaggctgcagacagcctcctccgcctcctgtccttctgtgggaggatggatgcatcttagcttctggggttgcagtaagaaccgtaaaatcactttttaggtatagagtggctgtgttatagacctgcattgtctaataacgtagtcactagccacatatcgctattgagtgcttgaaatgtggctagtctaaatggagacgtcctataagattttagagttagactacttagtacaaaaaaaggtaaaatatcagtaatttaaaaatattaattacatgtgaagtgatattttatattgggctaaataaaataaattatgaaagttaacttttcctgttttactttttaaaactttgcatagtagaaaattataaatgtggttcatattatatttatattggatacctctggactagacttttactgactcatgatatgacytgaccaaaagatctttttctagctgggcgtggtggcttacgcctgtaatgccagcactttgggaggctgaggcaggtggatcacttgaggtcaggagttcaagaccagcctggcctatatggtgaaactcattctttactaaaaatacaaaaattagctgggcgtggtggtgtgcacctgtgatcctagctactctggaggctgaggcaggagaatcgctcaaacctgggaggcggaggttgcagtgagcggagatcatgccactgcactccagcctgggtgaaagagcgagactccttctcaaaaaaaataccatctttttccacctaaaagagagtgggagctggaggacaagttgcctctctgccccaggagggttatgtggggctaattggttagcatatgtggtaatgtgaggatcactggactagtgaatatacttttctttaccctaaagtggaatctccctgtttataatgtgaaatctctatgttttgtgcttgtgatttattactagaagactgagagctttttccttcactgtctttgctatttcttgtttcccttcccctttaataggccacaattgctgccagtcggcaggccagctccccaaacaccagcactacacagcagcagactaccaccacccaggcctcggtgagtacgccctctcccactgagaggcttctctacctgggtctttgtctctgggttaaattactttgtgccgctgatctgagagtgtttattgagccgtcagtggatagttactgcttttaagtagagaatagtagtacaaggggaaagtaaccaacattaatctatattggagtctctaaagaggaagtctaaggaagagaggaaagaaaatcctggggaagaagaggagataacaaagaaggggactaatccctggactcttcaatgagaagtaaaatctgttctgtttcaatcttttgtcttctcaactgttaacactagtggttagagactgttggttttttttcactttggtaataccctaaagtagccaggatgacagttttggatatgaagacattatttatttcccccggctccatgaaagtgaaatactctgttcttgactgtgtgactctgaatttgtcagtcacgtacctttccttttacttctcccaaatccttagtcctggttcctttctgtaccacacagatcaatctggccaccacatcggccgcccagctcatcagccgatcccagagtgtgagctctccyagtgctacyaccttgacccaatctgtgctactggggaacaccacctccccacccctcaaccagtctcaggcccagatgtatctacgggtaagccacagatgcagtcaccattgccccagaggcataattgtctggccctggcaaagacttgagtgaaagcttttttttgagacagaatctcgctatgtcacccaggctggagtgcagtggcacaataatggctcactgcagcctctgcctcccaggttccagcgattctcctgcctcagcctcccaggtagctgggattacaggcatgcaccactatacctggctaatttttgtatttttagtagagacggggtttcaccatgttggccaggctggtctggaactcctgacctcaggtgatccacccgcctcggcctcccaaagtgctaggattacaggcgtgaaccaccgcrcccggccaaaagccatttttttaaaccatggtaaccctgatgttttgagagaagctgggacctacttcccatactttacttaacctggaagtgatgttctgtgttcacaggtagcctatagattaaattgagatattatgctagaaaatactggcttaacatttgactaaattagtgttagatatagtcgacctttaaacctgtggctcaagtatacaaattctgtgttatcgctcagcctacctactttctatatataagtacttgttctaaaatcctaattttctctatttctttgacgtgtgactcttkgacatcaatctgtagttttctatgcwttctaggttttcttctggatggttcattacatgtggagaatatgaggctcctgggttggtgtggaagaggcagggctcagctgtttaatatcttctgtttattttgtcttgtggtccttcctttccatctcttctgtctcttctttccctcttgkcctctttgctcttcctcttcctctccttgccagccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttagtggcgatgactttacctgtgggtgggcactgggcaggatgaagggaatgaccacggacctgggtccacccttctgccccattacacttttcagaattcttactttttgtgttttgtttttccttcccttaatcaccatagaacttgaatcccatataacctttgagttaatctgagttagaaagacaaggagatttgcctgaaaatagtcttgtggatctgggaagtcttattttcaagatagggtaaatttcctcaccatccttctagtcctctgtgggtttgttttattcggagagtcttaattctctcatagtactgtcagaagagaagagattgttgagagaattcttctgttagttagatgtaaagctgacctggctgagttactggaggaatgtttggttgcttctgtttgtgagttactctagttctcaactttcagtcttctcttcctgttcactgttttttcccagtaaaggtcttcctcaccattacttctcatgacttattcccaaaatacatgtatttttgagcctggaattttagcttcttatagatgggacacaacctaggatcttacgataattatttcatccttttagtttatttatcagtaagctggtaaatgttgagttcttccttcatgtacttttggccctccctgtttatgggtttcatacctgtaggttctgcatctctggcttccacatccgcagatacaaccaactgcagattgaaaatatttgggaaaggccgggcgcggtggctcacgcctgtaatcccagcactttgggaggccgaggcgggtggatcacgaggtcaggagatcgagaccatcctggctaacatggtgaaaccccgtctctactaaaaaaatacaaaaaattagccgggcgtggtggtgggtgcttgtagtcccaactacccgggaggctgaggcccgagaatggcatgaacccgggaggcggagcttgcagtaagccgagatcatgccactgtgccccagcctgggcgacagagcgagacgccgtctcaaaaaaaaaaaaaaaaaagaaaatatttgggcaaaaaaacaattaaaaataacaatacaagaacaaaaaataatacaaaaatacagcatcgtgtaaccatttacatagtacttacattgtattagatattataagtaatagaggtgatttaaagtgtatgggaagatgtgctatgtgcacagatgatgtgcaaacactgctctgttttataaaagggacttgagtgtctgcagactttgatgtccatgagcctggaactaatcccctgtggataccaaggaacaattgtattagaaattttgcaggattaaaaaagaaatgtgagtcaggtcttcaaagagcttagacaatgaaagtgctaaattaggctgggcatggtggctcactcttgtaatctcagcactttgggaggctgaggagggtggatcacctgaggtcaggagttcaagaccagcctgaccaatatggtgaaaccctgtctctactaaaaatacaaaaattagccgggcatggtggtgtgtgcctgtagttccacctacagggaggttgagacagaagaattgcttgaatctgggaggtggaggttgcagtgagctgagatcgtgccactacactccagcctgggcgacagagtgagactccgtctccaaaacaaaaagaaagtgctaaactaaatggtgctaactttgagtgacacatgagtttggaaaagaattggttacattactttgcaatgccttattgggatacttgagcagagtcttggacgagtggatttgatttggagtgagaagaaaactagagagagaacagcaagcgtaagagtatagtcatatatttaaatrcgagtatgtgtggtaggcgttggagatgaggggataaataaaatagaatcaacaggcatgrtgatagaagaggtcattgctggggtagagcatataaaggaggttgtagttaacttcataggtcacagggatcattgctagctattgaacagcagattaacaagatgaggaaagtacttaggaagaactatagggagaataactgttctaacagttcctggagaagagaagttagggaacttgctaagaaactcttgtggtcatctagctgtaaggcaagtctttgttttagactctggtgatagcaatgggagccacgagtgaggttggttccatttccatatccagttctttgatttatccgctcattcattcatcagatatttgagtgtcaatatgtggaggaacagagggcagtagttaaaaatacgcatctgatgggtcagattccagctccactacttactgtgtgaccctgtgcaaatgatctgacatctttctgttatcgtttttttcatctgtaaaataggtattgtaatatacctacctcaggatgtgttgtgaggactaagtgagttgctgcgtttgactgcttgaagaatgcctggacgtagtgagtgtttaggagaaactactgctattaatatatcaaacattccttagcgttggatgcccaagaaagtcacgatcactgcatttgtggagctcacagaccattgaaacaccagacattaaactgatagtcacctgaatggggaaataattgagaaagtaccgagtgttctgagaatttagaaagggacctaacttagctttggcatggggtgtaaaagtcaaggaggtgacatttaacttggggtgtgtagaagttagccagataagaatgtggaaggagagtgttggaggcaggagaacagtgtgtccaaaggtcctgaggagggcaggaacttgatttgttagaggaattaaaagtcttgtattcttggagtttggcatagtggggctagacgggtaggaggaaccttatctttcagggctttgggggctgtgtttaggattttgggctttttataaaaagcaattggaagctatagaaggattttaaatatggaagtgtcatagagagatttggatgtatttttgttttgttttgctttttaaataccatgttgatttcctctttggagactaaacggatatggtgtgagtgtgactgtagggagaataactgttctaacagtttaagggacagacgatgttcatactgggggtagcaatggagatggacagaaatgcatagatttgaggataacttagaagaatcattgaagagggtgaactaatttagtagatgggggaattaaaggagatgccagataggaaatctgtggggtggctggtggtgctgtttatgagacgaagaatgtaggagtgtatttagagtgacgttcagttttggacatgcagacctaattagaagtgtttgtgagccatccatgaggagatactgagactgcagttttattatgtggttcttgagctcagaggagaggtctgggttggagataaacatttgagagtagtaggcatatagatgataattgaagtcccccatctactaaattagtttactctcctcagtctttaaaattgcctggggaggccgggcacagtggctcatgcctataatcccagcactttgggaggccgaggcgggcggatcacctgagatcaggagtttgagaccaacctgggcagcgtagtcaaactctgtctctactaaacatasaaaaaaaattagccgggtgtggtggtgcatgcccatagccccagttaacttgggaggctgaggaaggagaatcacttgaacctgggaggtggaggttgcagtgagccaagatcgtgccactgcactccagcctggtcaacagaggagactccatcttaaaaaaaaaggccagcgctgtggctcatgcctgtaatcccagcactttgggaggctgaggcgggtggatcacccgaggtcaggagttcgagaccatccagcctgatcaacatggtgaaaccccgtctctactaaaaataacaaacattagctgggcgtggtggcacatccctgtaatcccagttacttgggaggctgaggcaggagaatcacttgaacctgggaggcggaggttgcagtgagccgagatcgcgccgttgtactccagcctgggcaacgagggcgaaactccatcttaaaaaaaaaaatgtttggggagatagtacaggttgaggagaggaacgtttaatatggggccctgaggtaggatgaacccccactttggaaaagcagttcaaggtcgacagaggatcgtgggctgacagaggcgaatgggaaagagcagcagataggaaaatctggactgtagtgtcacgaaggcaagggaaccaaatgttacaagatgtgcatgtgtgcatgcgcgcatgcgtgggcagggggcatctctttctaatgtagagagagaaagaaagatggttttattaacagggagggagagttgtttcagttgtttggggggtggtgaatccaaagtagtatgagtttgaggggtgtgaatggctggtgggaatgaatacagtgactgtaaacagctattaagagtttagcagcaccaggaaaggaaggtggaactggggaggggaatgtgcagttcctacatggtgatgagggagccagtggagaagaagtggaagaggaggcagtggatattatatgctgcttgagatggcaggaggaggtggaatatagagtgcagagaaggactgattgccttttgataggaagaggagagaagggggaaatgatgggtgtgtatgcagataaatgtatagattcggtggtggaactgatgaagcaatgctcatataatggtttttgttttctctgaagaggtgaagagtaggaggagaaagagaaggtagtctgaggtatagggagagagtgggaaagtttgaaatagccattatggaaatgaagctgattggaaaaactgtatattaataattgccagataatattatgtgctctagcacccaatcctgatgattcttgtcaatatctctcaaaagccatcaactctttactgctcctgcctgaattcaggtttttattattttaacctgtactgtactagttttctttctttctttctttctttctttctttctttctttctttctttctttctttctttctttttttttttttttgagacagagtctctgttgctcaggctggagtgctgtggtgtgatctcggctcactgcaacttctgccttctgggttcaagcgattcttgtacctcagcctcctgagtagcttgattacaggcgcgtgccactatgcccagctaatgttttgtatttttagtagaagacggggtttctccatgttgctcctgctggtctggaactcctgagctcaggcagtctgcccaccttggtctcccaaagtgctaggattataggcgtgagccactgcaccggcctattgtactagatttctacatggtcttcttcacttcagtcttaacctacttgtagttcttttccacattactatcaggaaacttttactatgtttttttaaataagaaaatatatgttgttactactaattttttaatcgtacttctggtacacagaatttgataaaattgtaatccttggatcatgacactctctcactgttggtctcgtcataactgttaaaatttatttactctgtaatttttaataatgtaataagcagtgtgcagttccgtctactgccttccattacccacagtaacgagccttctgatttctaagtccattcttccctcgggtccttttttatatggttttattgcatctctctatgtttctaaaatgccctttttattatagaaaattttaaaggtacacaaaaacagaaaaagtatgaattcctgtgtacttaccatccagcttcaacaattatcgacacatgaccaatgcattcaggcccttctctgcctgtggaatattttgaagcaaaccccagacaccatgtatatattttaattgtattgaaatgtgtaaggtactcgtgctgtatgtacacttttggagagtgctttcttaataacattgtcacgatccatttgttttgttgcagtcattggagtttattaattgtagtttctatatactattccattgtatgaatatactatagtttattcatcttctcttctgtagatggccctttgagttgattccaggtcgtggttgctaatgaataatgccaccatgaacattcctacacatgcctcctgtggtacatggcaagagtttgtcttgtggaattcctgggttagagggtgtgtgaatgttcaactttaggatatgataacaaatattttctaaaataggaagtgtattgatttatacttcaatcagaaatgtataaatgtataagtgaatgtttattttgattaataagctttattggcttcctataatcagttaagcagacatcattctttccctttatccatattttggagtactgactatgtgccggaactgtgaaggtgctaggaatataacaatgaataagacagataaacttgctgttcccaaactaaagttcagattccttgtttcaatacaccaggcccttactggcccagcaccttcctacctccttatccacagcctgccttccttgctttatttctttccattccttgtaactctccccaaacataatgaaatatttataatttctaaaaatacagtctttttagaaattatacattttttttaataatattttaaaataatgtctttttttttttttctggacagggtctcactctgttacccaggctggagtgcagtggcgtgatctcagctcactgcagtctctgcctcccaggctcaagtgatcctttcaccttggcctcctgagtagctgggactacaggtgtttgccaccatacctggctaattttctgtatttttttgtagaggcagtgttgcccaggctgttctcgaactcctgaactcaagcagtctgtccgtcttggcctcccaaagtgttgggattacaggcatgagtcatagcgcccagcctaaataataatccttttttggttctggccttgcaaatgctgttatcaatatctttaaacccccaccttcaccattacctactgagtgtcacatcagtatcacttgttttaggaagcccttccttgatctccctagtcttagttgatattccttctctgtactcctrtggtactgggtgcatatctatacatcttattatgtcataagtgataattttcttgtcttctgtagtagaaagtaatcattaagagcagagactgtgtctttcctctgcatttccagtatccagtgtagtacctgaagcatagtaggtttttgggaggtgctgaatgattgaatggcgaggaaagggataattgaagagatattttgaaggaataaaagaccacacttgatgataaacttgctagtgagtgaagatggctgaagaatcagatacrgagccagagttcctccttaggaggtaggaaggccttaaagtatatggtaaaggcagagatacgagctgaggtattctgtggaatacgacacaatagcagtcctggctgcttttgaatctttaaccttaatgcctccagtcctccttttctcaatctgttttttcgtatctttcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggyggaggcagtgggaatagcatcccagggtccatgggtccaggtggaggtgggcaggcacatggtggtttgggtcagttgccttcctcaggaatgggtggtgggagctgtcccagraagggtacaggagtggtgcagcccttgcctgcagcccaaacagtgactgtgagccagggcagccagacagaggcagaaagtgcagmwgccaagaaggcagaagcagatgggagtggccagcagaatgtgggcatgaacctgacacggacagccacacctgcgcccagccagacacttattagctcaggtaaattgtcattcctcatgtcattattctctcagaattcatgtgaaattttcctttttttctttttttgcctttttttctttgcctttttgttttttccccgcttctgttggtccttgaatagtggaaggaatgggaataatatcagccttgaacatattagttcagggtcaggaggacaagtgacagatacagattttatctgtttctaccaggcagtagtcagcttacaagttcccctgtccgctttcttaggctgtgagttcttcagttttatcactctgtctattcattcatcacatcttactgaattgcttactgttttctaggaattactggggatacatttttgaaaagtagattccctgtcttcatgtaacttagcatttactataagggatgaattctcacctcactgtttaatgtggttacttgatccagtgtatagcagatacagtacaatgccttagagcacttaagactaatggagaggcggggtgcggtggctcagtcctgtaatcccagcactttggaaggccaaggcaggtggatcacttgaggtcagagtttgagactagcctggccatcatggtgaaaccccgtctctactaaaaatacaaaaattagccgggcgtagtggtttacacctgtagtcccagctgctcgggaggctgaagcaggagagtagcttgaacccggttggcagaggttgcagtgagctgggatcacaccactgcactccagcctgggtgacagggcaagactctgatagtttatacttgctttcagactgcgggtaagatgtagttagatgtgtgtatcttatttggtcatgttgatttttgccttttyttgtttctagtaccttagttgttgatgtatttagataatttactcacaaaaaaattaagagttagttattactatacttggtatttatatactctagcagttctatttctaaattgctttatcatcacatgctttgatctctggacaatctggtacaayatggagaagtagagtttgtcactcccagtttacagtggaggaaactgagttaggtcagagctgacaggtgctgactctcaagactcagatggtggtctaagctgatgatttgtaaaatccaagtcatttgtgggawgacgttgrcatctttaactctgtgggtatctcttctttcagtgaatattaagtgcttctgcagtgtcaggccctgggctgtgttttagggatgtgaaaatgaataaaacatggattcagcctttgagaaactccaagtctaatggaggaggggctaaccattcttctttgctgagtacagagtaaaagaatacaatatttaagtatggcaaagataagagacacaagaaattactcaggatctgaaatgactgagcaaggragttctttctctgagatctttaagactagtagtagttggtaatgtctgattgagtgggaagagtatggacgaagtgatgtccaagtttcatactgactagatttcttttcaccgcataattccaaaactaggttataccttggaaaaatgaatttacttttaatttaraatgattattattctctgctcttttttctctctgttgtattctgggattgttcctatagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagmaagcccaaaccctggtcgttcagcccatgcttcagtcttcacccttgtctcttccacctgatgcagcccctaagccaccaattcccatccaatccaaaccacctgtagcacctatcaagccgcctcagttaggggcygctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccggtgagtgatgtctgatggttttgagggcactattatgcatgagagtggacctgggctaagtggaaatagagcttaattgaataggggaataaagagttaagagggttaatattggtatttatctgcttcttctgtaagagagtgacacattatataatatctgaactttataytcctaaatttgttgctgatactattctgggtttttgggtatgtaataagttagatcaagatagccttaaccaaatcagtctttgaaaaaacaacagttcttggttggtctacgtgaatacagggtctcaagacctaggtcaggactaaatcatgttacattttcttttgtcctgatggaaagttactaggaatgaccaggaattttagtgtaccatgggaagtagataaattgggaaatctggaactaagaaaattttctttgaacatatggtaataattgtggttccttattatccttcatttgtacatctttgtttctttcctattctttacggtatagggtaaaccccagacattggctgtcaaacgcaaggctgactctgaggaggagagagatgatgtctccacattgggttcaatgcttcctgccaargcatctccagtagcagaaagcccaaaagtcatggacgagaagagcagtcttggaggtgagtaactgacttctaatgctgttggagagcacacagagtagaggaatgttctgagtgagctaaaagataaawctggttgagtagaaaatgggccagaagttggtggacaaatgaatagatccaaaaacagggaatccaggtgaattgtcaagggtggacatagattattatggaagatcatgctggctcaactaatagatggatcaatatgtcatctcatgtctgttgcttaatctgtgtttgttttccagaaaaagctgaatcagtggctaatgtgaatgctaatrctccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgaggrcagggccataaggtgggactttgaagtggggacttggtctgattgttgtcttttcaaactccagtaaaagtaaaaggcacagaactatttaatgaaagaatggttcaattacgctatttatttaattataaagaaggaaagggaaaagagtgtgtggaccataaaatgaaaatgttaggaagaggagaaaaaaaggaagaaagtaacctttaaaactgtaatgtttagttagataaactagtttgttttataatgaataaaattatagtaatgaagttaaggagctttcctagggtttgcagaaccaggactagaactgaggtgtcttgactcctagtgcattctcagcaccataggaaggaagaggacaaaatagggagccagcgtaggaacctgttctccaatggcttatctggaaaaaaagccagttactattttttttttctcatttccaaacattgtatagagaccagttactactcttgattaccgtattgaaagtgattctctctgaaccagacttggtcattaactcagagatccaagcagagrcataattgatggggaaatgttggggaaagctatagagaagcagaaggggatcaggctaacttaactctcaatgttttctgggacaggtgggttgttctcagttactgaaggagtctgagaagccactacagactggccttccgacagggctgactgagaatcagtcaggtggccctttgggagtggacagcccatctgctggtgagcatttatttagagactcatttgggggaaggagactcgtggagatgtgtttgaggactcggtgtaaaatagtagttacctatttatttaaagtagaaatgaggcctggcacagtggctcatgcctgtaatcccagcactttgggaggccaaggcaggcatatcacctgaggtcaggagtttgagaccagtctggccaacatagtgaaaccctgtctctactacaaatacaaaaattagcctggtgtggcagcatgcgtctatagtcccagctactcgggaggctgaggcgggagaaccacttgaacctgggaggcggaggttgcagtgaagtgagctgcacgccaccgcactccagcctgggcgacagagcgagactctgtctcaaaaaaaagtaggaataaaatgaagtctgtctacatatagaaaccatattatatatcagagtatgtagaatcacggaaaaggaattacataaggtgaggggaatttatccagctaaagtaatcttttgaattattattattatttttttttgagacggagtttcgctcttgttgcccaggctggagtgcaatggtgggatcttggctcaccgcaaccagtgcctcctgggttcaagcgattctcctgcctcagcctcccgagtaactgggattacaggcatgcgccaccacgcctggctaatttttgtatttttagtagagacggggtttctgcatgttggtcaggctagtagtcgccaactcccgacctcaggtgatccgcccgccttggcctcccaaagtgctgggattacaggcgtgagccaccacgcctggcccttgaattattctttactctatagatgtattttttggccgagtgtgatgactctcacctataattccagtactttgggaggccaaggccggtggatttcttgagctcaggagtttgagaccagcctgagcaacatagtgaaaccttgtctctacaaaaaaatataaaaattaactgggcattgtggcacatgcctgtagtcccagctacttgggaggccaaagtgggaggatcgcttgagcccgggaggtggaggttgcagcgatccaagatagcaccacggcactccagcccgggtgacagagtgagactgtctcaaaaaaatttttttttccaaaagatgatctaaaataggacatttrtatctttaatttccagttctccttattctagattttataatctatcttaaggactcttactgattttcccactgcttttggaaatctttgtggtagaaggatcttatatctttctaggcattagtagttcctctctcctcagaaattgaatcatatctgaaatctaagagtatgaattaggataaaattagtaagacatctaaaatggagagagttcggcttaaggttaggaagacgtcataaagttctcamgggacaagtcttcgtgattttaggttttgaactttgcgttttagggattctcaactaggttgtgtaggtttttgggggtgaaccctgagaataattttagaatccagctctgagcctaatgattgcctgaggggcagcagaaacccatggtgactgtccagcaataccttgttttttagagttagataagaaggcgaatctcctgaagtgcgagtactgtgggaagtacgcccccgcagagcagtttcgtggctctaagaggttctgctccatgacttgcgctaagaggtactctgggcaccctcctccttgccctcagcactggtatctccatctaatgttacaccccttccccaggatcgtctcmtagctgatattttatgtctccctccttgcttttattcccttccccaaatcagctcataagcagaaattcacatttagagcagggtggtcytctgtggcrctattgacatcctatatatgccctgtcctgtaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccgggtgagctgcttgttgtagagccagatgcctttaaactgggtctttttttctttccctgcagggcaattcatttgcccaggtaagagggtgtgagatgagaactctggtttcacattgattgcattactacaaattccaagagatcctgaccccctttgtctccrgacctcttacccaactactggttcatgtttccattaatccttacactgtacttgagtacaattgttaattgtactcaattgtactcaatttctctcaattgtacttgagagaaaatctagatcaattgttaggtcatggggagaatcaaggaagtgatacagtttctatttgaaagactttgagagtagattttgggaatttgcaaataaartgctgcttatttcacatatgataagatgagtttttcttctacgcccaacccagggtggtttgggaagaaagagagaggaataaacctttgacactgacctcattggtttgctcttttcccctatagggtcaagaagactctagccggggttcagataattccagttatgatgaagcactctctccaacatctcctgggcctttatcagtaagagctgggcatggagaacrtgacctggggaatcccaatacagctccacctacaccggaattacatggcatcaaccctgtgttcctgtccagtaatcccagccgttggagtgtagaggaggtgtacgagtttattgcttctctccaaggtactgaccctytcttcaacagaacccaggttgttttccttaacatcatcccacaggggccttgataagagggaaagtaattgacttttaagcagtaggagcttgaatgctaatatagaggctctactcctaatattcaagttgacttcctaatttttttctgggttgacattatcttctgtaatgtcagcaattttacagtrtttgattctcatcttatgatgtagctgcatttytcactaaatttttggataaaatgtttttgtgtaattaactatgatacctcccatggggaaaaaattttttttttcagtggagcagggtattagaaactaagtggccattgttgccccactcttcaaagagggcttgtttgctagtcttcttttttttttttttttaaacagagacagggattccctatgttgcccaggctggtcttggagtcctgggctcaagatatccttctgccttggcttcccaaagtgctgggattataggtgtgagccactgcactcagcctatatgcaattttgacagagtttttttcggaaatgaaaatcaccctacccttcttgctatttgtctgaattctgggcccttaaacaaaaatatcacaaagaatctttttgccagtataaaagaaaacatgcttttatttctgttctctccctttcccctgtctctaagctatttgaatgaagttatttctgtggttgaacaatttagttgcttttcctttcttggtcttggactttggttttgttgttgttgttgttttgagacagagtcttactctgttgcccaggctggagtgctgtggcatgaattttggcacactgcaacctccgcatcctgggctcaaatgatcctcctgcctcagcttcccgagtagctgggactataggcatgcatcaccatgcccagctgatttttgtatgttttgtagagtcaaggttttgccatgttgcccaggatggtcttgaactcctgagctcaagtgatctgcctgccctggtctcctaaaatgctgggattataggcgtgagcctctgcacctggccattttttaaataccagttgctttctaatttcattttgcttttaaagcttgccatctgacttcatattactgaatttaggacaggtactttggaattaatcattgctagacctcagtttcatttagcttcccttctcctatcatctggcattacctacatgttctcaccatttcttctaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatccyggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctyccccctcccagtgtagctgtggctcagagttttttytttttgttgtcacttactcccttgtgattgaattttttctcctgcatccatggcaggatccccagccartatagagacttggttggcatcttctgctgcagggactaaaagtatttgactggggcacatgtggctgttgtcattctttctgcatcccactgttcccctccaatttatgttattttctaccctgtttttcagttccatctctgctctgtcctrtagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttktttaatcattaagagtttttgtacaaaargtgatggttttttttcttcattttaaaacaccagggtgtgggggrgggatgcaaacaaataacaaaaaagatgcttttgtaacattattttccctgtttagaaagaaaaaaaatcactccaatagtattgaaaagtccaaagatgaaatagtttcattttcttttcctaaggcttataaaaggscccctgcctrttgattccatccctcttttgtgtccagtggagycatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggartaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcmctgcaaagtagttccaagcagcaaraaataccagattctcatggaggctactatagggtacagaataacaacatgaaarcaatcaaccctgtataaataatgtttcttggcattttttttttaattaaagaaatccagtgtctcaaaaacttgtgaaaatgtgtttaaaaaacaaacggccagtgagcctgctacaccattttgcccatatgcctattgtaacttctgatgtcaagagacaatgcaaaagcctctgttttcacaggccctattatattaactctgacttacaactgtacctctctagagaaaaaacagaaaataaggaacaaagggaaggcagttttactagtgagaagatgcaaatcaaaagcaaactggaaagcaagagcaatagtaagggtgagatgagggactggagttgagactgcttgagaaatctggctgtgtagctttggtttgggggactgaggaagaggctggacatataaagtgcaatctacattggtaataaatggtcatccctttcttctgactcctcccccagctggtcatcccccacaccacgatatgctgcaggcacatttcgaggtttagaacggcagacaaagtcacagccatcctgtagggggagaaaaaagaaggaaataattcgcagcatctaactttaggatatgagaaagtgtacttatggtctaggaatgtggcaagaattggttttctatagggataatgagaaaacctaaaagatctgacaatcagcctaaattcaatttggggcaacaggagaaaaagtttcttcttattaggcctcaccttcttcccacccaggccctcttaaaagctaaatcagatttagaagagcccatctggtcaacagtgttgctctttcagcaatgtcttaccaaggccagaaatggatgctgtgccacttactactctgtactagggcaactgtcttgtttgctgggacttttgtggttttagcactcaatgtcctgtgtcccaggaaccccctcagtgtgaacaaacgaggatggttggtcacccaaccttgtttgcaggctacaaattcaaccagctgccctgttacttactgctaccaggttgccaagatcctgccagaaggctaagtggggaaactgctccattcctttggctcccactaccagtcgctggtataggaaccccccaacaacataaacagcaaccagtgatgcaaacctgtagagagagaaagacatctatacttaagaactgggaaatagtaaaaactcagataggataacctctgcatttattgtcagctgtttcctaagatacattccctgaaaaggaaaaatgagtagtgatactaaatgaaaaagggggctggtaactcttagaaaaccagttagagtgctgtcagtccaagagaagcaaaggcccagacaaaatgtgacagcgtgtgattctatggccaagaataatcaccattaagtatatgattccatttctctagaagttctcataatctaatgaaataatataaaaattgcctagtcctgcagtaggggaaaaaagcacctccaaatgcaaatctataccggcaactaaacattaaatctcatttttcaaaaacttgcagtcagaatttttttttttttttttagacggagttttgcccttgttgcccaggctggagtgcaatggtgcgacctcagctcactgcaacctccacctcccaggttcaagtgattctactgcctcagcctcccaagtagctgggattacaggcatgtgccactgtgctggctaattttgtatttttagtagagacggagtttcatcacgttggtcaggttggtctcaaactcctgaccttaggtgatccatctgccttggcttcccaaagtgctgggattacaggcgtgagccctgtgtcctggcagaattattttatagccagaggatttaaaaagttatccccatcaattacagcataatgtacacatacaatttgtgcttatgtaccaccatatagttactgaccttaaaaacaaaaggaaggaaggtctgttctgataaaggaaggcatactcacgtgacaagtaagatggaacccacactgaggtgggagatctctggtgaacaggccaggctgctatccatctcaaagaggtagaaacaatcttggactttgccacgctcctcagacacagggttaaaattgtcctgatgatgagatggcataacacattcaggtggttaagtgttttgactcctgtccaacaaaataaaaaacccaaaaaacatctgctccttcctggttcagcagcctattttccatggaagatgcgtgtctgacacagagagaaactgagctcctagttttctaatgtccatcccaacgtatcgtgtcccctctggatattctccccaacctcaggtcagtcctttcagtctcctccctcggcttatacaacacagggtgcctcaccgctagggtgtgtcgattgcaggagatcatcaccactgcacgacgctgctccttgccacagtggttgtcatattcatcaccccctttatagatcagcatgatccaattacctgaggagggacaaggaaaatggagctatggggtgggggaaaagcagaggcagatctgggtggtatggcagagtggaattgcgtaattcattgcaattggttataactaaacaaccctcatcagtacgaacttggtataccagaaatgccaagctaaacttgtttgcttacaaagacttgtgttcccttaagacaagaatcagatattcatttaagaataatcttaatttttaacattaaaggtaggcaactgacaatgcaaaaccaattatgatccataccttaacactgattcattttctgaataccttctaaaagcaaaaaaagaggttccatacaattgctgagcagcaggggtaagcccatctaagatttcaacttagccccagataaattcagagtggatatctaagattggaatgcatatctcttctttagtatttactgtgttcagttcttttgcaaaatatcatttgattcagtaattgtgaggtgaataaggtaaagattctgctcctagttttgcatatgagaaaacaaggtcaaaaggtgatacgactttccagtcacaggattaggaaacaggaggagaacctggtcacatgatccccagccccaaacccttttgttacttttttattgtattatttaccaggagtaaatagctaccttgtataacttatttatctgtatgggagggaattggaccataggtgcttacatggtcctctccagcaatatgacttttaagaaatatcaccaccatagcacaaaaatcagtgggtaaagttttgcagactgagtagtttgcaaaaaaaagtttgagctcttaaaatttaactggtaaactttgattaatttgatgaaaagtggtggtggtggttggtatttttaagtctagtgtgaaactcattaaaagtatttgggtgaataaaaggactctaggctacagaattctggctagagttggctgggcgcggtggttcatgcctgtaatcccagcaccttgggaggccaaggtgggcagatcacgaggtcaaagatcaagaccatcatggccaacattgtgaaaccctgtctctgctaaaaatacaaaaattagctgggcatgatggcacacacctgtagtcccagctactcaggaggctgaggctggagaatcgcttgaacccaagaggctgaggttgcagtgagccgagattgtgccactgcactccaggctgggtgacagagagagactccgtctcaaaacaaaacaaaacaattctggctagagtcttcattttgcataagtttttcactgattttaatgcacaactgtcctgagctgtggcttacagaggagctgtggaattaggcatcctgtggtatattacagtctcaggtgtgccgaaccacacgtatgatatgctgaagacactagaaacggccaagacatacaggattgtcagagggattgacttgggatcagttagtcaatcgatggtaggaaggggagttttcttacttccgttgaagatgtgagtctcgttgagtctccctaccactgtctccttcccattacttttgttgatttgcaccaggcctgccccagaagtgtggttgccagcttcccggcacaccctgaagatgtagatgtatgtgtctgaaccctggcccacagtgctctcaaagctgtaaagagaagtgggaagaaagaagaggagagttactagctatcagcctcaggaataacagcatccctttccttaattaaaacaaaacaaacaacatgctcgatttatttatttgaggtcatggctgagtgaatatttgtttaattttaagatattcataaccttgacagaccatccttattgctgatgatgaattattaaaacacacttgagctatcttgatagctcaatattctagttatttttagaatgcctgttagtaaccatgttccaatgaataagggcccatgttcatcggatagtctcgtttcttagggaccaacttcagatttatatatctgaaggttcctgacacttataatgacatgtgtcggcctaaatatgtttatctgatatttctaaagtcctattatatgtaggtgtcaaataatccttaaatttctacaagctggtctcttggatccagtcttggaaatagctacacttctgtgaaagatgagaaaactgcacacagcaactaaaaactgggctgagaatttgctctatgtcataaaagagagcacattatgaaataaaatcagtaagaagaaaagactttaacataaatattttctcaagctctttaaggttcttctcatttaccttttattaaacagtggtttcagcctcttcactagagccaactctttctctgactctttacccttttctcctaccaagtcgcaagttttttcttctgtctgccaggattctctcactgccacagccaggagtagtagtagcagtccagtcctccagcagctgtagaaagggaacatcctttgggagagagtgtgtgttggggagggcaggtaggatcaggagagagaggaaagagataaagcgtatgaatgtgtaataaatcgatggtattttaattatccagaaagtacaagattctctggcatatgcaacacatagtacattttaatatctctgtaacaagagcatctgcagcagaaaattcatttatatgtaacttgtagtctaatgtataggtgagtctttcagaacaaactacaaagttgggaagagggaaatgaaagaacttaaaaaagaatgatgacagcttgggtggagccatccttgcctctttactgtttgatggcttgatgtagtcttctgaaacctctttggcctctacaggtcacaaatctcaagggtttctagacttcccataagtacagttgtcttttacactacaaatcaatgacaacaaattggggatcaccaagccactttacaattgagtaaattcaatgcacctgctgcttgtactgctctaggaatgaaaacacacagacagctctctttcccaaacttactagactggtgcaaaggtcattgtggttttggcaaaaaaaccccaccaaaacctaacattttcttttctcttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttggtttgaatattctttaaagttctctagttctttttcatgcgggtccacttactccacctcatttttaaaatataaaacttgaaacaggcagaattttcatgggtactaatgagtttgaagatgggaaaatggaagctccaaccttggccgtgaatgcactttccccattcccctaaacaacctaacatctgaccttccacttcccacaccccactaaagcaaaaaatcccgggaaattgtctacctgacttcctgtaccccaaacatcaattctctactgtaatattatggtagtttccatagaataatcatagctaaccaagaggtccaaggccctcataacacatttaatgcactgaaaccacacaacagcaggaaacaacagactactgccttgggccaggtgctgttcaaagcacttaacatatattaattaactaattaatcctcacaaccttatgagtaaat

SEQ ID NO: 17900 - DNA, 42479 bp, Homo sapiens
  misc_feature (1)...(42479): n = A,T,C or G, or insertion/deletion polymorphism (see Tables 1-2)
atgaaaacacaaaacaaattacatggtttgatgaaataaaccaatattcttgcagttttaaaaagaggtattaatgtaaatccatatcccaaatatgttttggtagtctagggagcacaacatacattcttcacccaagattcatcctaactggctcttcagtgaaacaaggaagtgaaatctgtcatagaattttaaataagacaagtttgggagcaacctctccattgcttgaaagattcacttttgatctgtataagtattcttatatttactattttaaaaagggcagttcattgggtataacaacatatgtaatatataattactgtttcttaattcattcaacatctagaatataaattcagttaatttattttattctctaagaaaatgatctctctctgatgaacattcttatttaattttatcctgagtgatagaaaatattttatcaacagtgatgcatcatcctatttgctttccaaaggggattcagatgttagaatttatttttatggaacactgaaaataagaaaggtcccattgttaaattaataaaactagggccttataaaattgaagtctggatattttgaataaagaactgatttcaactataaaataagatgtgaagagaaataggcacttctgagaacggggaatattttactgtgttcctttctaaattggggctaggcagatcttgacatacacttttctatatgacctgaaagagtgatggagaagtaaagatgatgtatgtgacaacccttggtggactgcaaaactgtagatatgtaagctattaaaattccaatgatgataaactatggctaaaaaaaatgccaagtcaaatggaataaactgtagtaatacattgtgttggcccttgtagtcgacaaatgcttgcttgggtaattgtaaaactcttctgctttattttggctccatttgtatgctctcttacttccactcatcttcccagctcttcccacatcccaccctcacccctagattaccataaacgtgcttattctctatcagtttaatatgggataaattaacctataataagcagtaaatgacttttaagaggtctctatatcactttttccaggcatgatcatactttttagatacgtaccaaacctgtatttgaccaaatgctgaatgactaaacataaaatccttttttgtacgtatgaagcaaaaattgtcatcacagtttgaacttctggaatagaagaataaatctcaagaattatcagaattttatcattttaatttttaattaaaatattttagttgatacatttgaaacatttgacattatagggtaaacacaatactttctcagcactgtcagctaaggcttctatactcttgggatcttcaaacattttccttgtattccttaaaagaattttattaaacatgtaatatcttacatacacttgacatctaaagtgtctacactaaaataagtgtagtataatactgatgtttaaaaaataaaatgtaataccactttttaaatgtatccgatgaaatgtagacactgcagtgattttttttggccaccaccgttcctgtaaaacacacatgaacacttttttcaccagcaggaaattttatatcactcttgtttctttttggtcttatattttcattctacttcctcaggtaattttatcctggagttgcatacttcaatatattttattgatcgccctattatatgtttctgcaactaaagatcatcaaagattattataaaaatattcttgagcctgtaaagttctaattagtaataaatgttttctaggttgcattatcattaaaattattatcaatatactatttataaaattatatatctgctataatcttaatagatattaaaaatgagaacattttgttcaaaaataattttttagtgaaataaatcatgtattccagctggctccctaagattgtgtattcttggatgaatattgcttattgctggattaaaacaagtttcatctattctctatttgttctaccctgctctatttcaattctagaatattgctattctgttttctattgtatagatgtaagcactaaggaaacctgttcacataaagagagaaatagaaataggggacgttctattataacaatgttatctaattatttaggcttccatgttaaaagccaaaggtcacattataaccattaaaaattacttttaattatctatcagctgataagtcctctgtaattttattgaaagcaaagtgctaaaccaggtcaattgcaacaggatttggaaatcagccattatgatcattcttattctcggttcctagaaagtattcaataaaggcttaaaaggacttataaacggccaccaatcattactttcttacttaaaaacacaacttttaccaaatatactcagaaagtttggaaattttgaaatatcatttattttaatatactttgtcaatataaagcctcataaaaggcttttatctgatcagaaccataacctgcacatttagctcatttcatttaaaggaagtctccaccagtaacctgatttgcaaagccagtccttattgtcaaaataaccagtcaaactggacttatttctaacagaaaaaaatgttgcattatttttaatttcaataaactcactaatatatattcccgggatgactctcccactttgcaattctaagatgaagagttgtgctgaatatttgttacctagatgaagtaagacaaccctactttggtatttctttccatgctttctgctttattcttatggaactctcagggggaatacaacattgacaagagttggaaaagggaagaggggaattttaaatgtgaattgtaatcatttctgtcacctctacaatatgtatgagtactgaaaatttcagaacaggccaaaagaatcaatttctaacatcatgtttttcttataccagaaattgttttaagacagatgggtatatgatacctacaatgggcttatgatgccttgattaagagagtttgtgcaaaagagaatttgtgcaaatattaatattttgatttatctttttgtaagagacaagcaaggcgtttttcactccaagatacatctaaaatacatattataactgaaagagaaaatgtatattaaaatcaactcataagttatgccttgattatattacagcaagatgacagtggttttataacattgcttacaacaatcgtaagattattgatcattcacaatttcaaggatcccagaaatgacactgacataaactgagggcaaagctgactgtaactaaaagattttagccaaatgtcaaagtcaaagataaatgtcatagcgccctaacaaatagtatgtgtttatcaaaagcgataaacctggagatgtcatcacaacaacaaaaactttcatgaaaaagacaagacaaaggtaagttacgactgtaattgtagcattaaatatagggactagaagagaagagatatatgtgaaaaaagttgactttgtaattgagaatagttttgatacattaattgtataacagatttttcaaatgatccaaaataaagctacttttcaaaggaactctacaaaagacattattacctttggacatatttctaaaccaactttattttcaaagagaaatgtgtttacgaagcattgagcaactttgggtgggttgagaccgaaagtatccttgccacttgagtatacattgggggaggcagagctggaatcattggcatatgtggaatgaaattaatgcatgtattagcacataagggatgtgaatagcaatacttttcataaacaaaaaaagcaggattattggttgtaaaatttatctaccatgttaatatgctgaataatcctgtacgttttctatccttgtgaatacttgggctggcagagaacaggctggaaaaatcaggagattacagactacgtttccatccttcaagtatttccctgcatggatactgagacgtagaacaaatgataaaaagaacatgatgaatgtgctttttgtcttattagaaagactcacacttaatatgacactatattaatattcagagatcaggccagtgggcttgtcaactgagctgtaattccaccagcctgctttagtcaatactgcaatggcgcttccttctatacatattattagaaactgccctagtggaaaataatcttctaccagcccagtcttgctttttatattagaattaaaatttttattcattaaaaacattattaggagagtgaaaggaaaagtcacagaaaagaaaaagatattttctgtatatataattgacaagtgcttatacccagaatatattgaagacttccagaaataaattagaaaaagacctagcaccttacacaaaacatccaaatagctaataaatatatgaaaaggtacttggtctccagagaaatgcaaattaataccacaatgaaatctctacatatcctccaaaatggttaaagttaagattcataatgccaagttttagtgaggatgtggagcaaccgaatctctcatccaattgtgaaaatgaatcatcattatctactagaattcatcatccacagagcctctgtcccagcaatttttaccgctacataaatacccaggagagtgacagcaaatgtgcaaaaagtcacgtataagaacatttgcggttgcattatttgtaatagctctaaattgaaaacaactcaaatgtcccacaacaggatatgtaaattgtggcatattcatacaattaaaactttatagtgtttttcaatgaaatagaataatgttaactgcatcagtgtcaatgaatcccatgaatatagaactgagcaaaagattccacatacacacacacaaacacgtatacacaaacacattacaaatcatataattctatttacagaaacactggtgtgttcattctaagtcatccagactagtcttctttcttgctcttagtgaatcaccaatggaagttttgctcaggagaatgaaatgtcccatacttgtacatgcaaacactgggatccccagttaccacaaccccaacctgatgggtctcctaccttcacctcctcagccatactaaactccttgcttttctttggcagttgagaatctttctacttgacttgaagccttcacaccttttattatcttctgttgtattgttcttctgtatatgttctgatagctaacttccttactgccttaaacctttgctcatctatcagcttctcaatgaggtctaccctgatcacagcatttaaaactgcaaagtctaaccccaatcttatgatactcttgatctcccttgctgtgcctttttaaaaataacatttgtcattttatgacatgttataaaatgaacttacttatatttcttgtttattgcctgtctctcctctctggaatataaggcagagatgtcttgtttttcactgtttcttattattcagaagtatatccactaataacaagcattcaataattatttgttgaataaataaatgaaaagaattatgtgcccatgagaaacaacacttgctttttctttcttaaaagtatataaaaagatgaatggataaattgaattgtatgcatatatttaatatagaatgaagcaataatatttcaaggagaatgacttaagaataacttcagatgatgtgaagtcagtctttgtacaagcaatcacataacagagtcaattatatagttttatcagcagatcacagggccttctttctcttttgttagtgacatagatgaatacacacacacacacacacacacacacacacacatatattctgtataatcattaaaaatgtcacttaatgtaagaaagaatgcggttctcatttacattcttctagtttattattatttcttgagaaaatattgctgggttcattataaaatagattctggctgttgcgtgttagcgcgcgtcccggagtgcgcatgcgcaacggcgggggttgttccggcagcctttcactgaggccacccgccagtttcaaattcagtggcgtttgccctgattcccggggcctggctttcagcgtagcaattctgccggcgaagaaggtgagcgcagtgctgtgtggcagcagaggtccttaggacgaggagcagcgggacgaggaagggcagactggtgaaatcgcaaactgggcgtctgttccggcgccggacccctgtttgcaaaggtgggtggcccgtccggagcggaaaaacattccggaagtggagggcygggccagcgtgattgacaagcgggaacccctgtgtggggacggggcmggcctaggaaggttgtgcctgcggtggaacggsgcggtgcgcaggagtsggcattaacagcagccgcgtgtctgggtcttagatttggcctagctgtgttgagcttttcatggattatgttacgtagataagacactgcaacagtgagtgagcgcttgtaacccacctgtctcttacagaaactgagccccagcgatactaactttagcaaggatacagctgggatcctaaacttggcgatcagagcccagagccgataaagttagctgcgtgagtctagcttcccccrgggcgggaatcgaggcggagcagggtacagtacggaggccagggatgagtgcagttgaccagattgttgacggaagtgtcataaaagtggacttaaatgttgataagcagctggttgggttccacacaggktgcgagctcaggatgcacgttggaggggacacagggycagagcaaggtgggaatgcgggtattatgggccaggccatcctccagctggtggagcaccgcagcactgcagtrtgtggccctggcttaacagcagtgcggaaaagcttttctcttggggctgtggtgctttccaggtgtgtgaagttaaaacattttagggccatacggtaggtagyacctgccacatagttgtcttggtcagccccggctgccrtgacaaaataccataaactgggtggcttagacacagaaatgtgttttctcacagtcccagaggcttgggatgtccaggatcaatgtggggaggacacaactgagcccacaacaatagtctgtactcggtaatgagtgataattggggactgaagaaaatgaacacgttaagaactaatatgttcctgaagtgctttcacaactctaacctcgttttatgagcgtgagctttgctgtcctggtgtgtgccttggcactgggaggtgatggttgtcctccacacagccaacctgaagagggctgaacaagtcgctgcaaatgtttttaatagggcttagtgaatccgttatactcagatttatctaaacctctatgatttagcctgtgctgcttctggaataatgagatccataattaccactgatggggaagtgaaataatacttaacgtttcttctgtattgtttagtgttgtcattctagagtttggtcaccaaatctgtcttttttatcccacttaccctggtgggaggaaaagtgaggagatagaaagtttcaggtggcttgggggtctggcagatgtggttcaaatcctgagttcaagcacttgctgagtgaccttgggcaagtcatataagtttactgagtctcagtttctttctctataaaatagagcttataaaaataccacacagggtttttgtggggttatctgaaaacggtttgaaaccattaaagaactggccatttaactaataggtattcaagtcatgggacctccgttacccagcctcggaagagaaacctttacttacagccccgatgtctggctggctcctcattcattcatcagatttttgttgaatgcctatgaggtgttgaagcacctagttctgagtcctggagccagagaagagcaagacagacaaggttcctctatttatggaatgtatattccagtgaggaagaataaataggttcagatggtgctaagagctatgaataaattaaatacagagtaatgtgatttttwaaaagtgacttagagcaagctagggggtgaggagtgggggtggtgtttgaccactgtccagcggccagacagccggagaggcttctctgaggaggtgagccaaagcctggatattgaggaggactccttctccaggccaaggggagcagcaagtgcaaggcccgagctgagtagatgaggctgggagccagaccagtctcaggctgaccagtgctctgtcttgagaggagctgctggtcagctttttgtcttgggattcagaacgaggagacatgaagactttttacttggcagtgggagctgaagctgaaaggtccaggggctgatgaggccacgtgtaagcgaaagtttgggataagcagaaaccgagtgcgctgagggagtgagattgtggctgtatccggcrcctggctgagcaggagagtgaaccccgtgggtgtgtgtttgctggtgacgttcctggagctgtcttgaagtccgagctgccttgcagctctagtctgcttctgtttttggctttcccagatagtttcaattcttactctcagtttgtgaacctcccttcagtgaacctcccttyacttatgctggatatctcttgcgactggatgagcttcactaaagcacagtcatttggayctggattcgaatccctggttttccactttttagctgtgagtttgagcaattatttaatttctgtaagcatcagtatccagtagctgtatccttatagtgttgtacagattaaatgagataataaaagcaaaagaccactgtagagtgtttaacacataggaggtactcaaaaatttgttaggtacctttcctcccctttccttcatgtgttaaagctttttcagtacatacccctctctcaggattgaattgtaagtcatattttttaattacccttcttgtaataattcctctacctctgtagtcatgtttttcttttttcattttgtcttgtccccagaatgtctaacaaaacagccaaatatacctctgtraagacagagggtaaaataatgctagttctgtgagttctcttcttgtgcaaatccataaactgccaccaatctgtagtcattttaattgcycctaaaccgaagagcatcrtggcaactacctttcccctcgtagagtgacactatcactagtcttaytgaggccaaagttataaagatgggctctcgatctactaatattagtaaaatgggtttgggacttactaacatttgtgcttagaagagacagacctggcaaagagcttggagaagtgagttccaaagagagaggtgtgggaaccaggatggaagagtcaggcctccagatagcgtttacttctcctttcttccttgaatcactgtctcasagataattaggttcagragaggaggaaaaaaaagatgacgtcaacatggagcagagtttttcttagaccttagcctagcaaggaaagagaaatgcctggtctcagtgctgggaagctgttycagccagagccccgtggctgtgaagagagctctcctgtctggagccaaacagaaagctcataggtcttgaggccagaaaagttagtaggtggcggctctggtcggtgctggaaatggaggccaggatgaactaagaagcaaactaaagatacttgtaakataaggacgtgtaggctgggtgcggtggctcacgcctgtaatcccagcacttcgggaggccaaggcgggcggatcacgaggtcaggagatcgagaccatcctggctaacacggtgaaaccccgtctctaccaaaaaaaaaaaaaaaaaaaaattagccggccgtggtggcgggcgcctgtagtcccagctactygggaggctgaggcaggagaatggtgtgaacccgggaggcgagcttgcagtgagccgagatcgcgccactgcactccagcctgggtgacagagtgagactctgtctgggaaaaaaaaaaaaaaaaagataaggacgtgtatgttaacttgcgctatccaaacaagctgtgcttatggtcctctgcctgtgcgtcatgattttccaggacttcacaacgggataaagtgaagtagcttcggcttgtgaatgtgcattgcagagacgtgggagaagaaagctgcaaaagtcattatragcaacacccttgatcttaggggtgctggtctktgagaagagagctctaagccttttgtagaggyattagaaaggtatcggmgccacggtgaaatgcaggggagattgggtttaggggctttcctggtctgcattctgctacagccgttaaatgccgctagatggagtgcgtgattctggtatggcctcaygtggacctgcgaaggatggagagaacatggtctctgcttcccagaawaaaaggagaaatttggtaayaagtgtggagactgctcttaaataatgctccagatttcaagccacttcttcctggaccatgagagagctccctaatgttgtatttatttttcctaggtccatggctaatgaaacacagaaggttggtgccatccattttccttttcccttcacaccctattccatccaggaagacttcatggcagagctgtaccgggttttggaggctggcaagattgggatatttgagagtccaactggcactgtgagtatgaacagtgagagatactgaaaaggacaacttwacggcagctgtgctagcttttcctgtttgcccatccagagattttcatagtatgaagttgggcagaatagttgctctcagtttatctttctgagtaatagtcacttcctctattaaagtcttttttttttttttttttttttgagacggagtctcgctgtgtcgcccaggccggagtgcagtgggacgatctcggctcactgcaagctccgcctcccgggttcacgtcattctcctgcctcagcctcctgagttgctgggactacaggtgcccgccgccacgcccggctaattttttgtagttttaatagagacagggtttcaccgtgttagccaggatgatctcagtctcctgacctcgtgatccgcccatttcggcctcccaaagtgctaggattacaggcatgagccaccgtgccggcctaaagtcttaaacatagctctgtggtctgagaaaaattaggctgaagtcattggtgcctacctattacggtagatgagatggctttcttaccaactcttttccctccggttccccatccttcaaatataattctaagttttagtctctgctgagtgaaccagtgcgttatgattatgttttgaacataattttgtcttgaacaatatgtcttaatattctgttttytctagttaataattgcccttttaaagttagtttagtttttaatatacctatgccagttcctcccacatcatccagtggcctctcaatatgattttccgtacagataactcctgtcttagtcggccaggactgccatagtaaaataccatagactgggtgacttaacaggaatttattttctcaccattctggaggctggaaagttgaagatccagattctggcagggttctggttctggggagggggtctcttcctggcttgcagatggctgcgttcttactgtggagcaagaaaagasgaggaggagaaaaacaaatctttggtgtctctttctcttttatgaggacaagggctgctcccttatggctgctcckttatgacctcctttacccttgaaggccagatctgtagtacagtcacatggcagggttaggatttcaacatatgtttgtttgttaagatgggcagtctcactrtgtggcccaggctggtctcaaactcaagcgatcytcccctctcagcctcccaagtacctggtggctggcaagatccaagattactggtgcacaccaccatacacagcttcttttgtttkgtttttgttctttaaaaacttttttttaacatgcattttggtggggatacaattcagtccacagcagtgaccaattccatttttaccttggagccctcctggaatcctccatcctttccgtgtcatttgaattagttgctcctcagactgacttgacagatttcagcatgagtgttartggggacagacggccgcacccacaccacgtcagggtataygtccgtttggaggctttcctcaaacgtctggcagccctggactgcctgtgtatgctgaagaasagggcacagaaaggctgagtctgcagggcaggctggctgtggctgccaggctgggctcctttgttgggggcctccagttgccagcacatctgtgggattttccctagagtcttcggtctctccagagcaggtgcctctgagctctggcccagcaggtacagacgctgaagcccaatagccggtcttccgggaggtggtctggggaaggggatccaggtggagagtccccctcagtgcctgctttcagcctgaccctcctctccctccctcttgcctcctcaatctgccagttgcctccagggytctcctagctcagcttccacttagagcccacttcctgtsttctgcaaggagcaggagcagggattgcaacctgggaatctaattgttcttaaacagaatttcaacccgtccctttgttttcagtggcctgctgtgttcctaccacttcctgagtctttctgagaatgagtgggggagatctctggggacacttgggcttgagtgtctctgcsgaatcacttccatgtctctgccttctttccctctctcctaaaacatattactccttccactttctttgtttttgtgggtgtaagcctccatattactttggttaattttagtgtgctttggaacacagatgagtgcatgttcattctgccttgtttaattttagagacagggtgtcgctctgttgcccagggccgagtgcagtgttaagatcatrgttcactgcagcctcgaccttctggcatcaagtgatcttcccacgtcagcctcctgagcagctgggactacaggtgtgcgccatcacacctarctaattttttaatttgtagaaatgagatctcactatgctgctcaggcyggtggtcttaracccctaggctcaagcaatcctccctccttggcctcccatagtgctgagatgacaggcgtgagccactgtacctgaccccttttaccttgtttagcctgacaacccatcttctscctctcaggtctttccatctcagtcttctgcactccaggcttctgcatcttcctcctatgctcagcctttaattgtcgatgtttctggttctatagcttcatcttcttgtgtgcactctctgtgaatgtaccctgtggctttattacctttgacattcttctgtcttctaaatcatctcctgaatagagtgttttctcctgtcctgggtgtcccccagcccataggagcagccatgctgtgggacaccctgagtggggtctgtgttacctgttgtgcctaccatgcccttccccgccttggatgcacaggtgccccaccttagctgcccgagatgctgtttatccttgatagtcaccttttaagccttmtacaggtctatcaagttgagtcaccattaccacttggtgtgtgctgtgccttgtgtaayactgcagttccgggagtcntccaacctggaatgcatgctttgcggggatctatgatgccctcgaattgtatgttacatgtgaacytgtgagcattttctaggggctctgcacctttgtgtyctcagctctgagccccatgcttgctgcaaccagcaggtgttcagagtgaatgaatttgcttatcttggcataaatcatgtaactgttgatgataccccaggaaggtgagcctttggttataaatccttttaacattttccagtctaaaagttttgtggtcttattacasgatgtagaaaacagkgggcctcagttattcttttgctgttgtgccggartataccacggttgtttttgaaagataactttgaccatacccttaggaacttcctcagctcactttcaaatggagggcactggctttctaaccattgtgtctcccagcccagtgacagctgaagctgwctgcttccgatrtcacagrcagcacagaagagccgccctccaggtgctgctgggaaatgctgcctggaacyctttgccatttactttctatcaaaagctgagggaaatggtacatatggggctttcctaaaaatatgggatccatccatttgtcagcaatgtcattctatcctatcccagggcctttcaagattttggtgaaaactaatagatcccatattccagaataatgctattaataattttattattattacttaatgatagcaaaaagttagctaactccaaccgctcacttgttatttgccaggtaatcctctaatccagaggatttggccttttgtgtgtgttaatgtcctgcttgcaccagctctatgaggaaggtgctrctgttgtcatttccatttctgcactcgtggaaacaagcgtagtgaggccagcctgagccacagagctgcaggtaggggaggcagctggaaccctggcrcctggctgtggagtttgagrctctgactcctgcgccgcgctgctgccccaaccstagtcatacgaggtgtttcaccccgccctggatactctgagatcccctctgggttcagcaggctcagagagctgactgcctggagcagaaggcatggggtcctccagagactcccctgagctgagttcccctgtggacaccagggccgcctccttgtggcgctccctgaagggtcctctctggaagaactgtattggttccctggggctgctagaggaaagcttcacaaactggggcttaaacaacagaaactgacatcccacagcgctggaggctggagtccgagatcaaggtgtcagcatgcttggtcccttctgagggtcgygagggaaagatctcttcaggcccctttccttggcttataggggcgtgttctccttgggtatcatsacatcgcctgccttctgtgcatgtytgcatccacgtgtcccctttccaataaggatattagccctttaggctgggtcccgtcctagtagtctcatcttaactaattacatttgygacagtcctatttccagatmaggccacattctgagatgctgggggttaggatttcaacacaggaatttggaggaatacaaytcaatcaggcttatggacaattctggtcttaagtcaagagtagtsttctccagtctgtatgtggaggcgcacacctatggtcccagccacttgggaggctgaggccagagaattgtgtgagcccaggaggagttccataccagcctgggcaacatagcaagacctcctctcaaaaacagacaaaaaaagtggtgttccagagtgattagtttgctttaaaaaaaaaaaaacaaaaaaacaaaaaaaaaaaaacacaaaccgtaaacactggcactcgtgactgatcatcctgtatccacgcacgagctgcacgaaggccgcgcggtcactgtggctcccygttggcgagtacctgggatttcttgctcagcaktttggggccttaattcttttaggggactttttgtctaatgtctccccttcttctaattatgtgcgatatttacatagaatctgataaactgcttcaaatttgttttcagaacagtgagctggataattaaagaagctttttcctgcttcttgggcccagtttccatttcttycttttttctgtttttcctggctattctagtgctartttccttcctttcctttcctaggctggycttagagcatcctctcctatgtacagccagaccttctttcaagcttttattaaaatggggaaaggtcatttgggaggctttgttgttttcctgtttctaaagatcatttttcttcctgcaggggaagtccttaagtcttatttgtggggccctctcctggctccgtgactttgaacagaagaagcgtgaagaagaggcacgactccttgaaactggaactggccccttacatgatgagaaagatgaatccctgtgtctgtcttcctcctgcgaaggggctgcaggcaccccgaggcctgctggagaaccggcctgggttactcagtttgtgcagaagaaagaagagagggacctggtgaaccgactraaggtgagacctggggtatccggaagtgggagtrctggaggaaacagggcttcagcgattgttstggggcgattccgagactcaggcagtgcatgctcccctgccgttgctgtgcctctcagctcttccctcagctccttgggtcgatggtgctgccgctgtgctgtctcttttgagctggaggtcagcagggccttctccacacaaggaactgttggtgcccatttattactcacctgggaaaggacctgatcgttgccattggcagcatrgttcartggctgcaaatggatctgatggagagcgtgtggctttgggaggagygtgccgccttccacagtgagcagcgaggctgggacctgcagggatgaggtcccgggaggggatgcggcagcccttgagtgctggtbggrgaaggagagctgcccscagtgaggaggcgccgrgctgagtggcccagactccttaggagasgcctggttttgggcttcctggtgattttccttcatgtctgcctcctgtaggyggagcaggccaggaggaagcagcgagaagaacgcctgcagcagctgcagcacagggtgcagctcaagtatgcagccaagcgcctggtgagcctcatttcttggggggcaggattatgtccaggcagggtcgcyctgcttggaggctcatgggtgcgtggccagggycttggtctcccctccatgaccctcactggctatgtgctcccgtacagaagctgggctgtgagtggttgaggcgtggatcctaggagtcgacctctctccagccaggcagccaggcctatgtgaatgggcgtggtgtgctttgtctctggcaygtggggaggtgggtactggtgctgagacttcttcctccctccccacctccactgcccctgtccagaggcaggaagaagaagaaasagagaatctcctccgcctcagcagggagatgctagagacaggcccggaggctgagcggctggagcagctggagtctggggaggaggagctggtcctcgccgaatacgagagtgatgaggagaaaaaggtggcgagcgggtgagacagaggcggtagcactaccctgccccaggccaggggacacccttgaagacagctctttccctcatgccacagatgccatgaagcacctggcaagaggcatggtggcctctgccctctgctctaagccgggtccctcctagggtccatgagtgccagtggcagtgaggacagtcaccggcctggcctgtgtcctctcagctgtcctcacagcagctcaggcagggcaggaacatttgygtctgcaccttatacacaaggaggctgcagccccacaaggagagactccttggctgaggccacaagcctcggcagtggagagctgggctagaactcagcyggcctggctctasatctcaggctctgaggcagctgactgcactgggtaacctttgaggtgccaaccgtcaaggcgtccttagcctgagctttccttctcccataaagcctctgttggtccagactcaaggtttccacttgatgagccatgagctgctgggtgacttagccctgagcaggccacccaggccatttcgggcccacaggatccctggtgacagccccgttcccattcacactggaacctcaccaccatccctgagtgtctgctctgagtatggcactgtccagatgctgtggacrtagaagggaagaagacatggaggggacagttaatagacatgaaaacaaatagcacctatgtgaagtcagcatgtttgcctacaaggaaaacaaaatggtgatgtggatggggtggggggctgcacctgatgatgagtcccgtgtgtcctgtgacatcctggccaccacatctgtgggagggtaactgcaagaccagagaccctccgtggatattcctgaaggttcatccccggccttcacggtctgtctgcagggcgccttctgacgccacctccagccgccatccaccagacgccagcttccccgctgccctgaacttcctccagcgcaccaggccttcctctgtcctgtctgaggatttgctcatgcaacgtgctgtggccaaacaccctgccctcctcccttcgcagatgtcttcctctcctttaaggcctggctcaggtgtcgtcttggtggcttcgggtgtcagctgctctgttttgctcacgcacctgcttgtgcttctgttgttgcctcctctccctggctgggctcgagctgcttcagggcaggaaccacgtctttacagtttgatgttcccagagctgacccagtgtttggcatagrggtgtgctcaatamaatcgagttgacatgaatgagcagatgctgcctcgttgcagtctggtagtgtaattccaggctgcscatgtggacytcgacttctgsccctgcccagggcagagaccaccrtgytgctttatgcctcgctggtgagagggggtcataaacagtttgtgctccatgaaccsttcctgcccacctccraggtcrtgtttctgctccctctcttctcccttagagcccatggggacaaggcagagaacttgagtggagatgaaggtggtgaatattagaggaacaaagtgctccttcaggtctgggcaagagccgtggatcctgtaggtcagcttccggggcttcccatgccctcacgtttcaggagataacgtgagcctcrgaggacctgagttctgaatagaaaatttttgckcttcatttcttcacacacccagcctctcagtgagctcctgctggctttgtccagcatgcgacataagattgaatccaagccttttaagatagagccgcctgctctttagtgaccatgaagccaagcctgtaataattactcttctgatagcccaagacaattgtattctgctttgttagaaaggaatttcgaggtgaacaaaaatgttttctttttatgtgatgttgccataggtggcgtgtgcctgtcagatggttttgtgttttctgaggagcatagactagtagagctagctcagcttcaggccatgggatgcagggctggcttccctgccaacgcctggcgctgatggattcttcccgcattgctggraagggcagactgaggcgctgacamaagaagagttgyagctggtcataagtgacagcatcctctgttcactcgattggtcagttgtagcttcatccaggagatggtcatggggttcctgctgcataccaagctctaggtgaggccayggggactcagcagaaacaaggccgacctgggtcctcccttgtggacatgacagtctggggagatagaccgagaggaagcrattttgaatgagatgggtgtgaaggggccatgaatctgtgtcagagcagccagrcctaccagggaaggtcaaagaaggcttcctggaggaggtgatgtttctgctgctatctcagagttgactgggagctggtgaggggagacaacattccaggcacagaacatccgaaggccygagatgatgaagagcaaatatccsccctggggcctcagaggggtccagcttgctggagggagggcagagaggagagcagcctgccatgagtcccgaggcttccractcaagacttgggtttggggtgctgagctcatgtctcctttttacatttccctacccacagacctgagcggccaygggaggttggggttggcatttgcctgggggagtttctgagcragcagcacctgctaccttggtggaacccattgctgggaatggccagggctcagcaccagcgctcagcagatgctcagtgcgttttgctgagtttgctgagggaagactgttttctrttctctctcacacacacagagtggatgaggatgaggatgacctggaggaagaacacataactaaggtaacacgagtgtcctcagctggtgctgtgctgggggctrtgggctgggctgtgyacccttggggaagaggctggagtcactcggctacttctcaccctcctctccacaaaggaggagcttccagcacttggactctgttgcttcttgcacgcaaccctggtcctgagttgctcccttggccagctgcagtggaccctggagtcctctcctggggtcagggcctggggagtcctctcctggggagacctttcctgggagcagggccatgcttgccaccccagggcatagaggaacagctgttctgggctgaagtctgggtgttttctgtccctgctgggtggtgctggatatgactcgtggaaggagctgcctgtggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttccctctttgaagtgcctttctttctctctgctagatttattactgtagtcggacacactcccagctggcccagtttgtgcatgaggtgaagaagagcccctttggcaaggatgttcggctggtctccctcggctcccrgcaggtaaacagtagccagtatttccaccaggggccatcctgctcctttcsccacaactttgtcctgctcgtccaggcctgggagacgctgggtctgtgacaggctgaaccrtgtgaggagcagccccctccctgrcctggccggcccakcactggaaggcaaaggagaggtggcgggggcaggtccacgtgtgttggtaggatgtcatttagctggcaccatctctttgccyctttctttctcctttgytgcagaacctttgtgtaaatgaagacrtgagaagcctaggttctgtgcagcttatcaacraccgctgcgtggacatgcagagaagcaggcacggtagccaccrggaccrtggtgtagccgcaggtggtctggagagagtgaggcaggggtggcagtgactgaagaccattmagtgtctttcatagaaagaatggcagaggagaccccagttcctycctgagtcccctctccttgggaaaaagtgttcctactctctgggtgagcgtctggtccgaatcgttggcttggagatgattttacgggctctttctggagaacaraagtaaaacsttacagtgttccgatgagacacagtaggcagtacttgggagggtcttatagacccyaccctryggaagtgggtctcaacattacacaaccccctctygggcccgtggacagttgctgtcytctctgttttctctctttgtgcctgtgccmccctcagagaagaagaaaggagctgaggaggagaagccaaagaggaggmggcaggaraagcaggcagcctgccccttctacaaccacgagcagatgggccttctccgggatgaggccctggcagaggtgaaggacatggagcagctgctggcccttgggaaggaggccmgggcctgtccctattacrggagccgccttgccatccctgcagccmaggtgagggccctgcagggccagaaagccgctcttggctctcactgtrgtctaggccatgaggggsgtcctcatcacactgtagtttgggggatgccccccaccrtggtcaggttgatggcaccttaacccattctctcctgaggcgtgagttggaggaggcgcgtgggatcccttggggtctccaggcagcagggccagttggcattactggggatggtatttaggagccaggaaagccggtgcattcctagtgaaaccacagggagaggggggatgccaggagctgagaagagtgtgctgcatacatctatttacaaatggctttccaagtgatgctcccaacttccatgcctatgatgtgatggaggatgtcagtgatagaaccattcagttttccagtttttcctttttgtaatatcagtactcttaactggaaagctttccctaacttacacctacctgcagcacgtgagaatactgtcttctctgccwcaacttctcttgatttttaaacagaaggaagaactgctaatgtagcagatgaaaagtagtatctcactgttacttggtgggtgcagtttcactatttccttgctacttctttaacttgagtgactttggaaatgggatatcactagtggaaaattctgtataatccagaaaaaaatgtaaggttttaaaagattcagggaactaagtaaccgtttgcacagcagctaaatgctcaccagcatacctgctgagctgtgtgggcgctggcagagaaactgaggaaagctgccaggccccatggtgtcccaggccttccctccggtctgtttgcctttagagcaaaattagtgctataggcatttatacacaaataccataatatggcccaaaatctttacgatttttgaatttgtaaagtactttgaccatattttgcttttatgttaatagtattccagtgaaattccgtgcatggggacgctggagcccagaaaagttaagtgactcatattttctcaccaagcgtgggtgatggagccattcagttttccgayattttatttyttatatgagtattcctttaactggaaactttcctaacaacaaacacctaaagacctgcagagttgcttttatttttgttaccccagctccacgccttaaccctcactttgaaataggatgtrtcaaccctattttgcagatgaggaaagcaagggtcagagaggttagacaactcttccagagtcacacagctgggragtagcagctccaggagcagaagctggggccgcttcctggtgcaccgatggtcttcargtgttttgtggaaactcgggggcctccggggygaccttgaggacatggacaaggctaagcaggggttcccttcacccagccctgcccttggtttactcaggagtcagaccagccctagtttcctgtgtttcatgtattggcttttcatgtgaaactcgaggagagcttgtccgttgctacaagctgttttttgaaygtctctacacagtccaggcaggaartagaagcactcacatcaggagctcagtgtcaggcaggcaagcctcctgcaggggagcccygccctgctcaggtggcctcatctcccctcccagctggtggtgctgycctatcaratgctgctgcatgcgrccactcggcaggcygcvggcatccggctgcaggaccaggtggtgatcatcgacgaggcgcacaacctgatcgacaccaycacgrgcatgcacagmgtggaggtcagcggctcccaggtgcgtgggcctcccctccccrggccagggcctgccgtgaggtaaagggacttggatggttcctccagacaccygggccaagaattcctccggaggtggggcttgctacagggtgcacgagtcaaggyggtgacctcatcggaggctgaccatggctttccagtgcatcccagaactctggggaccccgctatgacagagtgcctcatttccctgcacctcacctgcccccatgctmctgagtccctccagccctggatgccagcagccagttctgcaagccagggagatggcatgtgtgaggcaraagtcccctcaggattggattttgtcattactgaagttgtctggaggggactgaattgaggaatgctcaagatcagygcaggctcctcctgctgccctatcatgcgccatgcatggcaccaggtgtctctggtcttcacgctgactctgccatgggkgtggtgttcctgttttacattggaaacktggagattcaragatggtcaagctctgtcctgaggtcatgcagctcatgagtgtggagctggggtgtgcccactggtttctgactgtgaaacccccacgacatcccaccrgctctactgacctgtgcctgggctgaattgaggctgggatgtgatggtgrccttgaaccatcactctttgtagactctaggtcttttcccaacccggtggaaactagcaggsagattccatacttgaggaattcagcctyttgctttttctctgacccacagtggacactggaggaaaccttcccttccttcccttttctcttagctcccacyagcctaagggctgtggaaaccmgtaccttttgtctgcacccagccccctctcctccctttggtggcttcctgtgtgtccagggcyagcrtcttctaggtgaatctaagatgtcagtaccttagccctcrgctgcttgctcagagcctggtttgtgttctttccccagctctgccaggcccattcccagctgctgcagtacatggagcgatacgggtgagatgtgactctctgaggtagtgggacagtcccttggtggccccctgcatgggcctctgagaggcagcactttggttcccacctctggcccgkgctgtggcggggtggagctgcatgccattcatgtcctaggcacatcatggtgtgtgctgcacacagacctggaaggctggggactgaccgctggctctgaggcctggggcygtggccagcctgctctctgggaaaggatttgtagcttgtgacccagtttgagaggcaccgggcagcaaggcttccactggggtgggcggggcgagtcgccatcaggrcaccaccacttaatgtccgttggcttcttctcaggaagcgtttgaaggccragaacctgatgtacctgaagcagatcctgtatttgctggagaaattcgtggctgtgctagggggtgagagcctcgccccccggctaacccccggcctgcaaaacccgccgggctgctttttccttggatgcccatcaggacgcctcagttctctgtgtttttaagaagggtcggccaggtgtggtggctcacgcctgtaatcccagcccttgggaggccgaggcaggtggttcacctgaggtcaggagttttgagaccagcctggtcaacatgatgaaatcccatctctactaaaaatacaaaaaaattagctgggagtgttgccgtggcctgtagtcccagctgctccagaagctgagacaagagaattgcttgctcaaacccgggaggcggaggttgcagtgagccgagattgtgccactgcagtccagtctgggcgacagagtgagagtcagtctcaaaaaaaaaaaaagaaccaaaaaaaaagaagggtcttggtcattgatttagaaaattcttgttctttgtagcttagttgagttgtctgacttgagctttttttagacccatgggttctttgcccatgttctgaggactttttatttcaggcgctgctctggggggatattaaggatacagcatcacatrgacacacggtgtttccgtgatgggcatagttctgtgggttgttcgaagcacttgcatatgcggttttgtgtgccctgtgagaacgcagtgctggtatttgaatccttgttgatagacgcataaactagagctcggagcaagggctgctcccagcacgggagcctgggatcttctgactccagctcccacgcctctttgcrtgaccctgtcacgtccccttcttttatgatggggcacccccttgctggaaggtgtctgtggaagtggaagctgcagaaagcctgtgggagctcctggcgggagctggtctcgtgttgctgctctgagccrccagctctgctttgcctcaggctcaccagtggcctgggtagctcctctgtgctccggtgccctgcataccttggtctggctgctgtgtcccggcctcctggagaaggggtgaaaaacatgaacttacagggctttgggttccacgtgcaagcacgtgagtcagacrtgggaggctcctggacccacctgccctctaagtgggtccgttgcatrctataaacagtgaaaagcaaaacaaagccgttcaaatacagatgctcttcttacttgatgtgcagtgtggagggagagaagatagggaagggttgggggkcctgagaaccaccattgtgacctatttccattctcttttttagggaacattaagcaaaatcccaatacacagagtctgtcacagacaggtaagagagttgccctcagagsgcccagagctgatctgagccacttccgagcttaaccctgggactgaaacctgaggcttagggtgaagctcccaaggcccttcatgtgtttgctctcagggacggagctgaagacyatcaacgactttctcttccagagccagatcgacaacatcaacctgttcaaggtagaggtttccaccttgccatgttccacatccaatttccttyctgtcaccacctgtgggtagagtactatgttaagactatagaaggaagaaaaagcaaaacagacgtgtaattacttaacccttaacgcaacacgcctgtgagacaaaagtcatcatcttttagagtgaaggccacagggatgagggatgggtgagaaagggacctttcttggtgccccatagaacakatagagactccaggtccttgctgtctcaccccatcttctggcacagtctccctcaggcttatggacaggaataggatgttgatttgttctgtgcaacccctgtcacgtcttcgcacttgggccttgggtgtggttgcagcctcagacctctgctcgctccaggtctgtgtacccagcgctccccagatgaaacacggccactgccgcctgaaccccaagctcgtaactcaaatcagcaacagtgactgcccctgggtacagggttctgcctctgttctaggcgccatgccacgtgctgtgctctgagctaggatatccttttgccccggcaaggaaagcaaacaggcccatggaggtgacttcaggagggtggcgagcacaggcttcccacaagtgagccaatagcaagtggcagagacagcgtccaaacctggctgcactgacttggggccccacattcttcccatcgtgcctgccttttttttcttaaaaccagcttttcccctgaattacacatttgggtcactgtcactgccaccatccctgccagacaggctggatccacgtcatccttgatgcctttctccccttgtctcccacatgcctgtgacagccgccaggcctgacagcctcagacagtcctgccgtccccgcgcttctcccacagctgggacatgggtgcaggcactccttctctcgccttccctttgccctccttgctttccttctcccctcttcttcccatgggtctcgggtctcatcacccaccattgagggaatcctcatcgaaggacgtcgctctttttagaaaccggtttaaagcctccaaactcctcatctctgcatcccaagctaagatgtggcaccaaaccacacacattggatgcaccgactgagtggcactgccccagcccctgagcaggtcccagccatcatctcctctgtggctttgctcatagaagttcctttgttttaactctctgtcacctggaaggaaagccaaggggacctagattttactgggcactcttagacttgggagagacatttggaaagagggtctcccccctgaggaggacactgcgttgtgggcaggggcagtagaggcgggggtggcctcggagaggrgatgacaaggttggtggcaaggaggctccaggtgcctcagaaggtagcactgcgttgtgctgcctgggtggtagaagtggtgttttttgttttgtgtttaagattacagcttgctcagtttgcacwcatgcctacagctgggcttggtttttgcaggtgcagcgatactgtgagaagagcatgatcagcagaaaggtaactgctcccatcttgtggtcctgaacaagacccagctgtgccccaaccccctgccgttgccatgctttcctcccctgccctcaggraactccagagtccccttcrtctccaccctccttggtgcagtgggccttgctggggtggtgggatgtgcgcttcaggtgtcttgagcctggcagagcctccgatccacccagcctctctctcatggctgttcctcgttccyctccactgctctctctcatcccacccagctctttggcttcactgaacggtacggagcagtgttctcatcccgggagcagcccaaactggctgggtttcagcaattcctgcagagcctgcagcccaggacgactgaaggtgaggcaggagggtgagcaggcagagccggctgcacgcatgggcaaggacttctgttcctcatgtgtggacctgacmagagggaggcctcctccccrttctgctctgtgcagcwcttgcagcccctgcagacgagagtcaggccagcgtcccgcaaccagcttccccrctratkcacatcsaaggcttcctggcagctctcactacggccaaccaggacggcagggtcatcctgagccgccaaggtaatcaggtggttcttggccaggttcagttcccaggaaggagccaagctgagcccgggagccgcagcatgaaaggattctttccttccatcctgggaactycctgggttaggaggaagcagtgcagtgggcactggcctgctgtgacctgggcaagcagtggaggtggacgggaggagatcgaggggctgggatggaggtcctctagggcaggggtcctagggaaacttgtattgtggggtaggtgggctttggtttgggtcatgattttgtcatctatgagccttgtgatttggactattttctttctcaacttcagtttcctcatatgaaaatggagaggataggccgggcgcggtggctcacgcctgtaatcccagcactttgggaggctgaggggggcggatcgtgaggtcaggagatcgagaaccatcctggctaacacagtgaaaccccgtctctactaaaaatacaaaaaattagcagggtgtggtggtgggtgcctgtagtcccagctactcgggaggctgaggcaggaaaattgcttgaacccaggaggcggaggttgcagggagccgagattgagccactgcactccagcctgggcaacagatcgagactccatctcaaaaaaaaaaaaaaaragagatggagaggacagtatggtccacctctgtgggctggttgtcctagagattaaatggtgtttaatttaaagagaaagcactagcacttgtgcctcagacctggactcacctgggggaccccctttgctgggacgayagaagtgtctgttgggcttgcactcacctcccaccgatctgtttttccaggcagcctcagtsagagcaccctgaagtttttgctcctgaatccagctgtgcactttscccaagtggtgaaggaatgccgggcagtggtcattgcsgggggkaccatgcagccggtaaggacacctttcccagcccctcgtgccccaggtgttgggatgagatggggrcttgggagagatgcrttatcagtcctgttctctcctggggccscaagccagaaagggtcagctcgagcaggcccagtggtgtccrctgggtgacactgctattctctcactgctgtgccttttaggctgcaggagcagtgcagactcctctgctgctccattctgtagccccaggatcacacttctcccagagaaagctgttctgtggtttcaaactcaaggaaaaaaatcatgattccacttttaaaaggttcattttgatgtatatgaatataatagtctttgtaggcataatttttacttatgtgcatagctattttaaaaacaaaagtgcggctccctccatgtgctgtcactggaacttgctcttttcactcagcagccagagggtcataaaccctgtctccttgtcagcaagcatgcacgtatttcagtatcccagctgtgctggattccagttacccagatatacagcatttcatgtacctccttctcttttgttaggtgtgcaagctatttgcagttttctgttttgagcatgactgtgatgaatataaccgcatttccgcacagtggtgactcctacctagcaaagggcctcctggacaaaaagctgctgggaatcctgaagcagtgcttcccagccccagatgccttagcttttgatttttatatttttgtatggatagattcatagttttattcattcggcatattaaaagttgtttacagtcattattgtttctgacgttcacatggtgaaagccccttcctgctagctcaggtcctccccgtggcccggtcagtctcgcctccagcacagcagaatgtcatgggatcaccatgggtgtccttgccgcacactggattgattcatttctccaagctgctctggtttcttgtaatggggaatgacatttagaagtcaagctgtgggtgctagggtgtttgtcgtgctcctggggcattttggtagacagatctaggaaatgttttcagagtgaatccatactggtatttctttctttctttctttytttttttttttttgagacacagtctcgctctgtctcccaggctggagcgcagtgacccgatcacggctctctgcaacctctgcctccggggttcaagcgattctcatgcctcaacctcctgagtagctgtgattacaggcatgtgccaccacacccagctaatttttgtattttagtagagatrgggttttaccatgttggccaggctggtcttgaattcagttgatccgccagccttggcatcccaaagagctgggattacaggcatgagccaccacgcctggcccatattggtgtttctaagtaaaaatcaaaggatttgtttacttgaccttttattgtacctctttttctcttaagcctgaacatgtgtgctacattaacwtacttatctgctctatcctataatatacttaaaagttttgaaatcatagtaccaatattacttctaacaatagatctgattgaaattgcctttcctctttgccyttagagtgtaacccactaaggatgcctggtcactaggctctaaagtcacgtggaaccaggcttctctccgtgtgcttctgttgtcagtttcatagatarctaggctgtttttgtttcattttcttttcaattttagaatttgctttyttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgycttcwtttttccctttcctgttttatttacayrgaaggcatcttagtcagttgtctgrccatcgctcctctagtgggctgcgtggttctctgttggacagatgtaggragcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttgccagtctarcaggtgaaagcctggagattsttattcagtagtttgggctggggcctggccaygtgtatttttgaaaattttcgctggtgattttgctgcatggccagggttgataatgactgtgccagatttgctggatttcctttgctattcctgcacatagtttaaacgagactgccagcactgggtatcagtcaccatttttctttttgttagtttgccgtcagccttttctttgacctcttctttcagtttgtgtgtacttgctgtctcttaggccagacttctcgcttcctttctgctgggcctctgaggggtcatggggccatgacgccgtggccttggtctacaggtgtctgacttccggcagcagctgctggcctgtgctggggtggaagctgagcgcgtggtggagttttcctgtggtgagaagctgtgcccagggtggggcaggctagaggtcaggttctggcccccgttttctgtgggtaatacctcatacygtgaccaggcacagrggcggaggagaccccgggatgggagcctcacccttcgtgcgctcrcccaggctctcctgctttgctccctgctgcstgctgcccagtgtgactggcgatggtgggtgggtgagcgctgtcagtcgctgttcctgtgctggatgatggggcaggtaaatgccctctctgcagtgtcttacagcacacctgcatctccagttttcggcccctccctgatcttaccaggtcacgtgatccctccagacaacatctgcccctygtcatctgcagcgggatctccaaccagccgctggaattcacsttccagaaaagagacctgcctcagatggtcagtcccagccagctcgctgcaccacagcctggcctcaggcagcaaagggttttctggggcagggacgctctggcccaccctgagtgttttcaggtgttggggaaattgcacagggacacccacttagagccacacagaatgagcggcgtcgatctagatgcttatggaggaaggtctgagcttccccgcctctcacaccttaggctgcgaaatatgtattcataaaacctccaggcatcttctgaggacgcctcackcaggagaaagctgctagttccctttggctctcttgccctttggttatatctgcccctgctgggggcagggatgtggggcttgggggcatctcctgtggtgtgcctggggtgtgcagcccctgattgtcrttgtggtgcccatcaggaccctggacagaagaagggaggactcagtgccagggcaatagggaggcccccyagggacgctagtgctgtgacatgtgtcagaaaggcgcagtcagcagcagcggctgggtgtgtttggtgggaggtggcacctaccaccccgtggttcccacccaggggagccaagtcctcttccttggctgtagtcctgccragggtctctcctcagttttgagtctcaaggtgaagacgcggtttgtgggtggctgaggggttgctccatgggggctccctccctyccttccttccttagatggacgaggtgggtcgcatyctctgtaacctgtgcggtgtggttyctggaggggtggtctgtttcttcccctcctacgagtacctgcgccaggtccatgcccactgggagaagggtggcctgctgggccgtctggctgccaggaagaaggtgagtggcctgtcggcagccttgccacttgtgaggacagtgycactgagtcctcctgggagctcttgtgctcatcgggtcrggacaggcttytggctcctcatccccaccgctcccagtccctgactacagaggatttccccmaagtccctggctgtgaggttctccagtccgctggccagaaaacacaaggccacgagcagacccgagacctggcaccctaaacctgtctctgggaaatgtcctstgtctttctcagatattccaggaacctaagagcgcacaccaggtggagcaggtgctgctggcgtattccaggtgcatccaggtgcgggcgtcatgctgrgcttgggtctgagaccrtgtgggggtggcagctggaaacgtgggtgtcatccaagttttggctcagcaactcagcrtctgggtttctcctacaggcctgtggccaggagagaggccaggtgacagaggccctgctcctytctgtggttggaggaaagatgagtgaagggatcaacttctctgacaacctaggccggtaagtagtggttctgctcatctcctgggtcgtgatacatggccggccctcactcccagcagctgggcccctgcctgctstctgctgccattagagcccacagctgggctgcgactgctcagaccagccagctggagggaggggctcagcagctctgggtttggccctgagagagtagttggattttaggctggycattgctgtatcaggacccaatcaattggcctagacgggatctctcagccttacaagccctctccaggtggtaggtacagagtggagagaggctgagttttgatcacagtcggagagggctgacgraaggggtagaacggagcagctggtgacatgggtgatgacccgggagttcctgacgtccacccactgggctcttgtctccyccccacgtgtgtggtgatggtgggcatgcccttccccaacatcaggtctgcagagctgcaggagaagatggcctacttggatcaaaccctcgtgagtgaccccagtgtcacagagggtgacagagtaggcagtgggtgggagtggcatcacccccagggctgatacagccaggccttccccactgcgctggtgtctcctgccccctccggaagcttggatgcccctccacaccctcttgatcttccctgtgatgtcacctggacccctgctgctggcattggccacraagcctcctgktctggctccaaagcctggcagggtcttttccccgggggagctgcaggcagggaacrgtcctgatgggtcwtccccttcactcccagcccagagcccccggccaggcacmcccagggaaggctctggtggasaacctgtgcatgaaggccgtcaaccagtccataggtgagcctggctgcctccagctgggtggacagatgggrgctggagaaggggagaacaggaaagaggggttgcctgccctgtttcctatrtaagtctgaggaaggggagggggtcgccatgggaatgtgctgtagggggaggcaggtgttgctcggagcsccagcctctgttcctatgcaggcagggccatcaggcaccagaaggattttgccagcatagtgctcctggaccagcgataygcccggccccctgtcctggccaagctgccggcctggatccgagccmgcgtggaggtcaaagctacctttggccccgccattgctgctgtgcagaaggtcagtcctacctttttctttctgagagcctcccmaccccgagatcacatttctcactgccttctgtctgcccagtttcaccgggagaagtcggcctcttcctgatgggcaaccacaccaccgcccggcgccgtgcccttcctttgtcctgccctctggagacagtgtttgtcgtgggcgtggtctgcagggatcctgttacaaaggtgaaacccaggaggagagtgtggagtccagagcgctgccrggacccaggcacaggygttagctcccgtaggagaaaatgsgggaatcctgaatgaacagtgggtcctggctgtccttggggcgttccagggcagctcccctcctggaatagaatctttctttccatcctgcatggctgagagccaggcytcctkcttggwgtccrcaggaggctgtggcagcwgtggcatccactgtggcatctccgtcctgcccaccttaagaggygagatggagcaggyccatctgcctctgccctttctagccaaggttatagctgccctggactgctcactctctggtctcaatttaaaatgatcccrtggccacagggctcctgcccaggggcttgtyaccttcccctcctccttcctgagtcactccttcagtagaaggccctgctctctatcctgccccayagccctgcctggatttgtatccttggcttcgtgccagttcctccaagtctatggcacctccctccctctcaaccacttgagcaaactccaagacaccttctaccccgacaccagcaattatgccaagggccattaggctctcaacatgactatagagaccccgtatcatcatggagacctttgttcctgtgggaaaatawccctcccacctgcarcagctgcccctgctgactgcgcctgtcttctccctctgaccccagagaaaggggcygtggtcagctgggatcttctgccaccatcagggacaaaccgggggcaggaggaaagtcactgatgcccagctgtttgcatcctgcacagctacaggtccttaattaaaagtgtrctgttggtttctgctgagttttttattgatatgtgctgctgttttctctggaagcctctttagggaatcgaggagcgcactggtgcaggggctgggtggagccatcctccgatggagcacaggcagatggaagcccccaccccagctgcgtggcctgaagccagcctcccgctccccgaaggtggtctccacacagaactgggacagttccatccccgccccttcctccagggcagcagggctgaggatcccattctggctgtgtccacgtccgggccatggctggagtctgggtttaggggaggaaggcatggcggcgcccgctaggatttccagttgtcctcttcttcctctgcctgtggctgctgggggttagcagacacggtttgttgtctgacatacgggctctctcctcccggcccctcaccagccccagaggtgaaaaggctggagggcaaaggctgagtgagggaggtctgtggggagcactggtttccccaggccccagagacttaaacacaggaagaaaaaggcaagagagaattaacgatgccacagcccatggcagacagcggccctgcctcctacccttgcgtctcaggaccagcttgttgaagagatcccacatcagttccctgccttggcttacggctctcactgcaataggaaagccacggagtggggtgtggggttcagtcacattggacccccggctccgtgttcctgtcccctgtagtgtttttgttattagaccctttttcctccttggtttaggaatgggggccccagggccacccttgtccaggctccctctaccgtagaggtgagaattccagggcgctacagtttgaaaaccactattttatgagccaagtagaacaagaaatgacaactattaaaaaaaataagggatttctgaccagctaacaaccccacagaaaatctgccagggatccagaaatgagactgaggtggcctcagagagcggctccctcctgaaggggatgctgctgctgtcatcctgcccggcaccttggactgcagtgggcagggcctggggtggggatgagggtgcactgaccagcaccgcagcagcttggggaggttggggtgctgttaacatgccatcgtataggtcggaagtggaaatgggagaaagtgtggggtgcctagggaaggaggtgactgagtagggagcctggctgccatcctaacacccagctcactgggcttgagagacttgagcctggtgccagggcagagtgggtgatgctggggcccaggctggcaccatacttgaggtctgccaggcaggtcaggtaggatggcacatcgaccttggggacttggcccaggtctggcgtgtagaagtagttctccgggacacacgggattaggtagggacatgtgagaggtgacagggacctgcaggagcagctagcgagacctcatgtgcaccctgcacagctgtggtggcataaggggttcaatagagcctctcctagagaggagcctggcaaggcccccagcccctgcccctgcccctgcccctccccctccctgtccacctgctgctccagctgctctctcattgatggacaaggggcactgaacagtttcttctctgtctctgcccccagcatcacatggctctttgttacagcaccaaccagttggtccgggaagacagacttcttgtatctacaggggcaacgtggaggtcaggcaagccagcacctgctgtcctgggaccatgttcctgacctacctctcccatgtcatcagggacactgcactgaggggtcccaggccaccgagccaagccaccctggtcaccttctggctcccgcctctgtgctgcacctgagtgtgatgccctgggaccccattaagtcaggctgagtcttgcacccacaccctgcgactccattttctgctacaaaggatctctctgatgttgacgagcagcatggagacttggggagacccccccaagcgcctcctccatgtcatccttgggctccagcttggcgctcacacacacaggaaaggacttcagcttctcctgggagggctgggtggctgaggggtggtggatttcggagttggaccagcagctggcctagaggctactggggaggagggagcagggagcacccactgctgatccagattcactccttccctcgcctctgtcatgaccccaaagaagcagatcctgaacctgggctcttgtcttcacctttgttctcttccactctggggtaattaagaatgatttgctggccaggcgcggtggctcatgcctgtaatcccagcactttgggaggctgaggcaggtggatcacaaggtcaggagatcaaaaccatcctggctaacacggtgaaaccctgtctctactaaaaatacaaaaaaattagccggtcgtggtggcgcgcatctgtagtctcagctactcgggaggctgaggcaggaggatggcgtgaacctgggaggcggagtttgcagtgagtggagattgcgccactgcactccagcctgggcgacagagtgagactccgtctcaaaaaagaaaaaaagaatgatttgctaattatgcaggcagctgatccagtgctgtgtaaccttgggggccaccagatgccaatcagtagaatgggagagaaggaaggatggaggaagtgaggacaaggggcaaggaggaaggtctgtccacctgtctcttttgtgcaggaggtgtccaagcaggaggagcacgtcacatccccactgaaaaagcccacagaaaatgaaaagcccacatgcttgtccattgctgcaggatgggggcaagtggagagggagaggtgtcaatgctcccaccttactcccagtcatggctgactcctccctttccttcgttcttgttcctaatctgtcaccatgtcctgtcgttttctttgtctcacccaaccctctgtgcctgcaaatcccctgactgcagcctcatccctgtcacctcctgactgtagttggtgacagaagaggaggctgcaccagtgaaggagcagggactccaggtctggcaacaaccagggatggggccgggtgggggtgacttggaccaggagaggggcctgagtcaggcagtcacatgcttcatgctggggtcccccaagtgaggcacagcccggggtcccgggaagaagaccaagcctcatttcaggttgcttgtggccaaagacaggacctgtgtacccaacaacccctgggacttttgcaggaaacagcaaacaccattcgctcactcgagttagataaacactgagcgaaaagtcactggagcccaaggactgtgcggggtcagtgctgccgatacaagaaccgcagccctccagctcggctccctcaacggcctgcgctgcagccacactggcctcctttcaggtcctccacctcagggctatagctcatgtgcttccttctttctggaatgtttttcctgacctacccactcaccgtgagatttttaccacaaatgctatttcctcacatccgccttccctgacccctgagaccaagctaggtcccccatgatgggcctcgcagcacctcatctcccctccacagaggcggtgataacccacagaacccagggccacgatccctggctttgaaccctggctttgccactcggccagatctctttctgtgcctcagtttcctcatctataaaatggataacagcagcgcctgctcataaaatgtggcaaggattaaatgagttaacgcactcagatcaatggtggagcaagctccatgatacatgaagattagtgattacaaaatactataaataggccttatcacaactgtaattaaataactgatcattaattggttatttaggtctgtctctcctgccagagtgtatacaccagttggacaaggacgctgccttattcatcactggatctatagtgatttgctcagtgccttgcacacaggcactgttgggtaaatattttctggctgcaggaaagagtgaaggactaacctccccaacccccctcccacccccgccccttgctacctcgtgggaggaagagcatgagttgggagagcagagccaccacaggaaaccaggaggctaggtggggtggaagggagtgagctttccggctctcaggagcgaaagcttccaagttgggctctccccttggccccttccacccagggaagacagctgggtccgccaggaccaagaatccccaaaggggctgctcccagaggttgtgttgcagggactggagagaggacttcccagtacagggggtggccctctgatcaggtgggggtgggtggcagcagagcatttggtgggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacaggggtacatgggcagggtggtggtggtgagagaattgcctgaatcagctgccaaatggtgcccaggttggaaaagcaaatgtgcacacatgggttcttcccactctaaccctgaggaattagaggcctgcttctgacacagactgggcagtggctagtgactctaggtatagagtatccaggccctgctcacccaggctagagcttagggagccagaaggaaggaggtgcatgttggggtgcaggacaggagggaaaaatactcgaattgcaaggtgagggcacagtctatttatattgggttgaattaactcctccccctgatgccactaaagcaggaatcacactgcagatggcactgatttgattggcaagagacatgccaggaagaatattaagggaccggacccctataattaggcctaatcatagcctgttgtttgaaaagggcatgaaggacattcatcaggcctggcactgtgccctagacctgctctcctgggtagtgggaccctccgtggcaacagaggtgtgggtgggcctgggtgagtgtggcaagaaatgcctcggaggctctatttggccttaaagtgctgtgtgaccttggataaactgccctctctgaatctctggtcctttccatttcccattctccaggctgagaactgcactgtgatatatggttattcccataataataatgtgtgtatcatgcataatgcactgcacctcttcaccacgctggtgcccactcttctgctccccctgccggcttcctcagccccttctaccctgatggttctctcctttcctcctcaggccagcacttcccatgatctgagatgtccgtcctccttcctcttcaactttttctccagcagtgagttcctcctcctaactgaggcttccaggaaggatatcctctgcttctcagacctgaacctgccttgaatactcatgaggacccaggagctactcctcacctcccacttctcttccctcctgtcagataaccaaggcacggccaactgatctccaaccatctgaggaacccaaccgtgtgagaccacccacacctttcaagaatgttcctcccctccccttctttgtatttatactgatgcaaatttgctggccatcttaactcagtcctgtgcctcagttctcccacctgtaagatcaggaggaggataaagatgtaagactttctgcacacgttttaagatgaattccttgttaccacatctgagggtgtctgtgtttactgtactatccacgtgagaggattgtacagacacgaatctaaacaaggaagtagcaagtccattcaagcattaagaggctgattagtggtttattcattctgtctacaagcatctactgatcatctattcagtacagaccattatcacaacaaaggtgaataagacactatgc

SEQ ID NO: 17901 - DNA, 15351 bp, Homo sapiens
ctaagtttgcaaaatgtgagaaatcatgtggtactactttcattcttcacatagatagactcaaacacctttagttctcagaataatacacttcagacatctttgacctcttatattatttcctaaaataagcttaaatgtgtttctcatatcctctaatcatccagaaaactcctattcatcccacaaaatcctatttaggcatattctctttatgtattttttccttaaaaatatgtatatacatataaatgtaaatatataggcatatatctttttcctaaactagtggttgtcaaattttaatgtgcttcggaggacaagatttctaacttattcctatgttttttttttttttttttttttttttttttgagacagagtcttgctctgtcacccaggttggagtgcagtggcaccatcacggctcactgcaagctccgcctgctgggttcacaccattctcctgcctcagcctcctgagtagctgggactacaggcgcccgccaccatgccaggctgatttctttttgtatttttagtggagacgcggtttcaccgtgttagccaggatggtctggatctcctgacctcgtgatccgcccatctcggccccccaaagtgctgggattacaggcgtgagcccctgcgcctggccacttattcccagaatttctaaattattcctaggtgatgctgatactgctactctaggaaatatactctgataatcactgtcctaaactccagctagagttaatcattcatttttctgtaacacctcagtggccatacatgtttcgtttgtaacacttatgtaattctaatatatgttttgtccccagttatactttttctatttcttctattgttacaattgctaatacagcacctggaatatgaaaaacattcaataagtgttggctgattgaattaattcatgtttcattaattttatatcatcttcctaaatctcaatgaagtatcatgcacccatttagacagtgtaaaataatccataatagcaatatattaaaatcaaactaatacttaatatcttttgtgtgccagaagttgggcaaagggctttatatgtattattaaataattatcttgatgattagacaatatattacaaaaaactaagattctctagaggtttaagtggctttcaaaaagtaacacaaagctagtacatatcagaactctggtttgatcccagcaatgtccaaatagaaatgggtaactctgaagaaagggtctgagaatgacagagtgcatatgggttgtggtgtcatggccttttccctcctttcttaaaaatagataccagttatataagttttatcatttatgttaactttgagcttcctcgtggcatataggtacagggatttcattaggttcaaagaagttttaaagaaaagaagcaattttgattgtggaagaatattttcagctcataccaaataattgaagtctgctgtgtaggttttgtcttcaaagtcttccatattgagaatgcagtgcactagcaccctcttctgctggttgcatctcagttcttccatctcttggacaatctttaggaagctattcatcttggagtaaaatcgatatgcaaagtactcgggctgagggtattgaggcaacacccagccatgagcctggcaattttcattggccttgtaggctgcctagacaaaaaatcaaaattacgggtattttaggataaagagaaaggatgagtgaaagaatatttgataagatggtttatcatcatgctgctttatctctgcaagaaaattttatagccattctacattaaatctaacccaattccccattttctagttatactctagagcgaccactatggtttttacaatttagtctattcaagtcctacttcaataatattacattcaatattttactgtattctttactataattattacttttgctagcaagtagattgctatatctccctcactataatacgaagaacccatgagtgcaaacgtttaccttgctactgataacataatatgaagttttgctgaaagatgggaaagtttttatgaaatacagcaaggagtttactctgaccatagtaatttaccattatcaacacaaaaagtctgaggagtcctttaaaaatatctaggaaggattgatatttaattattacagatagtagtttacttctctcttgaatatatccagagaaattctttacattattccaaggtaatagattacagggtttctcaaatatttccttctataaaaacacaattctctttctatttccttaataaaagtgaagcgttgcttattttcagctaattctcctttatacaatttagtatgtatgctatccttctgtcttttcccgggactcttaaaataatttttaacctacttttcatagggcctatattcttaatatttaactatttttcagtactctagattcacaccaaggtgtatcttttcatttctgttccataaatataatttcgcacagacctaaaccttagcgagccagtgcagttttttgtttgcttgtttgtttttattttacttgcctttcgtttaacttactttcaaagtgatatttgggtatgtaaacgtatatgtgtccaagaaaaactgagcgatgccatttacatctgtggtgtagtttcccacgattttgtccttcagatgcaactggacaacttcatttgggattggagagttgtctggattaagcaatttaatctgtacaagaggaagaaaatacatttcggaagcatgtagtaaatttgggaatccattttgatggcatttgccaagcttctatcatggggacccccgctctccttcgtacgtatgcacttcctgcgtggtttcatctattcctgttgagtgtatgacatgtaccattaatatactaatgagcctaaactctgtttctcctgcccacgaagatctctgaaaactcaggcccatagaattaatcatcctgagtattttttataataaaaatgctacagaaaccctcaaattggaatgatttattactgtgcccaaccttccttttttttctctttctcttatttatctcagtgaatacctcaaccattcacttagtcactgaagtcaaatatctagagacatcttagactttttattttccttctcctataattttcaattgttgataaaatattttcaattgtatctttttaacattttctgtttccagcttatcacatttgttcctgttgctattccttgtatcaatagcttatcttttttccctcatacatcttctatttttttctatccagtctctctctcctgtattgcttttgcttgttctttctctatactggcatcaaagcaaattttctaaaatgcaaaatttagcattatcctccctaaaacattgtagtgactgctctgataggccatggttatttgctagaaatctctttctcattctcttactagtacaggcaatgattgctttaaaaagtcccttctgaaattgtatgatttgcagtagatacaatgcctgcatcagtatctatgccagtttgaagcctttaaaggcaccttcttaacaacatctaaggccacaacaaccagaagaagactgtctgagacatcctttttttagctcagtcagtttctgcaaaacaacttctgctttgagcctttcatcttatttctgccacttatcattttcctgctggtccaggcaaacacaatccttttttcttgctcagcatctgtagactgatgccttatttgcaccatctacgcagattttgaacttagtttcatctcaaggcttgatcttgtaagaaaaattcaacttgtctcagcagtccacaggccacagacacatgacaccatgcctttatgatcacacagaggtttgctctaattttagtacacctagactagaaagatcctttgagtcccttccagtcacagaaagatgaacaagccatgtgatttctgggcactttcctttctttctttgtccccaaacccaaatagtgccccaagtgatgacaccaggcccattatcaactgccggggccaggcatgcaacacttcattagcagatgtttcttgtggcaaaggtatttgtcgtatatcctacaattttaaacagtatcatttcagccatccacggatgctgctactgtcacttatgaagaaatacccttgttagcccaccgccttgcccagcttcctatgttcacatatgttactcttggagtcatagctctgaggtcttgaaatttgtaggggacactaaaaaagcagatagtatcttcattctggaaataaagcttactctttaaaagtgctccctagcaatactgagccacgtgtttgatggccttatgacacaacacatggccagataaaccatttttaatttccagtaatgcagctactgtagtgactcactatatcacagagaaaccagtcccttttccaaaagtagaacaggaatgacttgtttctcctggcacatctcccggaagtgatcagagcattcaccactgtgaaatggccaaaaacccaaaagataccactttatacaaccatgtttttgaactaaagcattttattgtttgagactcacatctgtttatagctgccactggtctccctaaaatgatcaaggaaataagagctcttatatatgagttttcaggaactaattctttcaaatgctaatgaagagggtgtgtccaggcaggaaactgtactgtattacaatatattaataacagactactttgtccacggatgcctgattcatgtaggtaccacctatcccctacctccctgataaactattaccaacctcagctagttttcccagctctcctctataggaaaaggtgtcttggagttcctgattataggataagataatactataccttaaagtgtcaagaagctttgagagggaatgggaaggagctgggccttaatgactaggctagggcttaagtacacacatacacatacacatacacatacacacacacacacacacacacacacacacacacacacacacacccctctcaaccatgtcttatgctagagaagacagaaataaaacccctgagttaatctggagcatgattgactggcagatttcagtggattattgctaattttttagaggggataataggatttaggtaatctttttaaaaatatctcaaatcacccttcattgagaatcactattctaagagtggcaaaattctaatttatcactttttaacttattagccaataaattttgccatttggcaatgtctgcaaacactttgggctatcacaaataggaaggggatggtgctacatcccaggtagagacctgggatgttgctaaactcttaccatgcacagggtagcccccacagcaaagtatcatctggcccaaaatttcagttgtgccaaggctaagaaagaatggtttagagaaacaatgcatctaagtaattattgtcaatgtctgctaacatctcagtaagagaggaagagtgctctctgtgaaaagtacatgacactacctacattatattcttgcctactgcacccaccaaaaatgaacttgaatctgatcaagcttctgaacctcactactggtttataggaaacacagtggactgaaagtagttgcttctggggaagtattcacgaaatgaacggattagaggggagaggtgctcattgttcttcatactttaatttacagtgttatttttcttgttaatatatgtgttgtccgcaatttaaaaattacttattttccttcccagtcatggtagctttgacagagcataatggcggtgaccacgtccacaggggtgctggcgaacttgtcagaaaagcaaagagttttatcagcttctgaagaacctgatcaatccaagctgtatggtgcggaggcaagcagaggaaatctgtgaaaatatcccaggatcctcatctaagggtaagggctccagcctgtactacacttggacagatggctacagattttgcacccaatttccaaaagacatttcatgaaacagtgattccagctctgttacgtaccatgcaaaatcaaggtaatcagcgtgtgcaatcacatgcagcttctgctcttactgtttttattgaagactgccccaaatcattcctagttctatatttggatagtatggtgaaaaatctacattctgtcttggtgattaagcttgaagagttgattcggaatggaactaagttggccctggaataacttgtggcaaccattgcatcggttgcagatacaatagaagaaaaatttgtcccatattatgatatattcatgccctcactaaagcacatcattgagcttgctgttcagaaggaactcaagcttctgagaggaaaaattattgcgtgcattagccatattggtcttgctgttgggaagaaaaaatttatgtaagatgcatcaaatgtgatgcagctcttgttgaagacacaatcagacttaaataatacggaagataatgacccccagacctcttacatggtttcagcatgggctagaaagtgtaaaattcttggaaaagattttcaacagtagctttccctggttatcgagcctcttattaagactgcttcagctaaacctsatgytgctctcttagacacacaggatgtggagaatatgaatgatgatgatggctggcaacatgtaaatcttggagaccaacagcgttttggaattaaaacttcaggacttgaagcaaaagtaactgcttgccagatgttggtttactatgctaaggagttaagggaagggtttgtgaactatacagaacaagttgtgaagctgatggttcctttactgaaattttatttccaagacaatgttcgagtggcagcagcagagtccatgccttttctcctggaatgtgcaagaatttgtggcccagagtatcttgcacagatgtggcaattcatacgtaaccccttaatcaaggctattggtactgaaccagatacagatgtgctctcagaaataatgaattcttttgcaaagttcactgaagttatgggagatgattgccttaatgatgaatacttggaagaactgggagggacactgagagcaaaacttgaagggcactttaaaaacgaagaattgtgacaggttaaaagtcaggaagaaaactatgatcaaaaggttgagatgtctctgcaagatgaggatgaatgtgatgtttatattctgaccaaagtatcagatattttgcacacattatttagtacttataaggaaaagattttaccatgatttgaacaactacttccattaattgtaaatctaatttgttcaagtaggccatggctaggcagacagtggggactgtgcatatttgatgacatcgcagagcactgcaatccaacttcatttaaatatgtagtccaacttcatttaaatatgtagactatttttggtggccaatgctactaaatgtgtgagataacaaccctgaagtcaggcaagctgctgcttatggcctgggtgtcatggcacagcttagtggagatgattatcattctttatgttcagaagctgtcccactgtggtaaaagttattaagtgtgcaaattccaaaacaaaaaaaaaatgtcattgctacagagaactgtatctcagcactagggaagattttgaagtttaagcctaactgtgtaaatgtagatgaagttctttcatactggctatcatggcttccactgcatgaagataaagaggaagctattcagactttgagttttctctgtgacctaactgaaagtaaccacccagttgtaattggtccaaataattccaattttcccaaaataatcagaataattgcagaagaaaaaattaatgggactattaactatgaagatccctgtgccaaacgcctagaagatgtcgtgcctcaagtacagactcctgaagatttatggttggaatgtgtatctcaacttgatgatgaacagcaggaagccttacaggagttgctaaattttgcttgaagcactttaatataacttgaatattatctaccataaaagtaactacaaataagtgttgtgaatggattttattaaaaatcagtgaactgttttctctctgctaagctgtttatagttcttcctatgtttctccagaattagtcaatgttagtcctctgtttatcttgtatgttttatctcccaaacacaaaccttggtgataacctgtgcttcaagctgtcttacaatatttgtcacctttcccctagttgatgtgaagtatataaattgttgctatttgtttgaactattatcaatgctagccaagcagtatacttgatgtgaagatgtcatgctatcatgatatgctaagagctcatgaaaataagacagaatttccaggacaaacatctttggaattgtgagtgaaggatatagtggcaggcttgtccctccttgattaatactcttgatatttgtggtgatgggaggatgctggaactaggagagagttttgagatactgcagaggatgtgggatgtatataaactttttcatggtgttctcctgggaactgggtgggacatatccatattctagttcccaaggtgtccagctgagagttagagaactttaaatttctttagccagactggtctctatttttttaagttatccaggactccaagaaccatagttactgaaaagggattcctgattcatctaacactggtagcatgtaacagtgttcgacaaatagtaagtcatcaatattcttgggagtcagtgttgtgtgtttcaggagagtattattttgtatatgtatgccatttcccccctgcaaagcagttcaacaagaagagaagctctgattatagggcttaaattgatttatatttcaaagaatttcctaatagattctatagtagcactgaagagtattctattgtaaaactcggaggaaagcaaatgtaattttctttggacatgaaaaagaaagcaactttgagagtagtcatttagcagtagatgtgcattattatgagaaaacagttctataaattcagggttaattmtattaattggaatgtcggtctctaatgtctagcttattatagggtagaaaagagctttctactcagctaatcattaatcattgatccaaaacttaaatacatctatcatttcctggggctattgtgagtactgtatatgtatttagcaaatatttaagacctagtaagtgctcaataaattgtagctgttactacaaaagaaaaaattactttttaaaaaaatatacaaccataatcacacatactagagaagaaaacttaaaactctaagtaattcttaggtaaaaataaaaataaaaataatgaaatcatcaaaaatgattttaattgaacttaaaaattgttaagatggtaaatttgatatgtgcattttttcataatttaaaaaataaaaatagtatagaaaaacacctgtgaggaggaaagaagtattcaggaaaaattgtataaatctgaaaacatggaagtttaacataagtatttataacaagatgctagaaaaaaaaaaccaaaagaggtagaagaaaaaatataataaaaataaatgatgtaatgaaaatcatttaaaataacattaaaaataaagataattaacaaatccaaaaactaatgggaaaaaaacacaaacacaactagtaataaaaaaggggaaataaattatgatagatttattttttcaaatcataagtgaacatattttatgccctctattttaaaacctaaatttaataagaaatatctagatacagaaactaacatattatagaaaattcttagtgaactaaaaaaggaaaattttttgactcgataaagtatgtctcacaaaatgctacagttacttagtaggtttacgcattacatttttaaaagcattccccaaaatatgcaaaatacaaccaggaagtccactatcatctctaatattcaaattggagatctttgccaatcgaataaaacaaactaataacaaaaacctcagaagattaagttcagaaaggaagctaaaatataacattttcacacaaaatgctctttacacagaaaacacttttaaattgcacagaaaagatacaagagacaaatgggaacccaagaaatcatcttgggtaacaacaacgtaagagggaggaaatggagaattctcaagtctagataaaattattttatattcagaaaaaattttatattctttgaagatatctctcagttttatatatttagtaacagaacatggaaatatataaagcaaaaatgtacaaagtgaagagaaaggttagaaaaaattatgttaacattatccaccactattcagtaagtgaagtgaacatatatcaaatttatctatctgccaaagctgtatttcaatctaaatttgttcattaaatgacttttactgaaatttgtttcagtaagtcctttaggtgatgctgatgccagtttgagaaactgctttgtaagatgtaagccaggctacccacttttgtatttcttttttagtgttcttgtgtcaacctaaatattacttcctcagggaaactttccatgatcatttagtccagattttagcaaacttcttttgtaaaacaccatggtctctctctcatatatttttttattttttaaataatcttttaaaaatgttaaaaccactcatagttcactggctgtatcaaggcaggcctctgtctgatttgcctatgggctgtggtttgtcagctcctgatgtagagtagttaaatggtcagtatttcactgacatagcacctatcacaactacaataattctttgtaaaattatctgtttaatgtttattatctctattacactataaactccataaaagcagtgataaaagtgcctctctacatcaccattttattcctaatactgatgtagactatataatttattgtccaaacttggacacttttagagtgaagtggttgtaactattaacagttacaacttgataaaacatatacaccaggacagatctatgaaaatcaacagtgtaggtcaccctacagtgcttagcacagagattcctacatagtaatttcttagggaatagctgttggaagattagtagataaatgaaagaacaaatgaatgaatgaataaggtatgtaaaaaatgattgctttcttacctggccaaaataagggagtccctgtttgtaggacatatccatattctcaaaactaatcttcaccactgatgagtctatgtatacgtacttggagcctgtaagctgcacacctgcagtcaattaagtattattgagaaaatgtcacttccaaaaacagacaaacagagcttctgaaaaaaaccacaaaagctcaccattccttctaatagtttcccttccctttcctaagcagttttaatatgtaggtacttcagatgtcttttataaagaaagttaatcaagatggcacaaaatgcttgtgccaactggtgttgctgctttttataaaatatccaattcacttaccatttcttcatgatggattagtaaacgttgatttctcattattcctaagtgattgtttaacaacatttcttttactctctgcttgcctaaaacatatgctttaatttattaatagtaagaattgtaatatatgtgtattattaaaaatggaaatgcttaaaaaagaaaatacaaattaccaaatatcagatatctccaagagaatcaaaattagcattttaggctttttcccacaagttctatttctttttatatttatcatttatattaatatgtttgagattgtgtgtgtatatgtgtacatgcacacatacactcaatatgtgcaaatgtgtatgtagttttacatgttttttatcattattttataaagtttttgtaaaaccttataaaaacttatttttaattgctacattatttctcatataaatatggacatatgttatcatgtagcaagcccttccctccttccttccttcctgccttccttcctttccttccttccttttctttcttcctttctttctttctctttctctctcttcctttctttctctctctttctctctctctttctttttcttttttttttcttgagatagggtctcattctgttgcccaggctggagtgcagtggtgcgatcatggctcactgcagccccaacctcctgggctcaagtgatcctcccaccttagcctcctgagtagctgggattacagctgcatgacacaacacccagctaattttgtattgtttgtagagacggggtctcactatgttgccaccgaggatggtctcaaactcctaggctcaaataattcttctgcctcagcctccccaggtgctggggttataggtgtgagccactgtgcctggctattcttttattatttatttagttcagtatgacaaatatacctaattatcaattaaatgtttgtttaatacttgaatttcctctggatgtgacagatacctctaaaactttgaagactgatataagtacattagtaatttaatatttcaggaacagaaattttgctgaaatatcagttacatatgcgtaagtttaaaagtactacagtaacacaaagtggtcagcacagaaaaaagcatttcaaggattaagacttaccattttgtgctttaggaagaaggggtattaggtccaggagatacaagaaattagtcattagaaatattattggccgggcgaggtggctcacgactgtaatccccgcactttgggaggccgaggcgggaggatcacctgaggttaggagtttgagactagcctggacaacatgatgaaaccccgtctctctactaaaaatgcaaaaacctagtcgggcctgatggcgggcgcctgtaatcccagctactcgggaggctgaggcggaagaatcgcttgaacctggcgggcggaggtcgcagtgagctaagattacgccaccgcactctagcctgggcaacaagagcgaaactccgaaaaagaaaaagaaggaagggaggaagggagggagggagggagggggagggagacagattttcctggatgagataaagatttttcactggatttattttcagaggcttagtaaaatattctccccaaactattttacttcccatgttctaattctatgctcaccaaaaaaattttataatcgacaactacatgtctcaattatatttatctgtggaatgattaaggaaaaggaatatgcttatatctaaaaccagatactcccattataaatcaataaattggcattcttacttctattgtagccttatttgaatgtaacacttgaccatccatcaacatgtgtgtgaaaattttggttgatatatgaaacattcagaatttgaatcagatgaacccaatgaaaagccctcagggaaaaaatgattgtattgacattgtatagttggcaatcaggtaacaattcgaatgagacagtgatatccattggggtctggcttcttagagagcattacctgttccgttctctgtaacaagagcatgcactttgaggaaactccagtatccttaccgatttaactcaaaagcacctgtgttaatgaacttggagacacagccatctttccccaactgaaaagaacaataaaaaaaagttatattttaaaggaagactgtaagaaatacctatataatataatagggaaaatgtgtgacctcactgaagcaactttaagaatattgtattacccaagttttagttttttaaaataatccattgtgtttctataattatattttcagttcatgtatttacctataactatttattttttaataaatattaactcttacaatattgtgttttaaaaaactcttcatggtgacattattttgttattatacaagataataaacacatccatcactagtcacgtattcacacatgatatttgcaattttggtaatttcagccatattcttttacagttttgaaactgagttttatattatttagttaccatgccttggacatttatgggactatttacacagcagttaggaacacaggctttacagtcaaacaccagaatttgaaccctggctttaccacttattacttcatacaaaatgaaatcttaataaagagcttgtagaactgtattacattagacaataactggaaagtgtttatttagcacagggcctggcacttagtaaacattcagtaggtagtagatttttaaattagattcctttacatttctctcagtgtctagtcaagtgacaatgtctcactaagtgaaatttttaaagtgtcacaattagtaaccaaaattaaacaggatgaattgtcaaatatttttaaaatgtgggataaattgtgctcataggttcctggactttaatattggggaaaaactgatttcttattctactccttcatcttatgatgatatgaggaaatctagtcctcaagatgtgggtgagatgtcaaaatcctgtgctacttcagggggtccttgaaactataagaaggtctagaaccatttccagaagcttaaagatctagaaaaatttccactatactaaaggtgaataatgagataaattatttagtccacactcctgctttacatgtgcatttgattattttaacttttattttaggttcaagggtgcctgtgcaggtttgttatataggtaaattgtgtgtcatgggggtttggtgtacagattatttcactatccaggtaataagcatagtatccaataggtagtttttttgatcctcaccccttcccaccctacatgtacattttaaatttccagagctctcaaatctcctgaagggcatcctataatatagccaccttcgataatgcattctgggatctacctaccctgtgcactcggcttatattggtttagtctcttctagagtgtgcatctttaaagattatgactgcttcataaagtgcaaaacccatgaggatagtacctgatctgtcttgctcaacaatgaagcttctaaataaaattattcttgcatattaaaagacctcaatatttatctgttgaatgaatttgtggagaaaatttttgtatccctgatatccctaaagatacagccccactagttatttaaatatttatatgacttggttggggtgcagtggctgacacctgtaaccccagcactttgggaga

SEQ ID NO: 17902 - DNA, 34263 bp, Homo sapiens
tggtggcaggcacttgtaatcccagctacttgggaggctggagcaggagaatcgcttgaacctgggaggcagaggtggcagtaagccgagatcgcaccactaccctccagcctcggtgacagagtgagacccagtctcaaaaaaaagaaaaagacacaaattgactagcccaacgttatattgctggacggtggcagactcaggacttgggccccagttttgccactttagcacaggttcgtcggggtttataggggggactctttgctgataggaagttttcaaatagcatgtaagagaacagtgtagaagtggaatatgtgaaggaacgtctggtgggaagatatgtgaagctggcaagtagggaggttgaagagaactcacttcacagaagaattcattgccacggagcccacagaaccaggaaatccaggacacctcctctgagctgctcatcttcacgtcagctagaaaaagaacagtgtcagtaaagctcaagttctccttccctgcctctggtatcctccctcctcccacattcggccctccaaccacgggagaattcggaaccaccctttcttaaagcaacccaaactctgaagcactcctctccagctcctctaatttacatctcagccccttttctttgaagttaaacattctttggggtcccaccacttgaaagaagccaacagatactttgacccaccagcccgacccacatccctggagctcccgaaggccagggccctctctcctctgtgtcaactccggcagggacctcgactcaggctccctaccaatacaagtctctgcatgacccccacgcctttcccaagggtttccaagtttatcattctcaagcaagaaccgggctcctccttttctcacgggttgggggcgattgtcaggtccctttcaccggaatccacacatcccccctccgctcctcaggccacctctccctccttcgtgccggacctggtcgcttcctcccccgcccccacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccaggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggtgcggcttggctccgtgcgtagggacttgggtggggtggggtgggcggtgtgagaactggaacgtcccagtgcgctaacctgaggtggtgccagccattctgctcgtccctttgcacttctccatttccccttaggctctaagtgtgaccttcgaaccctggtcagagtaatggtgaggggcaggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtatgtcttacggggtgggaaagtggtttcagaaagaggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaattgttgttaggattcaatgggttaatatatgtaaaatgctagaatagtgcatgccgcatagtatgcaatacatgaatgttagctatagtcattatgactaatgtccctccccttgcccaagagtttgctaggtctggttaccatttttttctttcaactattctgctctggatcccacaatggtttaaagaaatttgtttttaagacaagtcaagtgcagtagtgagaaggaggggaaaagtggagtaaggagtttgatctgtaactgagtgaacaattaattcagataactcaccaccacctttggaccagcctggatccctcactgttaagtaggaaggaaggcaatttgtcccttttttttttttttttttttttgagacaaagtctcactcatctcactctgtcgcccaggctggtgtgcaatggtgtgatttcagctcactgcaacctccgcttcctgggctcaagcatattttttgtagaaagcaggctttgccgggacatggtggcatgtgcctgtaatcccggctacttgggaggctgaggcaggagaatcgctaaggtggaagttgcagtgagccaggatcatggcactgcactccaacctgggcagcagagcaagactccatctcaaaaaaaaaaaaaaaaaaagcaggcgttgccattttgcccaggctggtctcaaactcctgagctcaaagccatctgcccgcctctgcctcccaaagtgttgggattacaggcgtgagccactatgcctagctggcaatttgttccttagcagaaaagctgaaaagatcctattctaccctgccagccccctctgaggcctcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccacccatttgtctacacttttctttcccacacttccccactctcccaccacccacccccttgtcttgctcatgccgggtggtaggcacaagaagagctcactgttgtgaaatccaggaattcaaatttgcagacgggcaggggagggctgttcaagtcgcaagactcctcattttttcttttctgggaaagcctttcatgaagtcttggatgcgaaatggaggagtggtgggggatgtggaaaagaacccaggggcagggggctgtagggggcgaccgagtttagggaagcatgagaaacccgggaaaatggggagctgggtttatattaaggtcctggtccttgctaatctcggtttggcggtccggcgcgcacagacagcgcggggtatacgggggcggtctattcgcagggtccgccccatgagctgcggcaccgcccccgcgggtccttccagtcctggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagatgaggattgaaaaattatctttattatcttgagtgggagctggagctggaagtctccagcttctccctccaacaactcagctcccattgtacccatctggggacttagatgaagttacaggtcagttattggacagctcacaggcctctgtgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtgacatcacacgagcctctttcaccctgtaacaccagaagacttggtgagtcctaatcctgttttatgagattttaaccccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtgtcataggacccagagtgaggagttctcctgccctcccttgtttccctccaacccttcctgccttgtatccctactcactgtagaggagaaagcgctggtaaccctggcctgtctcattcagcatgattccacctgggcatgagctggaaaagagctcagtcttcatgtcagggcggcctgtcaaggcaggtgggagaagtatgagaacagagatgcagaaccaaactcaagggagggtgagggctgggaagaaccaaccttcagttctgagatctgtgctcccttcagtcaggtggtagatccatttccggggcacacagagcccatctttcctgcagaggtggtggtggcaaggaggaaagaatgagcatcaccccaaccatagtgtcccagcttcttttttttttttttgagacagagtctcactctgttgcccaggctggagtgcagtggcgccatctcggctcactgcaagctctgcctcccgggttcacgccattctcctgcctcaacctcgtgagtagctgggactacaggtgcccaccaccatgcccagctagttttttatatttttagtagagacggggtttcactgtgttagccaggatggtctcgatctcctgacctcgtgatctgtccgcctcagcctcccaaagtgctgggattacaggcgtgagccaccacgtctggcctgtcccggcttctatttactccattgtatttgttattgaagcccagctctccttgggtttcaagctaccaagcattggttaggcacatctttctccagagggcaattaatacagccactgaattccgtgggccaagcatagtagatataccagctaagaggccagctcttggtgggtggattctcacactttgggcagagactgaacccagtgatgcttctgcctccttaccactcacatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactggagagacaatgaagggagcaaaagagggtgggttccagcacaggatgggttcaacctcttcatcagtcaaaacagcaagatttaggggtagaggtgttggctgccttcctctttccaactggggattggatccatgacaaagagtcattaaatgacttttcctctttgcccctccccagtcaacctgggtaaccaccccaccccccaattctgccatgcctctgcattgatggccacagtactgatatttttcttcttgctttcattatcacaacactcacacccccttcctctcttcctttcccaagatggtctccagtcatcctaggccatccacccaagtccctcagagcctccaccataggcttcccccaatctcagtccatacctccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggctgctcagtccactctgctttcagctcccttgcgttcgacccttgaccctttcacctgctaatgagtaacttcaaccttgttttccaacccaaacctggattacttagtgtttgggacttcctccccctcttccggatgcaaccactccatagtacaccctggcatgtccagggtttctcaggagttatgaggagagctgagctgtccagggagaagcctgtggtctttgaacctgtatctgagctggttatttgttgcactgtgcagcactgaagggaagtagcttgactgggcctctcattcattcacttagcaaactgttttgaatcccaagtcccagttgtttcccaagaactagctaatccccggggacataaaaaaacgaataagacatagcccctgatcttgaagaagtcgttagagggaaaactagctgtgtagacaaaccattgcaatacaacttggtaaatgctttagaacaggtatgatgcaggtgctggggcacggtggattgctctctttagtttacaattagaaaaatatgtataccctggcagtgttcactgacacattcactcaacatttattactacaaagaggctatgtaatctggctgttagagaggatagatgttggtgtcaggcagaatgtgtccaaaccctaactacaggcagggcaggtagctcatgcctgtaatctcagcactttgagaggccaaggtgggcggatggcttgagcccaggagttcaaaaccagcctgggctacatggcaaaactctgtctctacaaaaaatacaaaaattagccgatgtggtggcacacgcctgtagtcccagctactagggaggctgaggagggaggattgcttgagcctgggatgtcgaggctgcaatgagccctgattgtgccactgcactccagcttgggcgacagagactctgtctccaaacaaacaaaacaccaccaacccctaactgctatgtctgttttttcatctgtaaaattggcaaatcatcaatcttataggattaaatgaaataatgcacataaagcccttagcaaagacttgcacatggtaagtccaaagtatatatttgctataattaatagtaatgtttgcaaagcacttagtttctggtgggtaataagttctcaaataataggcagtaagaattgccaaataggttgtccttggatagcaccaagtgactggagcagttaatgctgtgagagatggatcttcctcgatagattatttatttacttatttatttttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccgagggctgaggcttgcgatttagttaaaaaacaaacaaaatttgggtgaccagtatattagagtttattaatactgttctattttggtgtaatgtttgaatttttttttttttttttttgagatgggagtctcgttctgttgcccaagctggagtgcagtggcgcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctcccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagcctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggcggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgtttttaaagggtagaaatcagaacccataatggagataggtccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatccacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggatcatctgagatcgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaarttctcccttgctctctatccagcagggcgcyggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagcttttttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatrgggacttggccagcstttctccaacctgcttrctttttctctttagctccggtctgatatacaaaaacgactrcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctctacattgtctccattaggtagtgtgtcccttaatcttgtgtgaacttttttaaattaatacttccttggaacactgttgtgttctactcagcacgctaaattgtacaagccagttttgatgtttgtttttttttttttttgagacagagtattgctgtctcccaggctggagtgcagtggcccgatctcgagctcggctcactacaacctccacctcccgggttcaagtgattctcactcatgcctcagcctcctgagtagctgggactacaggcgtccgccaccacgcccggctaatttttgtatttttagtagagacagggtttcaccatattggccaggctggtctcgaactcctgaccttgtgatccacccgccttggcctcccaaagtgctggaattacaggcgtgggccaccgcgcccagcctgatgtttgtattttttgtgcgaaagcactttatatataaataaaaaacctgtattttgagttgggagcatattccaggtgcacactagcatagagctctcaaattacccatcaaaaaaagtttctgagcagctgcagacctaagtatagtctttagcataactagcatgcagcgttaccatgtgaaatcccacttagtttgacaatgctggaattggtctatccaattcaaagagccccttaagtgtgctccaacattgaggccttaacagagatttccccttagttcatcataaagaactgaagtcccatggctgcaaattctttgctagtccctttgagatgcagttgaagtcccttctaaacccccccatcccctaccttggctagtttagtgctctatcaactaagcatggcataagcttagaaaattccagctagacctcttggaacatgagctcacggacatttaacaggcctgctggagagtccatgtgaagacactggttgataacccagtaatgttacagatgtcccaccaaggccctagatatgcaaaggaagccatattgggaccagcccaggtgtcagctgcagactgataaccagttgacctcgctcactggcacaaaaaagcagatttatccagctgagctcagcccaaattccagactcacaaaaatttaaagatccaatacgatggtcatgtttttagtttcaacagctcactggaataagtaatgaatatttccctgactgaaactacagatcactcagcaccatgctttaagacaatgcaaacaactcatcccccaaatcattgtagaagtttttttttttaaatccttttattactcttttttaacaaacagccccagggacaggggaccaggggaagggggaggaggggaagtgaggccccagccccacaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcggccctgtccgctcccaaggcttaggtatccagcgcagggcatctggtggggaggcctaggggacaggcatgtgttaaagagtgagtcacagtgagaggtcagcgatgagacggaaggacaggaaatcaggtggcaactcgaatttagagttggggccacaagggtttctccttcacctgctggtaaaggtcgacgcgctgggtgcggaagactccactgtaggtggaaggcgtggccttgagacgggaattgaggccagagaaggacctaagggaagaagggcgtctaaggcaagcctaggatccagaccctggttccaaagtaaggaagcacttggaaagtccacatccctattccgtttcaccttccagttgggggagtccgtgatgatccaggtcccccaaggttgctgctcagtttttgataatcctggaacggctttagttccactggatgcagctgaggggaaaaaaatcatgagctgcctaccttgaaatacagaatccctactcccaagtcttggcgctccctagcccctcagttcctgtaccttacctctgctcgccccaagctagcggggaagggcctggcaggtgaaggcagcacccgagtagcaggagcaggtgggggccgcacagccaggctggggggctgcagagcagggcccacaggtaacagagaaaggggaggtggggcaggaggtggtgctggcggcagggagccaaagttcaccacaggcagctgtgagtctaccatgggtagaagcatctgtaacaagaaatttgggtgtgcatgttgggggcagggaggaatgtcagaaaaccagggaaaatcaaagccagcaactggacagagaaatcaaatgaaggggaagtgtgaagatacaatatacctgctgggcaggagcccctgaagggagaaagccactttggccaccaggctgcagaggagtagaataaaaatccgaaggggatggcagatcctggcgtacctgtcgggaaacagggagaaatatatcaacccccacaaaatcattctccctaccctatcccccaatatctaatacctgcccccctcttacctgaagcaacgatgtgtcaggcaaaggactggggcagaaagccggagagtagaggaaggaaggtggagggtagagaactcctccagccggcaacttccccagctctgtagcttgcattgtggagaaatccagaaactggcccttgagagctaccccagagagcagtgctgagggaggggctgggccggggggtaggtataggggctgtgatctgaaaataaattgtggggagaaaagctgttaggaagccagagtcctagcaatgccttaagtccactagcttctagtaccctagaactgtgtcttccccttccctctccccgaaacacatctccaagtacttctgtgatccacaggcatcgagtcttacctgtaagggtgcagtgagggtgtcccagggcggaagcctccactgtttggatgtaattgagagtccatggctcccccagagatctgcaggagaggagcacggttgaaacagctttagtatctgtggtcaagaaaaaagatcaccatcccacccatagaagcaaaaagtagggagaaaaatgatgtgacaaagtggtatctcacaactctgcaacgtagaaaggcttgattataaatacataccaggcagaaaaaaattattattcactgaaggggtcatgcaatgggaagcggggcctacctgagaactggaaggcccagcactgccatagaaaacctcaggatacaggcgctggcctgaggagctgggctccgggacacagtgcccagaatccaggttcttggattgtggctcagcagaggcagcagcactgggaagcagctcccagtctcgtgatacaggaatggcctgggaaggagaggcctcgtggagagggatgtctggcatcctggacgccctggtcactcccagcaatcttccccagaaatcttgggcctttccaccaaactcttactcccacttacctcagtgactgatgctgttagctccttctctgctttcaagctgtctcctaccactaggcgtaagtctgagtcctgtgatcacaagaaggcaggagacattgtcccgtgacagacatgtgtcctctatgtcccacctttagtccttcccttctctccacccaactcaggatacccagatccagcccacacagaccttgtcactagtgccaaactggactgggggaccaggtcgatgggatggccgaatggggccaggctctgtgcctcggtctgtacgctgtgatcgttctgtgccaatggggccagggggcagaggctgctcccggggcagctcctggattgggcacacagtaaagtgcattgggggagggaaagggaaatccaaattggaatgcccagaacacacacgcagagagaaaaagcagaaaaaggtagggccaaagtcagattcctggaaacattccccttatccttttttggtcttttacctttctgtccccatcgtggggggcaggtggtggtctcctaggaggttcagagccaggtggaccctcacaaggaacagcattcaggggtgaggagcctccaggcctcttggggggtccctctgctgcccccttgagtcctccatcaggggaacttcgctggctgcagggacctgatgacacctgagaatccccactcaggtccaccccactgtcagactgactcatctgagaggagtggagaaggagctagttaagtcagggtagaaagcaccccaatacctgactgatgcacacatacaaactgcagaaaggggacagccaagtgagagaacagctccagactcaacccagagcaggtggggggtatgaccagtgctcaaaaaagtcccagctcagacacaccctcccaccctcactcacttctgtgccagccacatcctcaaaaggactcaggggctccatccaaggctccatggagctgggccggtaactctttcggctagtggctggagaagggagcaccaaccagaagagaagtgaggagatgacagttcagaagcccctctcattcttaacccttctaccatagtcctttcactcagctttactcaccagtatgtaaacggttccagatgtgaggggtcagggcctctgtgcctgtatctctggactctgcctgagggcctgggccctcaggcttagagcccaagaatccagagctatgaggaggtggcaaagattcctacagatgagaagggccagaagcaaaacatgaattgggtgggaattgggaattataggaagccaggacagagtggggtgacacagggtgtggggacaacaagggagacacatgggagactaatactgagaattctggagtaaaaacacagtgaaagaaacaggaaagaaaacagagaaaacataacccagaagaattttcacgagtaagagtgcagtgaagcacaatctcaaacccatcccttacctcctgtagcagctctggttttctgggaggccgctcccgacgtttagggggaaagggactaaccccggcagagtcccgaggagtcccacccacccctctcaccattggccccggctcctcaaagtgggggtctgggaaagagaaaaagggtcagcatctgcctggctctgccactgaccctaacttttcctctctactccacctcccaattcttctacccttgctccctgcagaaacgcacccagcagcagggcccctaggccaggttctccacccgctccctccagcacttgaccttctctggggatggagatattcccacccataacccctccagcttaccagaactgaggccgctgttgaccctctggggctcgtatcgggttgggggcctaggagaggggccctgaggggcttggggaggcccaggcttgtgccttggatgaccccctggtgcagttacactcccttgacggctactaagctgggccagagcctgttggatgccagcagggttgctgtggataacttggtccaggcggaagacagcagaactgctgggaggtgggggaggcaggggaagccccgggggacgctcctctggaggacgactggagaaaacagagcattagctccagtatccactaaatcgttactttttcccacaagttatgtttcccaacttctgcttacaacctattctcttccctattaaagtccaggtgtttttgagtccttctaagggttcctatgcatacagatgcacagactggaaagcaaagaaccagcaatgaatacataggtgggtgttcttgactctaacaccctaccaaccgctttccagttgccttagccagacatggaaatcctactgacattctagagcccatggcccctcaggccacaatctccactccacccaaacttatctttccctcaggctttttccccctcctccaattttta

SEQ ID NO: 17903 - DNA, 13170 bp, Homo sapiens
accctccaagatcaggaaatgtgtccgtttcttctttgtcagcctcacaaactttttttttaagttcaactatccctgtcattactaactattcccccatgatccctagcctacacttttctgtggatgaaaatgtaatgtattcgagaattttaacaatttcttagttttcccattcacattcactgataatttattttgatcctcataatttattgagcacagcagggaccggggtcctttccccaccttagagagattattttcactgctaaagatcataagcctagtgagagactgggagggagatggacctagctctcctgacacaggtcccaagcccttacctccacggtgtctaccctccctccaggacttcctccgtgtgccagctccagcaaaggatctgattcagctcgcccccaaaaaagacttttaatagttcaataacaataatgaatatgcaaggtttgttctaaggcatttagaaatggtttcagggagtcatgaagccagtcctctcttgggctaggggaggccgagatggtcttgagctccaggggacttgtttcttagtgcccaggcctgggcgcccctcccccaccaagcctcccaggtcttctgtccaaagccctccccctccaccccacctccaaccccgtctgctctaccccatcaactacgttttctccctcagcacttgccttataccccatgcactcacgagcacagaggcgacttccctctctcagactttaggcgccactgcagggtccggaaaagaaagagaaacggcccagcgcggtcgcttacataacccagggcggggctccgctccgcccccgaaagtttttgcgacggagttttccctcttgttgcccaggctgaagtgcaatggcgcgatctcggctcaccgcaacctccgcctccaaggtttaagcgattctcctgcctcagcctcccgactagctgggattacaggcattcaccaccaagcccgtctaattttatatttttagtagagacgggatttccccatgttggtcaggttggtctcgagctcccgacctcaggtgatcgcccgcctcgacctcccaaagtgctgggattacaggcgtgaaccaccgtgcccggccttggccgcatgtgttttgaattttgctgcccggaattcactgcgaggactgggatcacccgtcaccccgccctggtctacggaaaatgaaatgtgtttactgatatagaaacggaataacggcgctgtgggctggggagggccgagctgccttcaggcttctggtctccagctgcagggcactcacacctgcccgttatgaaaatgcagacccgcagggcaggaattccgagtccgggctggagcgcgatctggaatccggctctcttgaaacagcaccgcggaggattcggatccgggtgagtaggaaactgcgcctcagcccctcccacgggccgcccacgtattccaggatccgaaaacgcttcctgctgctccgtcaccccaggaaggcagcgtccgcctctgggcggttctgatggaaaccggctgcgccgcccgcaggaaaacccacaactaaggggccaggaaaaagcctcttagggtcccgccacttcagtgaggatcctaatttacacccttagtttggcctccatgaaagactggagtgaccttcactgaaatgatacaaggggcccagggagctgcggcgctcagaatgcggtgacagcgccgcctcgcgtcccttccctgacctgctcccggcggacgcggagaagtttgttggcctggaggctggaatataccggggatcaaatgcagagaatggagaaaagagggaaggatggggggacgtgttgaagaaatgagggaagagataggaagaaaaggggagagaaaaagtaaaggagagtttttttgttttttgttttttttttttgagacggagtcttgctctgtcgcccaggctggagtgcagtggcgcgatcttggctcactgcaagctccgcctcccgggttcagggcattctgctgcctcagcctctggagtagctgggactacaggctcctgccaccacgcccgactaattttttgtatttttagtagagacggggtttcactgtgttagccaggatggtctcgatctcctgacctcgtgatctgcctgccttggcctctcaaagtgctgggattacaggcgtgagccaccgcacccggccggagagagaaaatttaaaagacgtagtttcattatttcttttatttttgccctttatctagttttacttatgaacatttttaccacaaatttctctctctctaaatctgtaaatatgctgctattattgttatttcagagcctgtgagggtaagttgcagacagcatgaccctctacctccagatgtgtcagggtgtgtctcctgggcacaagaacagggtttttgttttgttttgtttcacataagcaaagtacaagtctcaaagaggataatatttttaaatcatcttattgggacatactttgcatgcaataaactgcatctatttaaaatgttcaacttgttgaattttagctgttgtacacacccacatctccactaccacagtgaagataaagaagattttaatcgtctcccaaagaacagctacacgataaaattctatgttgtcattaaaaagagtaagagcaattttaagtattgctatgaaaagatgtgcccagcatacttttaaccttttttaaaaggttaaggaggctgggcacagtggctcatgcctgtaatcccagaactttgggaggctatggcaggcagataacctgaggtcagaagttcaagatcagcctggccaacatggtgaaaccctgtctctactgaaaatgcaaaaattagccgggcgtggtggtgggtgcctgtagttccagctgtttgggaggctgaggcaggagaatcgcttgaatctgggaggtagaggttagagtgagccgagatcatgccactgcattccagcctgggcgaaaatgccactaatatcacttacataatattaatatatatttgaagtaggggaaaacctggaagattcctcaccaaagttttgacagtgactccagagactgggataactttgtgactttcatttcctcttaaatgttgtgccagggtctgaccggcagacccaggctgcacgatggatgaataatgtactcagacaccgatattcagtgaaagagtgcaccagagggccaggccactcacagaaagggttgtggcagctgcgtgccctgactatctggccctgtgggcctttattcagcacagatttaatgacaaaggctttgagtcaacacacctgtgggtaattaatctggtcgcagtcccccggagagagcagtcctacaaatgatcaaaggtaaacatgctctttagataaactctcttacatgtctttgtacttactcgaagctattaactcaaggtaaggggattaggctgctttcagctataaccctatcctgaggcttttgcaaaactttccaccttccaagaaggtttgtgtctatttcctataactttatctttataattattcccaccacctgaccaatcccctacaatgttggaattttatcttttagtgtaaacttggatttgggtggattgcagtggttcatgactataatcccagctctttgggaatcgaaggcaggaagattgcttaagcccaggagttccaggctgcagtgagctatgattgtgccattgcactccagcctgagtgacaggaggagaccctgtccccaaaacagaaaaataaataaaattttaaaataataaaaattataaacttggatttatgtggaggttaaggaagagaatatttcagtttgaaaatatgaagctaagccccacaacgaaatagttacagagttttaaaaaagaaaatgttcattaaaacccaccaccagaaactctctttcaagaggatccttcatattttcatggcattgaatctttcttaaagtgcatttgaaagagatgttttcagtggaatagagagatgtgtaacaatatttacaaaagcggttggctgtaataaaaaggaaaacgcaaatgagtggggacacaggggaccctgttccatttattctcaaagcacgtttgaaaactgcgttgccatagcgtccttgggtagaggcaaagtcgaggcagatcttgttcctggagtattgatttgattttggaaacggtccaaggctttcagaaatcaggctgactttcagatctaaagtctcaagaatattcgttctagcagtgagcctgtgagaatctagcccatctgggcgatgcacgctctgcttccacctagtggcagtgattggaaggacagggcacagtgttactgcatgggtggggctgaagccaaggtgaaaccgcctttgcaaaattataactaaggaaatgatgacagtgaaagacatcaaacctaactgaccccatcttgcttccaaccgctaaactgcccttcttcatttctaggcgtaggctgaactagccttgggaaggaatttagtttatagtttaaagggaaactgttcttgtaaaacgaagaaaggccaccggccattaagttaggatgagaggggctggaattctgaatattaccagccattattccagaggtcataagatttgcaacttctccagttactcttgaaggtaacatcactattgtgaacctcagagtggccttttgagatgtcttttcaggtttttgtatttttaacagctggagggccccatctggacctgccaaccagtcctgtggcccccacgttcaggaactgactcagcctaagagaatggcctccactcactatgatttcataccggagccaaccagtcagcactcccgattcactggcccccctatccaccaaattatccttaaaaactgatgagagtttttggggagactgatttgagtaataaaactctggtctcccgcacagctggctctgcatgaattactctttctctgttgcaattctcctgtcttgataaatcggcttcgtctaggtagccggcaagatgaacccacttggtggttacaaagggagtccaggccagtgtgcattactgtagtggggtccaggtagcggaggaaaggcgaggacactcagggaataaatggcagaggaagaaggagcacaagggaggacccaaaccctccagacctctccttccttctctccctgttagggttggagggaaccagcgtggtcccaggaggggtggctggtggggtgcagaaaacgccctggttgcaaaggggcctcacgtgcccgacacaagggtcctggctgttagctgctactcatgagttcaaactaggaggaggctcacacgtgtcctttgcaaagtagactccttatctcccactccggctggtttcccaaatccatcctgataaagcagaaaaaccaagagccaaattctgcgggtgacctttctgacagctggaaggtcctccccatccccattccttgcgtgctctcctcttgtcctgccccctctgctttgtctccacttcctcatccttttccctctctggaccctgctcctgagtatctcccaccttcttcagacaacttctcctcatgaagtacagagtcccccacctccaggaaaaagagacaaagaccacgagaaggacctgagaaacgcctgtgaccccgcccctgagtccagcctctccctcagcgctggctctggctgtgtgtgtgtgtatgtatttttgttttgtttgtttgtttttgagacagggtctcactctgacagtctgcagtgtcctgatcacagcttactgcaggctccaactcctggactcaggcaatcctcccacctcagcttctcgagtagctgggactacagactggagccaccacacccagtgtgtgtgtgtgtgtgtgtgtgtgtgtgtgtgtgtgtgtttgtgtatatatataccctttttttttttttttttttttgtagagactgggtcttgctttgttacccatgctggtcttgaacttctggcttcaaacaattctcatgcctcagcctcccaaagtgmtgagattacaggcataaaccacaatgcctggcccctgtgtgtgtacatasaaagtcaaagtgctaaacctggcgcctaggaaacatccccacctaggcattgcttgcaacagtmggtattttgtgcacctgtgcttttatttcaggagctgggacagttatattcatcagaacagcacggtgtcaaggccctcacccccagaaagcttargagacactgttttatggaggagagtgagattggaggaasccctgactccaggtctcctgatccttcctacacaaagcgaagctgaaaaaaagtgcaggacactccatttcctcctgggaccagacagggaagccagagccaccatggatgtcaaattccrgcaaggaaacaccagtatagcaaaatctccacatcacattttaaagctcacacaatggctcaaagagaacccacatcaaaaaaccgaattcctagctcaggtgagatcaccaaagttgcctgtgaggcttcgtggaacctgcaggtagaaaggacatctttatttygagctgcagcccagttgctyctgcgtcttggagccccttgaaaggaccctctcccttcaacagtacatagggaggccatttctggggagaaatgtagactgtccttagactcctgaggtttttacacttgcttgctgactctgtggactttgactwcatcattaaacatcttataatgatgtaatttgctttgactgtaagtgtagaacaggacgctgttcctgaatcaggaaacaagggactggtgacctgaactgccaccmccctcystggtgctcagatgyaatgaaatygtgaggcaacaaatctatggctaggtaaagggtcaactccatttcagcaaatgtttcagatgttccttcctgcctagtaatgttccagctttaccccagccttratcttttaaaatgtatattttccttrgygttgattttaaagtaattcgtatgtatttattacactgggtttgttgcagtaagccacctcgaatgttgctgtagaattaaagtaagcaaataaatgtgtggttctccaaggagttattgctaacaccatcttaaaaatgtattaaccccaaatccaatcacttctcactcctctactgcctcctccccagggccatcctctccaagatagtaaaccagaaggccttccagctgggctgcctgctgactctcacacccgctgtccatcacccacacaatagtcagagtgagcatttcaaatgggaattagagctcatcctcgcctccgcgtcccacagacatgccagcctcttcccttcttagcacagtgaaaccccagtctctcactatgttttacagcccctcatccctcatcacaggatccttctggccactctggcctcatcccacccctctcggcccagctcattcatctccactaacactgctcaatcctgtctcaggcacctcccactggaactccccaagtgcacctgctccccagggatccaaagggatccaaaggcccctcacaccattcaggtctctgctcagacgtccagtgttcaaattcccaggaacatcttgatcaacagactatatctcctaccatcctcaccaccatcaaccttctagctcaagcatattttctccataacaattatcaccggtattagaattgttttcatttgtttcattggttgtcatgttcttcgaggcagggaccttgtctagtcaccacttggatttccagcatctagaaatccaaggacagagaaggggctcaataaatatgggttgagtaaatgggtgaatataattggtacactgcttttttttttttttttttttttttttttgagacagagtctctctctgtcacccaggctggagtgcagtggcatgatctcggctcactgcaagctctgcctcctgggttcacaccattctcctgcctcagcctccagagtagctgggattacaggcgtccgccaccacgcttggctaattttttgtatttttagtagagatggggtttcactgtgttagccagaatggtctggatctcctgacctcgtgatctgcccgcctgggcctcccaaagtgctgggattacaggcgtgagcctctgcgcccagccggtacactgcttttgagaagtaatttgataatatgtatgagaaggcttaaaaatgttcatgcggccgggcatgatggctcacgcctgtaatcccagcactttgggaggccgaggcgggtggatcatgaggtcaggagttcgagaccagcatggccaatatggtgaaactctgtctctactaaaaatacaaaaagtagccaggtgtggtgacgtgtgcctgtaatcccagctacttaggaggttgaggaaggagaatctcttgaacccaggaggtggaggttgcagtgagctgagatctcgccactgcactccatcctgtgtgacaaagcgagattccgtctcaaaaaaaaaaaaaaatttcatgccttttgacccagtaacttttattgagaaatctgtgattttaaaacaaaatccaatatatagaaagatctttaggtataaggatattaattacaataatgaaaaaaacatgcaaaagaagagtggctaggtcctctgtttggaaacagcctacagctggtgaaagctgtgtgtaagaagattttgtaatatgatagaaagttgtgtattgataataaagttttgaaaagcaagattcaaaataactcataagcatgacgacactaagtcatcctgcacagtcacccgcatgcacaaaaaccaggagtggaaactcaggggcagctgcaaagcacagctccaggccccttccctctgaagtctgaggctctgccaggcaacgtttcatcccgatcctcccagtggagacactggcagtttccatccttctgcttctttatacctttttatattttctgtacttgagattttacttcctaagaagataaaatacctattagaaagttttaaaaatttgaaataaaattttaaagaagtccaaatgtctggccaggcgcattggctcatgcctgtaatccctgcactttgggaggccgaggcgggcagatcacgaggtgaggagttcgagaccagcctggccaacatagcgaaaccctgtctctactaaaaatacaaaaaattagctggatgtggtggtgggtgtctgtaattccagctactcaggagactgaggcaggagaatcgctggaactcgagacgcagagcttgcagtgagccaaaatcgtgccactacactccagcctgggtgataagagcaaaactctgtctcaaaaaaaaaaaaaaaaaaaagtccaaatgtccattcccaactcagcttcaaggaaagtctcctctagactccacagggtagaaattcctgttgatggcaccttcagaaggtaagaaaggaactcgtcctccaccatgcctgacccgtctttgggttttaggcattggccgactgataaaggcaatactgagagtgtgatcaatgtgtagacgaccgattgtcatataatatgaatctcaccacacctgagagagtgggatagattctctcattttcatagtttgggcatctgagtccctgagagcctgaatgcctgacatggattctccaagaatgttggccttcagactctaaagggccccgggtctcctgtgaagccccctgtgcatgcaccacacccgcagaggctccacaacggcgggaagggcacccagggtcagagcccaggcgagttcacactcggggaccatccacatccagggcgtgcaggggaggggccgaggtgagagcccaacccctgcctaggctgtggtgactggtggctgcacgggggtcccagcgctcctggagctatcattctttatctcctgaagaccccggacccgcacataccaaaattctgcatttctggtggagcggtcttctcttttgagatgtaaacactacttctcgaatcttaaagccagccattgccactcctaagggataagcctctaactccactgaaattagcctcagaatttcagctgagcatttggagccacaggcaggaagtctgtgggatttgcacctggctgatctggaaggtggtcctgaaaggtagtgtgtgactaggggggctttgaggggcatggatgtccctgatgaaaggagaacaagacagatgggaaggttccaaaagtgaactttagggggccctgtgcccatcactaggatttggaaaatcttttcccagccacttttggcctgtgggttttcattctgctttcctgtctgccaagccattccaggcaatcccttcatttggtaaacatttatcaaatacctactgtgtgcagggcattgttttaagaggagctgggactgagataagaggaaataaaccctccttgccctcaaggcgtgcccagtcttgctcaggcagagatcagtaaggaaatcataacacaaattgagagaggaaaaaggaagaaactggtcaggcgggcagttatggtgggtcctcagttgaattatttcaaacaaaagaacggcctgcaggcacaaagaagggaacttgcacaggggggcttgcctaagacatgcccacagctgcacaaataagaaaggctgcacaggagacttgcccagacatgcccgcaatggaaaattctgtcccccgatacgtgggcagtcagggaaacaaagcaatatggagtaactcaagctaagggcctgcatgggcactaggaggatggggtggagctaccggaaattcgtgccttatgcaaatgagacacccagccctcatcagtttcttataaaaggctttgcattcagctgtaaaaatggcaaccatcttccaagccccctctccgtgggggagagctttcttcttttgcttattaaacttttgctccaacctcaccctttgtatccatgctccttaattctcttggtggtgagacaaagaactccaggtaacacctcacaaggagagactgagaggctgctacgttgtggtgcattggcaagactaacaaactggctagtgggacatgcacacttgcttggtagacatatatgtagatcttcagctctgactaatgaaggaataccaaaaatctcataaaagaaaataatattatttgagctttgttttgtggtgtaagtgggagccccacaggcacccagggtaggagagctttgctcagaatccaggaagtgaacatctttccctgggccaggccaagaatgagactaagctgattgaggagcctggtgcctcctggcaagaaagggtgtctgacacctgactatccagaagtcacagctactcaatattgagacttgaaacagagagagagacagagagagagagagagacagagagagagagagagacagagagagagagagagacagagagagagagagagagagagagagagagatctgatttgaaaagcagaattctgctgggggcttgttaaatgcagagtttctgatacagtaggtccaggccaggccctgaagattgcatatctaagttcccaggtgatgccaatgctgcttcccccaggaccacactttgagaaccaccaccctaaggcaatctgtgttggtttctaatatcagaagagggctgggagtgggctgggaggcagaggtgtaggatcagtgagaccacacctgacccaccctggacagctccccaccccattcttgcagcattttatttcctgggagtcctgggaatggaagacacccaggaagggaccaaatgtggggtcacagggtgatccagaggctcggcttcatacagcacctggggctcccgccactccacaactggcccccacaccctcagtcttcccacccctcacgacactgacctccagaccttcctcgactaatctcagcaggttgggcctgggatgtgacactaggagctctgagtgtaccttctgatccaaagatagggtgaccgcgtatgacaagtactcagatgggccattaataggaccttgaacatttggcaaatggcttcagtcacgtgtgcttgagaattccagtgttttctagatatggcatccatgagcccacacaaacactggagggcgtcgtgagcatactgaaacccataactgctgcactggatcccctagaatccctttcccacttagaccaagatttgaacaaaatttccttcaccaaacaaactgcatttaattaatcatgctgttattttaccttgtaatggaaaaaagacagatgtaaagaaagatcatgcaattaaaaagaaaacaacgtactgaattaaaatggcggtaaacctccttgttaaaggaataacataatatttagaaaatttttaaattttatttcgataaaggttaaaaaattccattagtttttaaaaagtttttcattttgaattttttgggggtttgtttggtctccttaggaattatcttttatttcttgatatagttcaaaattcaaaattcaaaatgttcaaaaggtaaaatgtctctctcttaccctgtctcatccccaacaggcaaccaaggatattaacttcttgcttattcttccaaatatattttatgcatatgcaagcaaatataaatgtgtacatatatatcctttgtcccttttcacacaaattttagcagactctatatgttattctacaccttgctttatttcttcatgagggaatatcaagagttttctatgtctttcttcttttgtgttaaatgtttgtagactctgccgtgtagctatgcagtgcttgtttgggttttcttaagaagggaggcctccttatgttacccagagtggagtagagtgtattcacaggtgaatgctactgtgcccagcttgcaatgcttttttaaccagtcccctagtgacagacatttggattattttttcttttatctgtcattttctttcttcttttctttttgcttttacaaacagggttgcaacatataa

SEQ ID NO: 17904 - DNA, 13242 bp, Homo sapiens
aggaccatcccagtcagtgaggaccatcccagggagtgaggaccatcccaggcagtgaggaccatcccagggagtgacgaccatcccaggcagtgaggaccatctcaggcagggaggaccatcccaggcagggaggaccatctcaggcagggaggaccatcccagggagtgaggaccatcccaggcagtgaggaccatctcaggcagggaggaccatctcaggcagggaggatcatctcaggcagggaggatcatcccaggcagggaggatcatctcaggcagggaggaccatcccaggcagggaggatcatctcaggcagggaggaccatcccaggcagggaggaccatctcaggcagggaggactatctcaggcagggagggccgtcccaggcagggagggccgtcccaggcagtgaggaccatctcaggcagggaggaccatcccaggcagggaggaccatcccatggaagtaagggccatctcaggcaatgaggaccatcccagggtggtgaggataattctggggcagtgaggattattccagggcagtgaggaccatcctggaccagtgagtactatcccagggcagtgagaatcattcgagagcagtgaggagtatcccagggcagtgaggactatcccggagcagtgaggaccattctagagctgtgaggactatcccagggcagtgaggattatcctggggcagtagggactatcctatgacaatgaggaccatcccagtgctgtgaggaccatcctggggcagtaaggaccatctcagtcagtgaggatcatttcagtcagtgaggatcatcctgtggctgggaggaccaccctggggccgtgagactcataaaatacctgtgaagatcattgcaggaaaggaagaaaccattctgtgacaggtggaggggtccctgggataaagtggagcgatgggtcccaggagtggtgagggcagggcaggccttccaagcatcctggctgtgctcatgcaggcaggagatgtcacagcactgcttctcctcccccagaagtctagctcagaacttggcctccggcctgggcactgcctcatacctgccagaattgatctcaatggagctgcacaatgagaggttttgcatgttgtctagaggactttggttgagttcagagctgagcacacttgccttcagactctcctgggactcccaggtaactgattcaatgcttttgatactgggctcggggccgtaggtaagtgatgggagcacattgacaatggcccaggcttggaagttgggggttggaacacttaaatgggcagtctcggttgttgacaggtagttttggtcatgatctttgttgctggggataattgatgattagtcagggggtgagagccttggatactgaagcagcgagtttggaaaattggtgaagcacctcgcatactgaaatcgtggctgtaggtaatggctggtgtttctgggatactgatctgttgactgctgatagctggtgtagggtcttggatactgacctggtgattgtgaataattggcaaggggtcttggatactgaccaggcgattgctgctggctggtggaggctgttggatactgaccccgtgactgttcctggctggtggagggtcttggatactgacccgggaattgtaggtaattggcaccaccgtgcctggctaatttttttgtaattttagcacagatggggtttcaccatgttggtcaggcgggtctcgaactcttaacctcaggtgatccacctgcctcagcctcccaaagttctgggattacaggcataagccactgcgcctggcccttattattattttttaaggtatagaaatctagaatttttttttttttttctgagacaaagtctggctctatcacccaggctggagtgcagtggcatgagatctcggctcactgcaacctccgcctcccaggttcaagccatcctctcacctctgcctcccacgtagttgggactacaggggagtgctactattcctagctataattttgtattttttggtagaggtagagttttgccatgtttcccaggctggtctcgaacttgtaagctcaagcaatctgcccaccccagcctcccaaagagctgggattacaggcatgagccactgtgcccagccttagaatttttaggtagtttaatttcttcacctttgtctctgtgactttattaattgcttcttggcttcgggaggttctccctccagatttttgatgaacattcagttctgtttttttaaattctcattacttatttttaggttttgattgtgattttggagttggtatgcagggaacattgaattctgtgctccctgctgtcctaaggaagggacttgaattagtcaggagtttttgggtcacaagtgacacaaactctttttttttaaattttttttattttttacttttttaaatttgagatggagtttcactctttcacccaggctggagtgcagtggcgtgatcttggttcactgcaaccttcaccccccgggtttgagcgattctcctgcctcagcctccggagtagctgggattacaggcgcccgctgccatgcccggctaacttttatctttttagtagagacggagtttcaccatgttggccaggctggtctcaaactcctgacctcaggtgatccacctgcctcggcctcccaaagtgctgggattacaggtgtgagccatcgtgcccagccacaagtgacacaaactctaacttgaactagcttgagtgaactagttgtattagcttgagtgaactaacttgaactagctaggggatcctttatgggatcacctgagtgaaaaatggtaatggtaggaatgccttcaggcatgggtggatccaggggcccaagtgatagtatcagatattactgttttttggctatgggattggcttcattctcaaggctctgtgtagtggcaagtcagaatccagtaaggaaaataaatcattccagattcttcagaaggaagtaaatacagggaatttgttcgtgagtaacagaggagctgagaagccaataggaaatagtgaggcaaaccaggagttaggaactacaggatgctgctacttggccagaaggacaaagggaggaggtggtattactacagtccagaaactgcagccctctggaacgcataggttcatggttggattgctcagaagtggctagaatcagagaatagatacaactactacggaagacccaccacatgcagagatagagaggctaataaataccctggcttgccctctcctcccagaaccagtcttctgccagtgcctcccattagtcaaacacagtgataagatggtgagcaaaggaggctgggaaatgtggtccttgcagtgcagaacaggacagggcgggaaatggatctgagagcagacagacaaaaaactggcagagttgttagcaacttggcagagttggtaataactgccgagtccggtagaaaaaagttatcaacagttcttgcaagaatcctgtgtggcttggggcacatgagcaccccgagccaattatatggccagtggagtacagttggctgattggcttaagactggggctgagaatggggaatgggcaggaggtgaaatgcatggtggggaggtaagctgcaaatatccactcattctgaccaaatcacagagtgggctgctctctgggatgacgagagccagggacttcagtgtcagctcaatgctctttcgcttgtctgttttccttcttagttttactctccccatgaagctaggtccaaggcttaggcagcttcaggcttgtaatccttgaggagagactgcttttccttgacagcttcctaataaaaagtcttggggcagagcttgattggttgggctttggtcatgtgtccatctttgggccaattgcagggtctgcagctggggtactgtgattggctcagccagaatcacatgattacctctgtggcccagaggccagcatatgccaggagaatccctcatccagggttatgtgagttgggtggagggtgtccccaagagatgtcaggctgctgttctgggcagaccaaattcaccattcaaggtcttggtttctggcttggtgccttctccctgacctctgcttcttgactcttcaatgagcagaaagaactaagggaactggctgggcatggtggctcacacgtgtaatcccagcactttgagaggccaaggagggaggattgcttgagctcagtaatctgagaccagcctgggtaacagtgagaccccatctctatgaacaaaacaaaacaaaaacaaaaaaccaaggggtctgatatttcccccacttcccagagtgctgttgctcttctgtatatatgatgatcctttatctttcttgttgggtattagagatgtgcagtttgccagaaacaaagcagatgaggtcttggcctatttggctaaaacaattttgcactgttgaaaagtagacaaagtagaaaaagggctaaaaggaggagatgtagcatctcggaaacaggtaaacctctcttctgctggaagtctaagttggataaatatccactgtaaactggaactaagcttttgggcacattggttttagagtatttgacttgaaagtttttcttgtgtgcaaatctgtatgtgttttgtgggggctctcaggtgtgaacaagagatgacattaggatgtctgaggagattctcggcatgtgaatggggccactaggggaccttggggggtgactagcagagactagagcagaagtagggtgactttggagaggactggggtgaccgtggtgtcttggataactttgagggtgctgttgagggtgtctgggagtgaaactgaggatactaacatgagttgttatgagacaccttttaggagttcaagtagggtgaccaggggtgtctgtgggggtggttctagaaatgatcgaggctgggctcagtggctcacgcttgtaatcccagcactttgggaagccgatcacctgaggtcaggagtttgagaccagcctggccaacatggtgaaaccatgtctctactaaaaatacaaaaattaggctggcgtggcagcagctgcgtgtagtatcagctaatcgggaggctgaggcaggagaattgcttgagcccaaaggcagaggttggagtgagccgagatcacaccactgcactccagcctgggcaacagagcaagactccatcttaaaaaaaaaaaaaaaaaaagaagaagaaagaaagaaatgattgaggtgattctgtggggtaaccttgaggatgagtgggatgacctttggggggtcctctgtggggtgaccttggggggtgtgtgggattatgagagtgtctgagaattgagttttaggttaagtaggggtgatttgggacaactctaagggtgtgactgggggatgactttaggggtccctgggggtgaccttgtgagtgagattggagtttctttggggtttctaggaggtgactttggggaggtgagtaggggtgattttgaggatgtgccagactttggggttgtctgttgggctgcttgtgggtatcagcagagatgactttggagggtgaccaagaggggtatctggggttgactctggggcccctgtccccctctccccagttctcatccatatgagcaagggcttcatgttactggccgtggccctgtgctgagtcctcctcccgcccatggccctctcctcctggccagtggtcctccgcctgaacatggccgactttgtcttcagtttcctctgcctcggcattggtaggtgttggcttggggggcgggggccctccctaaccccagccctgctctctggctttctggaggtgtatctagacttccgtgctgctcccctcggggcctctgtcttagcatgtctctggggagctctgactcagttctactctatctgtgggatgtctctctcccccactctctgtttccctttctttttttgtcccctctctccaggtatctttctgtctgttgtgagggcgtgtgtgtgtgtgtgtgtgtgtgtgtgtgtgtgtgtctgcttgtcacggagggtgggagaggatgtctcagtccctcttttcttactgggggtcatagggctcactgtccagccttctgtctctggccccaccccattgcagggctcctgatttctcttcagcctgacgctcttttcagttaacggcaaggcggtgcacccaagtccggtggtgtcctacctggtgacctcctacctgtgctgggacgccagcgacttgatgctgcactccggtgagggcggggcctcgggaggagggcggggcctcgggaagcgggtggggcctagggtgggactcggagtacagcggcccacctagccatctcccaggagccgtgtcctacctaagcccagtgggcatgtgaagcagagggcagcccttgaatgcgcggcggctgagctaccgcgggtgggccgtgcagcagggcgcagcgaggcggacatccaaacagcggaactcagacgctgactccgagcgcaccccgggccttcccatttcatacacccwcgaggatgagacccaagcacctccaaggaatagcacccgaggtcttcaggacaccgaccggtagccatggccagatgcccggccaaccccttcagcgtggccacgccctggatattcgacctcccctgaggccccaccccctgatatcaggccacgccctccgaggggaccggtggcaaactccagccctcgctctagggcccgccctttgcggctttgtccctgcccactgggtcctcacagtgcctccaccccagaggcccagcatcccctcccgttctgcagacacttgtccagcgtcccgctgagctcggcagtgtggctagtttgtgtggccctgcccctggtgcccagccttcgcaggccacaccctgaagccactctccacccgctcagccagggtgctccgatgtccacccttgtcccggagttccggcctcagctccgatgtccacccttgtccccaggtggacacagcaccgcccagcatttggtgcaactccacccttctgcagaacgggcccctccctgggaaggcatggcttgcaataacatccctctgtaccttttctggcttccccgccacaataaaacctctcagcctcagaccttccattgccccccacctccccaccagggcagggtccatcctagtgtgagtgaactgttctggcgtccctgactcgccctttgggatctgagcctttccctgcctgtttgtctgcacctgtcacagccccttcctttccccacctgctggtgacctcagacttccaggcatgagattgacacagctggggtggccccagcctcagccgagtgggtccaggtgcaccacatctggaaagataggtgatggcagaacgtgacacacattggatgcacatttgattttactgggggtaggggacagggctgggcgttcaggagttctccgctatggtgtcctcgatccacttcacataagacagcactctgacggcgacagaaggcttattgggggtgccacaagggacgtagccccatgatgtgacaccttggagcacaccatcacacatcagcgggccccctgaatcaccctgggagcacaaggtgggaggggagagtgagaaaggtctacggggcccaagttctgcctggggagccccagctcgcagacagggcctccagtgcccactcccagaggaaggtgggcagggattcccacagaggggacagggtctccagtcctggccaagggggaagggacctcagggtccagctcctgcacatggggcagggtccaggtggacagtgcctgcagacaggttagggggaggaggggcaggaccatctgcaggacgctgcccctgcgggcacatcgcagaggccacctctccaggactactctctgactcgacggtaacaacacattaccacgaggaacggtgaactctggtgtggggggtgagatgcagttgtccctggatgggcgggggaaggagggggagctggggcactgatggggcgagtggctacagctagctgggaagcagtgaagcagatgcctggttagctctcagaagccagttcagaggctgagtcccctccctcagcccttccagaccctgggggcagggctgcctcaccacacaggtgtctttgccaccttccaggtgtccgacacacagcatgaagtctgtcaccttctggacgtgggcttttttgcactcatcattaggcaggattttgaggtccacacactggagatcatctggaaatgagactacgaacccgggagaaaaagggctgcagcccgacctcacctgcttccctggccctttctcccttggacgcaggagtccccatccccgccttgggctacacagtctgcccccacatacaattctctggttcgatgctgccccagccggaagccaaacaggtgctccccacttcgggttcctcggtgggcaactccacgaccttcacagcgtctgtgatggtatcagcaggctctgtcaggcggagcagcatgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggcgacccagccagagctggtaattgctggggaaagatgggaatggagggatgagaagacgggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagagtttgagagtgcaaaaggcaaatgaagagacagagcaaaaaagagctcaaaaggacagaggggtgagaaaggcggaggggagggcagtgagaaacagggtgagcaaaaaagaggcagatgagaaggataaaagacagggacagcgagaaacaggcccagggaagagggaggaagagggaacagaacacggaagggagcgagaagcagacaaatgaaaaaggacgcgggacgtcagagtgagaactagaaacagaggcagagaggaagcaggagtgaccgagtgtgggagagaaaagggagggaggccctgggggagggtgggggcaggtggggagggtgggggcaggtagggaggaggggaggcctgagagcggctcagctgcagctggggctgtggtgcgggctccccaggggcaggtggcctggcctgaagtccaaggtcgaggcccccttcccttcccagcaccctcccgcgcgtttctcgccccgcctcctccttcctcctccctcagttgccccacccagctcccgctgaaaccagcccttccctgtgtctctccagagtggagggatatcctgtggggcggggagctggacagagggagaggcgccccctcccaggcacacaagttggggataaagcccttcctttactctggggcctcccttaggtccatctgggtgtgtgtttagtagggatgagggagcggtgaggtagagacccagagagagagagatgggtagagagatggagggtgagacacagtgacagagatgccgcagagagactcagagacagacagagacaggggagatgcagagacaaggagacagaggagagagaggaagacagagaccagaacacagtcacacagagacacaagcagaaccagatcccaagagacccaggcagccttggagaggggtgtccagcccagctctgccctgccaggcgacctgcgccagagccttcctctctgcctcagccccccagtcttgcctgaggttatccaaggggaatgccactggcctgtcaatcctgtggcagcatagatgccctcctcccagaccccaggcccctactcactcgctgatgcaatgagcagctgtgagcacccactggcggtgcaccaggatgcccccacactggaaagtgctgaaatggtacagagccgcctgccagggctgggaatgctgctcacactcccagcctcccacaatccgggactgaatcgggggcgcagcacctgcagaggcggtgctgggtcaggaagggcagggttggcaggagaggccagggacaaggctaggagagggagctgggctgtgggtctgaagggacattgcgggtagaggaccagggctggaggttggggacatgggcaaggggtgttgggaaggggtgggactctggactgttccctgggcttttggagtggtggctggacctggtggggagattttgtgctctgacagtagagcagcctccagggatcagggtaggagacaggagacagtgtctggagcagacactgcatctgggcgtcaggtcatttggggtctggggctgggggatgggaggtggtgggttaggggagtggaaagggattctggaaaccagggatcaaggcgccaagggtgggacaggatcagaggctcactgaggaagaatctggagggctaaggggctcctaggctagggaaacaggacctgggttgggcttttgaggttcaggaaaggatgcagctttagggaaccaggtctgagaggtaaagaagagcatctggactgaagagtttgggggtgacttggggtccctacattggggttggaaggggccagcttggctgggacagttagatttcagggcttcctggttaaagggtaaaagaaagggctatggttaaggctagaggtgggcttccgagaggttttggggtccttcctgtgaaccaggaatggcaatctgaggggaggttggggccctgagaacacagttgcggtcaggactgggacggggctcaggaggagggaggcgtgagtggcagtccttctcggacagggtgaaggatgggatcttcgtttctcatggggatggggttcatggtctgagggtactggaaggatatggggtcctcttggaggcaatcctaggaagaggattggagaagtggtgagaacaggcgccaagcagctgtgggaatgcaatgcaggacccacttgatgtgaggttgtagaatcacatactgacttgggggaggccagggcagaagcgctggctgagaaggcattcaggatccttggcgtggggttccagaaaaccagagctgtgtaggaacaattcaggcagagaagggctggggcctggggcgggatggaacttccccaaggaaaggagcatgtggtgggagggtgtggtgtttttcctgggagagctgggggtgctgggtgggaagggacatttgcagacccccccccataccagatgggggatcccacatgccagtttgggaagcagggttttctggtgaaatttgggggaccctggaaggactggggagaccagatgtcagggtctggaggacacagttgagagcggacagctggatggaaaaagtcactggagtgtggtgggatttgtagactcaggagccaaataggtggccgcagggaactagggggcaggaggggatgatcagagtcctgtggggtgggggaagcccatgggagggttggggtcctccagagagagacagagatggcccagaatctgcccctttggtaaagcggtgggacagggcgttggctagggaagaggagaaagtactgaggcttcctgggaggagcaggaatctggtgtgggagtgagcactatgacaacatggaggagcgggggtggaagtttagggtggggccgcgcaagatagataagagccggggcaccccggactaggatagactgtgggccagagggatgagggtggggtgttggaggggaaggtcttatcggggggggatgtgaggccagcaagagaatcagggcccgttccccctcccacatccccccactgtctcaccagtcccccccagggacagggcgaggcacagaaccaggaaccacatggtgacagaggtgtccaggggccagcaggtggaggaactggggaacctccctggggaggcttttaaaagcccttatcccctcagagccccacccctgccctgctggcacccagatgttggccaaggcccttcccctgttgcctgggggctggacaattgcccccccccctccgatccccagagctgtagacggggagggagaaccagcacctgttctgcaggccctggatcacgctggacgcattcctggggttgaagccaggtggggcagggcctgtggctctggggctttgctctggggagcagccagtgaggcaaggggggactgaggggaagcagaaacaggaagacggaggaatcagtgacccctggtacaaagccccatatacctcagtctcaattaaggccctgcacccccagacctggtgccctcaaacaccagcagttagggctctgattccctgcaccactcggagccaagatactagcatctcagctgccagttccccctgaaatataagccttggccttcagaatgccctggttcttgcactcccagacccaggacctaggtccccaaagctactgttcctttcataataaaattttggggtacacatcaccacattcctagtgcctccagatccaggaatgtgaagtttcaggggtctcccagggtaagttctttagcattacaaaatccagtgtccctcccaaacaatgctggggtctcaatgagcctcccacttcttgctcccagttatgggtgctcaacgtcctgtcctccaaagtcccagagatctggacaaccttccctcccaggtcaagatcaggctaaccacagattccaatgacccttcccccccaccaccagtacaatatttaggtctcacgagccaggttcatgtacttcaacattcagcgaccttgaacatcacattttgtggtctctgaagataattaggaactagattcctgcagcctcaatggtaaacccataggcttccaacaggttgtcttggctttttggtaaaatcaaagcagctcagagttccagcctctgctgtatatcagggacctggctaaggaaaggacagtatttgcctttttgccatggctaccaggaagccca

SEQ ID NO: 17905 - DNA, 49979 bp, Homo sapiens
  misc_feature (1)...(49979): n = A,T,C or G, or insertion/deletion polymorphism (see Tables 1-2)
taaggaaaaagaaaacagggaaaaataaaacctcatcaatatcttccaacagttaacaggagataccacattcatgaaacaaaaaataggttataaaataggaatagagggaacaagaaaaagctcttagaaatgagaaaaaccttggtagaagggctggaagacaaacttgagaataacttccagaaagaaaatgaaaaaccaaagggtacaaaacatcaattagacaggaggaatgtggttttcttttatgagatatattgtacagcacggtgaatatagtaaataataatgtcgatttcaaaagtgctgacagtaatctcatatgctttcaccacaaaaaacttaaagtatttgaagtgatgaattatgttaacttgattttattatttattgtatccataaatcgtaacatcactttgtaccccctaaatatgtacaagtataatttgtcaatttacaatttaaaagataaaaacaaaaacaaaaattttagaggggggaaaaagaaaccttaagaaaattatgagtgccaatccagaaagtccaagagtagaattctagagagagagagagaaagcaaataggaagaaatcaaagcaataaatcaaaaaaatgcccagcgttgaagaacatgagttgcaaataaacaggaccaaagagtaggcaagacgatggatgaaaacagtctccaagggacatcactgttctgggagttctgaatttcacagaaagaaaagcctctgaggccagatgcaaagccttcactcccagcacttcgggagtctgaggcaggagaatcacttgaggccaggagttcaagatcagcctgggcaacatagagagctcatgtctacaaaaagtttttaaaattatccaggtgtggcggtgcatgcctgtagtcccaggtacttgggaggccgaggcaggagcatcactcaagcccaggagattgcagctgcagtgagctatgacagcgccaccgcactacagcctgagcaacagagcaagacgctgtgtctcaaaaaaaaacaaaagaaagaaagaagaaaaaaaagaaacaaaaaccttcaggtttcatggaggaaaacatagtcacacacaaaggctctaaaaatgttacgtatcaataaaagagaatcagaacggcttaagacttcaacaacactggaaacttagagaccgcggagcaaaatgatgtccaaattcctactcaggataagagcagaacgaggcactttcgtacatacaaattctgaaaacttcatctgccatgcacttctcaggcaactagtgaaggatgtgctccatcgaagtgagacagtcaaatcaagagaatgacataggttccagaaaagtgaggctccaacacaagagggagtgaggagagttacaggaagatttcaggcacagacaagcctgcagcagattggaggcgctgggagagatttattcaagataaaatgataggaatactaattttcttcaaaagaaaacggacaatttcttgaaagatttagataattgcttcagaatttggggttgaattgtagtgacaaaatatagaaaactgagcaagcagcaagcaaacaaaaacaaataagacttgtaataacccaggaaaacaaaaagttatccagaaaagtgaaaacaatcctattataccacttcgtccagctgtaaatggcaatatgtagtcataatataaacaatcaatactgaactaaccaaattaaggatatatcactttgggcagccatggatccgtttgcactgagaaggcagagggtgaaagaaagctaggaacttcctacctattctcagtgtcaagcgaagagacatcacatgaaacaggggtaggggacacaaatacagacgtcaagcaaatatgctctttagagttggaggcaaagatcaaggaaatctactaaggctgaagtagatactctgcaggggaggaaacatgattaggggaaggatgttggcacttctttcttacaagcctttctaggattatctgactctacaaatgacatgaagctgtaaccttgatttgaaataagattaatatgaatgctaataaaaagtagtaagggagagtatgtagtcaatgtattcttaccaaattaacaacaagtatcaacaagatgactaacacaaccacatgatgtccagacacgtctcagaacaaatgtctagctcatcttcaacggtattcgaggaacttcagtgtgcttggtaaaacaatagcctactagggatttcacttctaaaatgtctctgactttagaaataccaaaaaataacatgtaaccaagttttaaaatattatacacatgaaaaaaggttcttttcattattttcttggtttccagatgttgaacgttgtggtgcttttacaattgaagagaaaaagcattctgacacattatactggttggggttctctgcttttctacttggtcaaaaacctttacacgcattttggactttgtgtcatcataacttggcaattgggaaagccgcatgatatgcttctttcagaacttggttacttcttaccaaaagagggaaaagctttcgtatcaccatttgcctatgggatggatgcacaatgaacgggccataccaaataaaaatatcactttgtactccaaaaagcatgttctctgcttaagccctttctgtaagtttcagctgggacgcactaatggagaatccatatgacccacgaaggatcgtaagatatcccagtggacccggcacaatcatctcaaattctgttcaggtcagagtatcttagataaaactcactgaagggcatcaagtccttcagtacacagtctgagccaagccctctaccatttgccatggcaagagtataccaaattctaaacctgttgctcacgtatgccaccaactataaatgtcagcctcctctttcctagtcttcctgtccactcagcaccacctggaaaaactcttactcgtcttttaaaccgcagttcaaggaccacattctgtaggaagactttccaacaggtaaccacagcctatttcctatgtccacaccttacacatatttctatcattgcacttatcacaccataatgtaattactcttctacaaataagtctctcacactagaccacaagctgcctgaggaaaagaaaagtctatatcctctttttttgttggctttttgagacacagtctcactctgtcgcccaggctagagtgcagtgctacaatctcggctcactgcaacctccgcctcctgggttcaagcgattctcatgcctcagcctcttgagcagctgggattacaggcgcgcgccaccatgccaggctaatttttgtatttttagtagagacagggtttcaccatgttggtcaggctggtctcgaactcctgacctcaagtgtccacccgcctcgacctcccaaagtgctgggattacaagcgtgagccactgcacctggtcgaaaagactatatcctctcaacctttgtatctgcagaacccttaaccctacacagcaatttccagcaaatatttttttgaattgaaatgaagaagtgaggtcatgaggctgaagtcagacaactggaaggccaaaacaacaaaacctggaaaaatacgtatttactcaagaagaaattctcccaccaggccactgagaagttagctttgcccactggagaggacactgtaacagggattcaagtaagcctagtggcgctgagggacgtgatataggtcaactatatctttgaggtgctctccttacactcaatgcacttttacccgaatgacgttaatttgactcctgataagatgagctaagtcccttcaacagtgcttggcaccaagcaaaactaatagcagtaacaggaaagtttaatcctcatgatgaattatttaatggggtttcaaacgctgtccctgagacttgaggcagtaggctccagctccattttccccaagtctaaaacttgataggttgatgtttcagactcagagattcggtaatccaaatgatggaaataattcttacccaaacaccttttcaactatttttaaatactgttgccaagcatcctaatatcatgtgtacttaatgaatttagcctagggatacttttacatgtcaaaaaatcaaaatataaacctaagcactacgtttcatccagtgtttcagcatcccagatttgcttccctaaatgaacattaagcttattatgcaatgtgccgctaccaggagccttagacaaaaccctaattgtgacttaacctatcttaatagggttttaaggaagttagctgctaagaaagtgactatccttaagcagacaccaaataaatgtgaagtcattgattgagggcttagggtataggtagctatgaatctgaggacataaaacgcaaaactgaggggcaaatcgtcatgttccttaagattacgactcatccacattccttcagacgtttaatttcaccataataggcactgtttaataagcaaagcccaagtcgacttccttcgattttacatggcgtccaaacaccatgtcaagtctgaccctctcattttttaagtcgaatggagaggatatgtagcagctagccttgagcacctaaccacttttcaaaggagctacgcacaaaaataccctagcaacatgccacggtgtcagaaaggctcaggttcccaacaccatgcgggtcagccattaggaactcaggaagtgtttcctctaagcgggggaaacctaggaaggcttcctgaacgaggggtatttgcgccaagccttgacgtgagtctcgaacagttgcagtgcctccaggccacgcgggagggaggaaaggacaccccgggccggggcacaacccgcgggccggagccgcccgcgcccatcccgctcaggccgcagccaggcacggcaccctcccgtccccgagccacgtcgctgctcgtgggctcgcggagcactccccaggtctcacctcgggccccacaccagaaggagaaagctaggggccgcgccagctccgccctcccccgcggggcggcgggccccagcccgggcacaggaaggccacgtccccggggagggacgcccgactcgatggtctgcgcagggcccgtcggccccacgtgacgtgcgcgcagccaatcccagagaggccccccgatcatcgagacggcggcggtggtgggctagacgagtttcgcgcgggcgctcgccgtcccccgcccagtcgtactcggcgccccagctcggggctggcgccatcttcttggaagacaggaagagaagccaagggctccctccccgggaatggtccggaatcccgcaacaattgcccttccgggacggctttttctttttaagggggacttggttccttttaacaaagggctttcccccattcggttaccaccgaaggcaaagaatctcttgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggtaaaaggagaagaggctacgcttgacctccccccccacccccagcctctatatggccaactgccgtgggaggagcacggcgcttgcgcagaggcggacaacgcggacgactctgggcttgcgcactcggaagccggccgcatgggggaggggaagaaggccaggtcgcactgagccaggaagcagttggcaaaggggcggggtgacgcggtgacgcaatccgcctgcgcgctgggcggggcggggcgggctggggcgggctgtgagcggaccgcgagcgctgggcgggtccgcggcgcggtcggtcggcgcctattctcgggctgtttggcgggtgagtgtctcgccggtgtaccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaaggtctgcaccagcgaggcacggacaggcagcagggggtagggtatagggttggrggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccacggaaacacacgaaccaactacactgaacttcttgtagttcaaacttctgcacctttggccattgcccaaactcttaaatctggctacttcccaccttaactgccttctccttacctagtctgtgcttgtgggattccgcccaaattagatttcctccagacaggcttaggtgtttacctgatgttccagatggtatttgtccagtggactattggtgctgtgagggcagggcacatgttgtcacccatactcattgcctcggttggtgtctagcacctagtaggttctcaaatactttttgaatcacagtgcctgccgatatatttaatgtttcaaaatagttctgccgtcataaagaaaaacatcatggtgtaggggtcatgaaagctgattcttgatacttctgatttgagcctcattgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtatttttttttttttttttgtctggaggaatggggacaccaaaactcatttggcagcagaggtgaggtaaggccatttgtattgtctgttctgttagtagtcatacatgccacttatccctgccccagtccctgttaggagtgttatgtgggtatactgaacgtggaccttccccgaatccaaagaatccagatgctttgaataagatcatggaccttccgggttctacatcgccagatgttgttcatcttctatcttttgttttgcgaaaattggttttttatgtgtattggggttattctgtggaagaaataagctgtgggtcaagattaaagaactttaaacaacttctggcatgtggaataaacacgatctgaaggaacaaaattttcatttgactacatttttggtccaatttgcacccagtgtttaagttaatcacagtgcttggcagtttgtgttgctggatcaaggctttctcactgaaaaccatgtgcttcagaggttcataattcctctttcaccttccatttcacattagttaataaattatgagagaaaacattgtggatccaagttatgtttcagaaaaaaaaaaacaggaaaaaaaaaagatggcaggagaaacttggtaaagtcaaagcaaagttgaaatgtcagtttaagacaaatagtttctccattttcccatatgtgtgcacagggttcagtgaggctgaggggttctgtggaggtgcgggagaggtgctctatggtatttctatgttgcactgtgtgggtttgaaatcagatacatgtaataggtgataaggtaagtgcctgctcttttctatcctcagcattggcatttaatctttccatgtgaacttaaagctcattttatccaatcctttaagaaaaaagccacaccrttagggattccagttagaaatggactaaataacatactcatttggggaaaataaaaatgatttgatttatgtaggacctgttttctagtttggtccctacttgtttggatttttaaaaattctgttgtaaatgatgtgcccccatttctattccttgatatttgttgctggtacttgacttacttgagatcttatatttagctaccttactaaattatcgtattctagaatttttttaaccagagtatttgtattttctttttttttttttttttgagacaaagtcttgctctgttgccaggctggagtgcagtggtgcgatctcagctcactgcaccctccacctcccgggttcaagtgattctgcctcagcctcctgggtagctgggattacaggcaggcgccaccacacctggctaatttttgtatttttggtagagacggggtttcaccatgttggccaggatggtctcaatcttttgacctcgtgatatgcccgtcttggcctcccaaaatgctgggattacaggcatgagctaccgcacccagccgagtatttgtattttctgtgtattcagtccaatcagcaaaaaagtgttttcttttgattttcttgtttcattatattcagtaaactcaccaaggtagtattaaataatcatggtgaaattgcaatatctggatcttacttggatcttgattcacatgaaaaaaatgagagaatagagaatatgaatactgattggatatttgattgcattaaagaactagctatgtgtaaggtttgtcattttaggaagcccttatttttagatatgtgtagtggaatataaatgaaatgttacatctcgtatctgcttcataatcatccaggcagtggcattgatgattgtggaaatagatgaaacattattgaccttcagttgctaattgttgaagctggataatggatagcacatgggggttttgtttgctttttgtataggtcttcatgtaaaagttttcatgtaagtgcttaaaaataattatggaagggcattcctgccgaattatcggttgtaatttaaatagatttaattttctattgtttagaaaacagtatttgcctttggttttcagaaatatcctgaattagatttaagcagttttcctttttttctttttttgagacagtctcactctgtcacccaggctggagtgcagcagcaccatctcggctcactacagccttcacctcctgggctcaagggatcctcccacctcagtctcccacttagctgggattacgggtgcccgccaccacacccagctaatttttttgtattttttgtagagacagtgtttcaccatgttgtccagactggtcttgaactcctgagctcaagcgctcctcctgcctcagcttcccaaagtgctggtattacaggcgtgagccaccacactctgccagcagttttcttactgttttcattatgattggttgctgaatttcatatgcctcatcagcatctattaatgcatgattttttttcccctatactgtgttgttggattaatattggtagatgcttttgatacattcctggaatctaattgctagcaaatattgtattcaggatttttgcatttatatttgtgagtgagattggcctatggcgttcattcattcctttgttcctttcttatgtctccatctgggtttgttattaaaactgtgctgtcttcataaaacaaattgttttcccttttctctatagaggcttggaatagttaaatgactttggtcttgtccaaggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaaaactccatctcaaaaaacaaaaagaaaaccagcttttggatttgtttacccttctttttccccccctcataattcattttttctctttattgatttcctgttttatctcctaagttttgcttttatcttccttccattgctttctagagattgcttatggctttgcttttgttaccctccttgatcctggggatatccagtaatgtaacaaattactgggagttacttttcatctttttccacccaatttaagcagataattatttgagaacattgactgtaaaaatgtttttcaaattttgtttaggcttttttttatggtagatacatgacttcaaacattttttaaggtattgattcaaatttctctatgtctgctaaatcagatgtatttgttgtattactcagttcttctctgtccttgcacatactgtgtttactgaatctgtccggttctcagagaactctrttaaagtttctcacttgaatttttttttttaagtttgtatttttcctagtccttgctttatgtgtttatctacagtgattatttgaatatacaggcttatgaatattacatcttccctataaattgtttcttttatcattatagcttgttatccctgttattctgcttatttttactttaattcccaccttggctgatagtagtgttgtctctcctccatgtttgcactagcctgctattttttaccttgtccctttattttcagcctctctttgttccttttgctttaagcatatacgttatagctggacggtttgttgtttttgttttttttttcccttggtttttcaggccaatctgtcttctcctttaagcagagaatttggttatttcacatttatactgataactgatattcttgaattttgtccccattgtcttgatttaggattacttctgattttgtttcttcttgttccttttccatatttttgctggtttgatgaagttgctgtttcctccatatttttctcttaatttggaagttctcattgttattttctttaatgattacctttttttttactttcataatcagatacttatctctgtattatttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataactggggacctttccgtttcaaagggaaacagaggccccagtttccaggaagtaaattttgggggaggggattcgagaggcaaagtaaaagaagctttttattaggttttaagctccaaaaggaacccaatttggcagcagtctctcttttggggttgttactaaggttagccaccagactccatgctttccaaagcttcagggtttctaaaatttgtttaaaaattccacatatctctggctgggcacagtggctcacacctgtaatcccagcaccttgggaggctgaggcgggcgggtcatgaggtcaggagatcgagaccatcctggctaacacagtgaaaccccatctctactaaaaattwaaaaaaaattagccrggcatggtggcgggcgcctgtagtcccagctactcgggaggctgaggcaggagaagggcgtgaacccaggaggtggaggttgcagtgagctgagatcacccactgtacttcagcccgggagacaatgcgagactccgtctcaaaaaaaaaaaaagaaaagagaaaaaaaaattccacatatctttaaaaatattgtcacatttttcagacactcagatgccttcagtactatttcctttcctcataaatgtagttcacattgctctctgtaccccagtgtcaaaatctagttctcaggtagctctaggaaactccagtgggtggcaaacatgttcaagttacagtgctctatgtaatgaagtcccttactccttgaaaggtttcaaagagagaggggaaatgacataattccagaggtcagggaagtatgtatccgtgtgtatcccatttgtgtccctagtgtctaacatatagtcagtactgaaaaaaaatttgaatattattgaaaatatggaatatgtgcgtacatatatatatacagttgcttttatcaacttaaaaatttttttaattttttaattttttgtagagatagggttttgctatgttgcccagattggtgttgaatttttggcttcaagcagtcctgcctctgcttcccaaactgctgggattacaggcgtcagccactgcacccagccaccatctaattttttttttttttttaatggagtctcactctgttgcccaggttggagtgcagtggcatgatctcggctcactgcaacctccgcctcccaggttcaagcgattctcctgtctcagccttctgagtagctgggatcacaggcacgcaccaccacgcctggctgaatcagtatttttagtagagacggggtttcaccatgttggccaggctggtcttgaactcctgacctcaagcgccaccatgcctggctgaatcagtatttttagtagagatggggtttcaccatgttggccaggctggtcttgaactcctgacctcaagtggtctgcctacctcggcctcccaaagtgctggaattacaggcgtgagcatcacgtctggcctaatttttttaatcraatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcrgaactaaggctcatttaaagatacaaatttgattggctactattgattrcacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacaygagccagctgtcagtgcytaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtcctttggcccccttagttcattcccagcagaccagataatttagaattctgataatttattatgatgaamttgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgacyttctggaagtgtttatactttttaaaaaatttgtgaaaamtgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagctgtcatgtcaagagaacactcaagcagccttacagggaagcccaccaagtaaggaaccaaggcctgccaatggctgtgtaagtgacccgtttcagaaatatcctccaggccaggcatggcggctcacacctgtaattttagcactttgggaggccgaggcaggcaggagtttaaaatcaggctgggcaacatggtgaaaccctgtctttacagaaaatatgaaaactagccaggcatggtggcatgtacctgtagttcctttcccctgagtccaggaggttgaggctgcagtaagctgagatcatgccactgcactcaagcctcaaaaaactgggtgaatgaaaccttgtctcaaaaaaaaaaaaaaaaaaaaaaaaaatccaggcatttacagtgtaacattcacaatgtctaatgtctaatagaaaattgtgtggcatcaaagaaacaaaaactgtacataatcaggagaaaaagcaggcaatagaaacagatccagaaatgatagaaatggatctcgatggcaaagaagaactctattacttaaaggaaagcatgaatataataagataaaggaaagatacaacagaaaaccaagtggaacttctaaagattaagatacaaccgaaataagaaattttcatgataagcctgacagcacattatacactgcaggagaaaaagcacagtagaagcacagtaagggaaaagctggaaaaaaaaaagaaattgaatgtgccctcagtgtcctttggtacattgtgaacagtctaatatatggattatattcacagagaagacaggaaagcaaaaaaaaaaaacatgaaaaaataatgcctgggaattgtscaattttcagcaaagttgtaaatgcacagatccaagaagcttgacaaataccaggcaaaataaatataaagaaaactacaccaggacgcatcataacacgctaccagaaactactgatgagacaacaagcagaagaaataatagagaaaagcacaccaaagcctgtaataagcaaatagaccatagataaacagaaaggtctttaaaagtagccagatcaggcctggtgtggtggctcatgcctgtaatcctagcactttgggaggccaacatgggtggatcacttcagcccaggagttcaagaccagttcaagagcaacatggtgaaaccctgtctgtacaaaagatataaaaattagccagccttggtgggggatgccggtagtcacagctacttgagaggctgaggcaggaggatcacctcagcctgagacgtcaggcctatggtgagctgtcatcgtgccactgcgctccagtctgggtgacagagtgagaccttgtctcaagaaaagaaaaaagtagccagaacaaagaaatttattacatacaggggattgaagataagaggagtgaccactgaattgtcattaggaataacataactggtcgggcgtgatggctcatgcctgtaatcccagcactctgggaggccaragcgggtggatcatttgaggtcaggagtttgagaccagcctggccaacatggcaaaaccccatctctactaaaaatacaaaaacctgggcgtggtggtgcatgcctgtgacccagctacttgggaggctgaggccaggagtatcacttgaaccagggaggcagaggttgcagtgagccaagattgcgccacagcactttagtctggcgacagagcaagactccgtctcaaaaaataaaattaagtagaaattggctgggtgtggtggctcatgcctgtaatcacagcatcttgggaggctgaggtgggcagatcacctgaggttgggagttcaagaccagcctgaccaacatggagaaatcctgcctttactaaaaaaaaaaatactaaattagctgggcgtgttggcacatgcctgtaatcccagctactcgggaggctgaggccggagaatcacttgaacctaggaggtggaggttgcagtgagccgagatcccatcattgcactccagccggggcaacaagagagaaactccatctcaaaacacggtggctcacgcctgtaatcccagcacttgaggaggctaggcgggtggatcacctgaggtggcaagttcgagaccagcctgaccaacatggagaaaccccatctctagtaaaaatacaaaattagccgggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgtaaatcttttgttgttgttgttgttttgtttgtgtgttttgtttttgagatggtttgagatggagcctcgctctgttgcccaggctggagtgcagtggcacgatcttggctcactgcaagctccacctcccgggttcacgccattctcccacctcagcctccaagtagctaagattacaggcacccgccaccacacctggctaattttgtttctgtatttttagtagagacggkgtttcaccgtgttagccatgatggtctcgatctcctgacttcgtgatccgcccgcctcggcctctcaaagcgctaggattaatataaatcttacacagacatcttcatgaaatagatgagtaggaaacacctaccagcctattttattaagccagcattatcctattacaaatgacaagaaaactacagactaatatatgttagaaatgcttgtttttcggtgccataaagaaatagtacttgaacataaattcagtttcctcagcaaggccatttttactttctacagaaagggtacactcgccagcagttttgtcaagagggtacaccgaacaaagaggatcatttgtaacctgggtcatttataacctgatgcgtctaccttactgctgtgtctggtttccactggctggaacggtacctcacattctgtatttgtcctgattggctagcaacttagaacttcttaaaagaggcaaaggcagaggagaacaaaggaaggaggaatgttgagaaaggtaaaatcaccttcaaataaggaagagcaacaggctatgacctaatgcttgcttggaccagcataagcatgccagggcaaatatttaggctgaattgtgcgagctaagaacataaagtactttgatttcctcattacggccagcagatatttaagaatgttagcacaggtctttgaataaattatgcttctaagagaagttagtattattcctaattagacggggagtaaagcctttaaagaggagcctctactttttacatatacacgagctagacatggacatcttaattaaatcttaccgagtccagcaatatatctaaataaaaagtcaatgcactgagtcctgctatgatgcaacccgtgtgtttctaaaaaaatcaccatgccatacagcatgatgaataaacaccacagggcttgtgcagaaaacagggacacaatactcagaaccttcatcagcgacacaatgggaaaaaagataggaacgtaagaattataccagtccacatgtaaatggttaaaaaataatgactgcaccatagaagccctgaggttggtttgtgcaagtggacatcaggagggttgcagcttgtgtgcttttgtgtagctgtggagggagggttttctaaagttggaaagtcataacactacgtgtaaatgggtgtggctcataacaggcagtgaagaaagatagctgatagatatttaggggtgtgtgttgggaatatccccaagtggtttgattctgttggatgcagaattaaacactgtcttctgtattctcctagtttctcaccaatgagatcatatataataagcaaatacgaaatttgtattactctgctattgttccgtaatgtatcaatcccattggaacaaattctcattttcaaattaggactgactaaacaaatggagtttatcttaggaatacatgatgcaacattcaaagtcattgtcatgcagtgtagttatcaaggaggaagatgatgttagctgaaaaacgaatttgtaaaaatccaggacccactaaagataagaaattaggctgagtgcagtggctaacacctgtaatcccagcactttgggagcccgaggctggcagatcacctgaggtcaggagtttaagaccagcccccccaacatggtaaaacttcatctctttagtacttttgtaaagtactgaaattagccggccgtgatggtgggtgcctgtaatttcagctatgctggaggctgaggcgggagaatcgcttgaatctgggagggggaggtttcagtgagccgaggtcatgccactgcactccagcctgcatgacagagcgagactccgtctcaaaaaaaacaaaagaaaaaaatcacaaacaagagtattaataattttaagacagtaccacttaacagtcacaaaaaatattgttcagagataaatttaacaaaacgtgcaagacctatacactgaaaactacaaaacagtgctgagagaaattaaaatctaaagttgttaagatctgccccatttgtggattggaactattatgccctttctcccccaaattgtcccatattttttctgagacagtcttgctctgtcatccaggctagagtgcaatggtatgattttggcaacctccacctcccaggtttaagtgattctcgtttctcagcctccccaagtagctgggactacaggcatgcgccaccacgcccatctaatttttgtatttttagtagaaatggcattttgtcatattggccaggctggtgttaaactcctagcctgaagtgatccacccttctcagcctcccaaagtacaaggattactactggcatgagccacagcgtccagctccaactttcagaaataaaaattaacaagctgattcggaagtttaaatgtaaatgtagagggcctagaacagacaaaaacagtttagaaaaagagcagagttggaggattacagtccctgatttcaagacttaacagcagtaatcaagacagtgtggtaagggtagatacacagatctactaaacagagcaacagccaagaagtagacccatcaatataataagttcaattgtttttttggtttcgttttttgagaaaaaagccaagttgattcagtgggggcaagtttagtctttttacagtctgtaacaactagatgattatgtgtgaaaaaatgaacttcaactcctgcttcacactgtatatcacaacctgaaattatagtagatttaaatgtaaagctataaaaactacaagaaaatgggcaaaaaaatttttatgactttgtagtaagcagatttcttaagacatgaagaatagaaattataaaaacaattgtgcattattaaaagtttgccttcttgaaaagacatcaataggaaaataaaacgtgaggaactcagaaagtattcatagtaccatatctgacaaaggatatgtgtccagaatatataaaaatattgcacagatcagtaagacgaatgacccacttacaaagagggggcaaaagatctgaatagacatttcactaaggaagataaacaaatagccaataaacccacataaaggtgtccacatctttggtggtcaggggaatacgcattgaaaccatgagatgccactacccagccactaagaggcaggcactccaggtgtcagcaaggatgtgaaacaactggaactcttactagtgagcatgtaaaaatgccacaaccagtatggaagccagtttggtacttccttaacagttaagacccagcaatactgcttgtatgtgtttacccacaagaaatgaaaacatgtccataaagatttgtatatgaatattcatagctacttttctcaaaatagccccaaactggggacagcagaggtatctagagagtggattaacaaattgtggtgtagccatacaatggaatattgccaagcactacaaagaaacgaactactcgtagatgcaacaacatgcatcagtctcagagctttgttgagcaaaagcagccagacacaaaacaggccatgttgtatgatgccatttaaaagttttagaataagcaaagctgatacatagtgacaaagtagattggtgtttgcctgcggtggggactggagagggtagacttcacagttacacaaagcaactctagggttatgaaaataatctttatcttgagtggagtttgattatctgagtatctacttttgtcaaaactgtacagtttaaatgggtgtattttagtatttgtaaatcgtgcctcaaagtggctttaaaataaaacaggtagggggttgagggtgagtagtgaaaagtaaaactagaaagccacaagaatcctcaacttttaaattgtagtattaatagctcaagaaaaatgggtgtatcaggaaaaccctaacacacctaattagtaaatgagagactattgaagaggaaaggcagtttttaaaattttgtcagacttctaaagaaacaggtaaaggggcattgcaccaccgtttattaaaaggatgacttaatgggataacaggcatttagtcaaatttttacactcatatttaggcatgttcaacacattgttttgttcttttcatgtgtgaaaattgcagttcacttaaaatgcagtcctaattttgtatgtctgcatgtttctttttgttttgttttgttttttgagatggagtctcgctcagtcgcccacgctggagtgcagtggtgcgatctcggctcactgcaagctccgcctcccgggttcacgccattctcctgcctcccgagtagctgggactacaggcgcccgccaccacgcccggctaattttttgtatttttagtagagacggggtttcaccatgttagccaggatggtcttgaactcctgacctcatgatccgcctgcctcggcctcccaaagtgctgggattacaggcgtgggccaccgcgcccggctgtgcgtctgcacattgcaaattcacttatttgttcttgattttcccagaattgttttattctgtaagggacagggtctcactctgtcacctaggctgaagtgcagtggcatgatcatagcctgctgtaatctctaactcctgggctcaagcaatccttctgccctagcctcccaagtagctgggactctaggtacaagccacaacacctggctaaggttttggggttttttttactttgttttggttttttgggagatgggggtctcactattttgcccaggcggggtcttgaattcttagcctcaagtgatcctccagccttggtctgctaaagtgctgggattataggtgtgagccactatgcccagccagaaataatttttcaaaagagatgtgtactccttcctcatgctttgcagaacttaacagagggtggtttagggtacccagaggacagtccagcaccagtagtaccaagatcagaagcagttctccatgcagaattgagacctagatgatcatctgcaatgaagcagtgggatttgtgcttcccttcaaatgtaaaatttaatttttggtattttnnnnnnnnnnnnnnnnnnnnnnnnnnnnctgaaattagtcgtgtgaactcaacaaagtgagcgggaaagttgcccgacatatgacagttgccagtgctgggaaacggggatggatttaaagcaggaagaagacaaggtggcagaagggggaggttgcagagtgagggtgtgcatgtgagcccaccagaccacaggccctgtcctgctcacacgtttctgcagctcgggaagcacaagggttgttgacactatgggatagatatgttcagttttctgaaaatgtggtgagtttagtgactagcagaactgataattgaaaacctgctttgcattctatttgtcaaaaataaaaaccaacctctaaagtacattcctcacatttgtgaacagttatgtttctaattatatgatgttcaagttctgtagtctcatagacctggattcaaatcttggccctgctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattsaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttasttaatatacttcataaatttatagatartgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacctgtaccgtgcaaagaatgccacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgcgatggctcatgcctgtaatcccagcactttgggaggctgaggtgggctgatcacaaggtcaggagttcgagaccagcctggccaacatggtgaaaccctgtctctactaaaaatacaaaaattagccgggcgtggtggcgtgtgcctataatcccagctacttgggaggctgaggcaggagaatcgcttgaaccctggaagcagaggttgcagtgagccgagatcacgccactgcactccagcctgggcaacagtgcaagactcagtctcaaaaaaaaaaagaacgaattggcagccctgtctacactggccctctctcaggtgcatcataacctattccattcaggcttttgactctcagcacttaggggcagttatgcttggcatagtttccaaaaacttccatttgccaaatctaaaagtcagtcttctgttctcatcttgaaaatgaattattaaattatgtatatttgggcggaggcacttgttttccctttgaagtcagggaccccctgttttataccctatgattattgttaatgtttctgtttctctcagttttaagacaattatctcctatattgatgagcaatttgagaggtacctgcatgacgagagcggcttgaacaggcggcacatcattgataatagggtgcattgttgcttttactttatttcaccttttggacatgggtaagtaattgtttatcgtggagaaatgctttactacatgggtttgtaagttttacccaaactgtgtattttaatataagaattaagataatttgagrgagaagagttttgtatgtattttttttaaataagtgacaattctaaaattaattttagacttaagcccttagatgtggcrtttatgaaggcaatacacaacaaggtgaatattgtgcctgtcattgcaaaagctgacactctcaccctgaaggaacgggagcggctgaagaaaagggtgagtgaggctggcgtcctgccctccctctgggtgcgactcgggggcatggggatgaagaaaggagtgtgttcccacgctcagtctgctcaggtgtcgggaggcagggcgggagaatttttcctgcattttagtggtggttttcaaggagaacctgatggttacaaattttaatttttgccttcatgaaggtatcaaatttctattctttaaattctccttatatttaaaatgccctcgatgagtagcagttggttacacacaagtaccttccatgggagttaaatgactcaaatatagaaatgtgatctctccatgaagtttgttattttacctaaattctttactgcaaatgacccatacaaggatgtatctaagtagactggttctctgttctgtttggaaacatagcagttgtcagccagcgaagcgcctctcacccgccagcagctcctgtggtgtcccagttttagtgcctcttccgtgtatgtctgtaaagcctctttattgattctctgctatatatttttaaattgcttactttgttctgattatatgctccttaagaaagtccaaatagtttatatatgctaaactctaaaaatacaaatccctaactgaacataccggtacgtgcataaaaatacaaatccctaaatgaacataccgatctgtgcgtgtaatcacagttgctggggcagggtagggggatacagcagggggttcaggcaggaggatcacttgagcccagaagttggaggccaacctcagcaacatagcaatacgctgtctctaaaaaaawatatatatatattttatatatataatatataattaataaatatatataatatatattacatatatattatatctatattatttatattacatatgtaatatatattatatttatattatttatatattatatatattatattatttatatgtaatatatttatattggttatatatattatatttatattatttatatataatacatattatatttatattatttatatataatatatattatatttatattatttatatataatatatataataaatatataatatatataataatatataattaataaatatatataatatatattacatatatattatatctatattatttatattacatatgtaatatatattatatttatattatttatataatatattatatatattatattatttatatgtaatatatttatattgtttatatatattatatttatattatttatatataatacatattatatttatattatttatatataatatatataataaatatataatatatataaaaatatatatatttaatatatctataatatatattatatatattatatataatatatataattgtacatatatttattatatatattatatatataatatatattataaatataatatataaatatatttataaatatatataaatattatatttatacattatatttatatacatattatatatacatttttatatattatatatatataaatataatatacatatattttttaaaataaaagagtttctaggccgagtgtggtggctcacrcctgtaatcccwgcactttggaaggctgaggcaggcacatcaccagaggtcaggaggtcgagaccagcctggccaacatggcaaaactccgtctctaaaaaattacaaaagttagccgggcgtggtggcgggcatctgtagtcccagccactcaggaggctgaagcaaaagaatcgcttcaacccaggaggcagaggttgtttgcagtccagcctgggtgacagagcaagactccgtctcaagaaaaaaaaaaaagaatttctgtaattacccacagaaagaacaactgttaagtatatatccttctagaacatagcttatgtttttggttttgcagaatgaaatcacatagtaatactattctgccatttgatttttctatttaaaaatatttggaagcatcctcatatatatactgtatcctaattcttcctggatgcacagcattccaccatatgaatatactctaacttgtccagtttcctgctgatgaatatttggcttactttttgttttactctggccccttttcttctttgaccaaatttactgtttctttgccccttgctcgctgcttttgctagtgataccctctgcctggaacagtcttccctcagatacctgtgtggggaactccctcactgagcccaacgctgcacacaagatttcacatctccatcccctgctctgctggtagcactccccccacactgcataaagtatttctctagcgtgttttttggcttctcctgacccctgaccccaggtcctgagatcaggaatctgctttgttcacttatgtattcccagagttccgaataatgtctggcacataatagatttgttgcataattgttgtaatgaacactggtgtacatctatcttttcacaattgtgtgagccaaacgaattcttaggaaataagtatacatttaaatttttgaaggatgactaaatttgctctaaagtaagtttgtaacaatttacatttccaaagtgtactcttctctccaccccctaaaactgtcctggttatgttgccagtttttgtaatgtgtttcctgtctgagaaattgtatctcatttgaatttgcctttccttgattgccgatgtgagtatctgtgctggtgttgatgccggttggtgtattctctcaggttgcagggacttggctcttgcttttttattgacttaacacatatacttatttttagatgttgactatcacgttgcagatgatttcacctggtttgactttcattttttcacatttttcttggtgcttttttccaaagcaatttttaagcagcatgtagtcatgtttggcagccttttcctaaattgtctcaagtgcctgccagttttttagaaagtatttgaacctttgaagaacccctggaagcgtagacgtttttatgctaataaatactttagyaattcctacttaagggaacttcaccttttgtactctgctatattaaatttctttgaggtagaaatgggggtggtgtcagggttagaatgctgtaattctaatctctaatcctgtatgcgaaacatttagtgctggattacaacatctgagatgaatcgaaatacttcgagcttttatcccttccttcttgggcctcattaatcacttctcttcctccagtttctccttgatgcctaccagtttgttcattctgccctatctacaagaacctcttgcctcctgccagcctctactagcttcttgccttcaccagcctttcttctagtcagacacttactggtagctgttatctgccctccccatgatcctgttcactcaggcttcctgtcatccacctgcaattgctctctcatgggcttggccaacagttcagttctcagatgtgggccccacctgtggggtttgtgtgattggcaattctacttctgaaacttcccttccttggctgctgaaccactgtgtttgcttttctatctgctgttttttaccaccttccttcctgatccctgaaggtcagtattccttagtattattttgatcacattatttctgtggcttctgatttgcccttccaggtatcttatttcttgttgtgaaccacatttacccacaggagtcctcttttgaccactgatggactcctgtccttccagctcccctgtctctttaaatggtcccacaattcttgaaatcatccagactgagaaatgtgtaaattattttttactcatcacttctgactcctctgctcacttttaaatagcttactaactgtttccgarctcttctctyctccaaagtgtaagctccatctttatgaggccagcataggacaaaagatgaggttagcatggatggatagtagaccaggaaaggggccgtaagatgaggacaggtgagcaagttcatgcttcttattgctcagtttctcccagagataagatggttcctcccatttaggaataaggatttatgaaaagactgaaggtcgagttacagagtaaaggatgtagagaggagggccttttctggagttctgaattagtgcagacattgtactaagaccaaatctctgaccattcaaggccctttttaggtcacattaaggctttccattcttaaaaaccagaaagcaaatccagtgcacagtttgaggtcgggatattttctgctcacgttgctcttgttctctcttccctgaatggctcaggtactgaggtgagaccaaacaaaactgtggcctgcctggtgcctgtgagaatgcccaccatgcaatgagcatttgagtgctagggttttaattgattgactgatgaatgcattcgtatttcaacttcagcccagttctttctcccctcaagccccatcccccacactactgcctgcttgataggtccgattgtgggatttcactgctgactgctggctgcctgttgaatgaaatacagatccccaggtcgctagcctggtgttgatggaactctccactttgtaattccaatttttgtttccttatccaactggatgtcttagattccaaccttttgaatttcttattctcaaaatgcaccccatgtgtcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctaaggcaggagaatcacttgaacccaggaggcagaggttgcagtgagccgagatcgcgcctctgcactctagcctggcgacagagcaagactctgtctcaaaaaaaaaaaaaatttgatacagctatcacctaaagcttagaawttttattgtaggtttaatttgttttcgtacaatttgtcccatgtagaaagtatctgacacttttcaagaaaatgttacatacccccagctttccaattcagttttgtagtcaatagcaatgtgttaagtctgtgctgatgttctcgtgttgccagtgaactctggggttccctgtgtggagcctgtctactctgtgtgtctctttctaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatgtaagacatttggtgtgttccttctggcagaatttggcgtgaagaatatggatttcagacggggtgtacacttggcccccaagatagttgcagccagcagcttcattgccgccctcagtgtttctcacatcgcagaagtggtgtggggctgttgcagattggtgctgagaaccctcacccaggggccctctgtggcactactaaactagcgcttctgcctgtggcctgtagcctgcagtacctttccttcttgctaagatcttacatctttgatgttaaaaggagaaaaggagactagaacctaaactggggtctgagaggtccccagtgctggtaaggaaacagtcaggctgtataggcccctggtccactgctccaggctgagccacccctggtgccctgctcaccagtctgagactcattgtatggccctggttagctttttgtgtcttccatttattattaatagcaattacagacctgactacaaaaatagtcttctttaaaaatgaatttcatggctgggcgtggtggctcacacctgtaatcccagcactttgggaggctgaggcaggcagatcacgaggtcaggagttcaagaccagcctgaccaacatggtgaaaccccatctgtacttaaagtgcaaaaaataaattagccaagcgtggtggtgcgcacctgtaatcccagctactcaggagcctgaggcaggagaatcactgttgaaccaggaggcagaggttgcagtgagccaagattgcaccactgcactccagcctgggcgacagagcgagactctgtctcaaaaaaataataaattaaataaataaatttcacatattgtaacatgcayacattgcttttactcttgaaaaaagaggctgaggccgggtgcggtggctcatgcctgtactcctggcattttgggaggcccaggcgggcggatcacttgaggtcaggagtttgaaaccagcctggctgacatggtgaaaccagcctggccgacatggtgaaaccagcctggccaacatggtgaaaccctgtctctactaaaaatacaaaaaaattagccgagtgtggtggtgggtgccggtattctcagctacttgggaggctgaggcaggagaatcgcctgaacctggaggtggaggttgcagtgagccgggattgcgccactgcactccagcctgggcaacaagagcaagacttcatctcaaaaaaaaaaaccaaaaagaacaggctgagagtattgcttaaactatacctctttaatcagaggacttcaaagaatgactgatgtggataaatcagtgttttgattagctgaaagtcgctacatatttgccgcatgtctcacttagtttagcaatttgtagtgagttaaaataagtaagcatgttaccatccaagctgtgtcaaacacaatttaatggttgtgtaagaagttaagcgcactcagcccctccagggctgcatccttgtggctatcctgatccccattattgaggggrgtgtagaggctgaagacagggtttggggactttactttagtgtcagttgtgtgtttctcacaatgaggtagagtgagccactccttggctatctcaatccatttccctggatcctgaatcaataggaacgtgttacaatgtttgctcattcttgcctgcttttaagtattttgaataagctaggcaattaaaaaaaawtttttaagagtgcttcataagatgaatggaaggttaagttgctgactaatattcttggatccagaatattagtccttcactttatggtcttgtacatagcttaagctaaccaactcttttttctcatatgagagtaatatataaattttgagttataggaggcatgaatattttcattacattttccgtaagtccttttagaagagtgtcttctatttcagacattgttgacctgaaaatctcttaaaatctgtctgccatcctgtggtagtgatggcctcacacaggggtggcagtgcctctagcagaaatccccctgagagactcagtcgagacctgtgtttgtatatcatttattggggaagaaagggagagctacacctcactagacatttccacggccatactcattatcctgaaatcccagcagctttatgtacaatttaccaagtaattttaattactgctatttcttctaygtacttgatgggtggttttttttctcatgagaatgtcatgtgcrtgatgccaccttggtgcattcctcttctctttcagcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaaaaaaaaaaaaattaatttagccgggcatggtggcacacacctataatcccagctactcgggaggctgagttgggaggagcagttgagcctgggaggtgcagtgagccataattgcaccactgcactttatcctgggcaataaaacaagaccctgtctcaaaaaacaaacaaaaactttagatggaaaggccagaggcttgtgtcgagttctccttcaaaagcatcactctgtacgtgaggacaaacttgttgccattaggaaactgcagcacctgagttaagggtgaggccaggatgagtggcatccaagcagccagtggccgttgaagcagcagcttcgatcctcgcaaagtcctgcagccatcctcactcaccttttctttttaaccattctaatatgtttttatataagttttctgggaggccaaggcaagtggatcacttgaacccagtagtttgagaccggccctggcaacatagggagacctcgcctctataaaaattttttttaaattagccagatgtggtggtgcatgcctgtggtcccagctactagggggaggattccttgagcccagtaggtccaggctgcagtgagctatggtcgcaccaccacgctccagactgggcaacagagtgagaccctgtctcaacaacaaaagtttcctgtgttgtaattcattaaaattctcacattctaataatttgatggatttctagatacatatgttgtacacrttgaagtctaattatgagtttggaaatgagacattaagaaagattttagaggcagcaagaaaattccaccctctggaagctgagtaggcgctggccctgagatggagattagtgtgctttgcagagcacagttctcaggtgtgcttggggagcttaccctttgcccctcgttcactcacgcagatcctgctccttaaatgtggtgactacattcgcattaataaagaataacatctcaaagcaaattcttcagataatacctatttttgagtgggtaacagcaagtgttgtcgctcaagcttagagtaagaaaagtctcttgaatgttccatttcatgttgttcgaactttttaaaatcattctgttccctttttattcattatatctttaattagaaaaatgataggctgggcgtggtggctcatgcctgtattcccagcactttgggaggccaaggtgggcggatcacttgaggttcaacaccagcctggccaacgtggcaaaaccccatctctactaaacacaaaaaaaattagctgggcgtggtagcacgtgcctgtaatgccagttacccaggaggctaaggtgggagaattgcttgaacctaggaggtggaggttgcagtgagccaagatcatgccactacactccagcccgtgcgacagagtgagacaccatctcaatataaaaagagaaatgataaatacatgtcattttaaattttaaagtagaatttttkgggggggtagcaaataactatttgttgcagtgttatgattctgatttctttcgattcttaggaaagtggagaatgaggacatgaataaagaccagatcttgctggaaaaagaagctgaggtaagtaggaaagtactattggttggttggttggttggttgttttgtttgttttgagacagagttttgcaccattgcccaggctggagtgcagtggcgtgatctcggctcactgcaacctctgcctcccgggttcaagtgattctcctgcctcagcctcccgagtagctgggactacaggtgcccgccaccatgcctggctagttgtttttgtatttttagtagagacggggtttcatcatgttggccaggctggtctcgaactcctaacctcaggtgatctgcccaccttggcctcccaaagtgctgggattacaggtgtgagccaccgtgcccagccaaaaagtactattcttgtgactgaaggtgttttgtttacatccgtagatatcattggtaattaacttaaagtttatagttttttttttaatttgttgaggaggatacatataactactttattactatatatacacatctatatataataataaacatggatatttacatagcatacatgatgcttcatatatttagctgaaagactttggagacaatttagtaatgtcactgatatttgtaagtagatcataaatatggaaatatgctctgttgtaaaggtggcattcagatctgctggagttttggaaggcaaacacattattcagtaaacaataggatcataatgggctagccttttggaaacaaaaagaaaatacttctttggtcaaattaattcaatattgatcaaatatttaaatgttaaaaataaccacaaagtcacctgaagaaaatttaaatgttttataatactttcctggaggcatttctgaacacatacaaatcataatgataaggataaagatgaattaacatttactatttttggccaggcactgtgggttacacttatagtcccagcactttaggaggccaaggtgggagaatcacttcatgccaggagtttaagaccagctagggcaacagagtgagacccccctcgttctctagaaaaaaattaaaaaataattagccatgcatgtcggcatgcacctgtagtcccagctactcgggaggctgaggcagaaggatcccctgagcccaggagttcaaggatgcagtgagctatgattgtgccactgcagtctagcctaggtgaaagagcaagatcccatccctttaaaaaaaaaaaaatatatatatatgtatatgtatgtatatatattatttttattgtgaggccttcattgccctccagaaaagctgattcattcccattcccctttactttgcatttctcactgtcatcagtctctttccctccttttaggttagaaaacttctcatattggccgggcgcggtggctcacgcttgtaatcccagcactttgggaggcggaggcgggtggatcacgaggtcaggagtttgagaccagcctgaccaaygtggtgaaaccccgtctctactgaaaatacaaaaatcagctgggcgtggtggtgtgtgcctgtaatcccagctactcaggaggctgaggcaggagaatcgcttgaacccgggaggcggaggtagcagtgagccgagattgcgccactgcactccagcctaggagacagagtgagactctgtcttaagaaaatttatcatattgtcttatctttctttggttattgtttctgtttggcttgcatattcgtatcatttacttgattttctctttagctgttgctttttttattgattggtaaaaagtctttatgtaataactcctgtcatattttgggaaggtgtagaagttgaaattttaggaatcacrgaacacccagaaataatgttcaaagacagcaaaccttgaaaacctataatgtgtgtgtgtgttcacagctccgccgcatgcaagagatgattgcaaggatgcaggcgcagatgcagatgcagatgcagggcggggatggcgatggcggggctctcgggcaccacgtgtaaggtgatgtgcacatatcaagaagtcagaggtaggccctgttgtcccttagcctggaagacaggcagttactaacattgtgtcagcttaaatatgacaggttcctccttaagcctcattaatattttgcattttgaagtaactccatcactaatcttaaacaaggagagattgctcctgaaaaacagaagccactactttgccacctactttctagtaaagatttttcatatttttgtctcttcttttttttttaaataatttcaacttttattttattggggtacatttgcaggttattttctaagcttgcaaataccaacattagaaggaaattatgtattaaagcacttttattagttgtattattggaaatttgttaattgttaaaacatctctttaaagggaataaaaacgtgttattaaaacagcttgtacagattaaaagtagagatggcacaaggaagaagaattatgtgaggtagataagggttccctggatggtgactgctgacctcctgttcctcagatagctttgtcccgactgatggtcattagtgaatagatctgtctggcatggtgtatgctggtctgcctgcttgaaaagaatctgcagactccagagactcaggaccaggaaaaggcagatgcccactcccctgtatcttatgtatcttatggacaggcaggctctctgaactgtccaggtggccactcccatcacttgccagaggaaaagcatgaaaggtaaagttaagtaatgacctaagagtccaaagaagagggtaggtcacatggagctggggtaaaggcaaacaaacctcatacaagagatctgattagagcttgaaagagagtttgagttggccaagatctgaggatgaaacgctgggaatttggtagaaggtctctactacaattcagggacctcattctggaagcatgagtgtgttcatgaaaacagggaggggacttgagccttcaacgacatacggcagggtgggttaggcagaaggcagggagtcttgaggcctccacagcatgtggacaggtggctgaggaaggacccagagtgacttgctggagccttagtcaccaaacgctcttgcagcttagtgggaaaggtgttcattgtaaaatacggtatttacacaaaatgcacaaaaatacgtatgtacagtttaataagttactgtaaggaaaacatccatgtcacccccaactgagtccaagttggttgctttagtttcatcatcacagtgacaccttagaatagtcctgagggtatgtgcttagttcacactttactgatgaggaaattgttgccgctccgagagtttaaaagtatttgctgatggtgccatgacttttaaacgatggcctgctgactctagaggctggtcctgcataaccagttaatggcatgtgactggggaagtgagggtacagtggaaagagacaaggatgcctcagcgatgcagctcatttgaagcaggaagcagtgacaggtgtttgcttattttctctgagcttcattttcaacctttatggaatgaaaattttacttttagatcgataamattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttrccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcacttyagtgtattttctgtcactgtaggtatagaagatctgcctcccctgtggaaattggggtctgttggtgggcktgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaatgagtatttctcttggttatttgcaagggaaagttgtgaggttttctgggaaaattcaaagtcttgacaacatctttgtataaaatcaagaaaaattacttgaatcaatagtgtcagtactggacaagtttgtacgtattggagatccagcccaaaagaaagcacaaaagattggaaaggaattatttacaggtgatcagaacatctacttagaaagtacaagacatctggtgaaaattaacactaagaagtcagtgatatctattttctaattagaaaatgtagtgagaaaagaaatcgcattgataatagcaactactaaattactggaaatataagtgaatgattgaaatatatctaggaagaaatttctaacctataaattttcaagaataggctaaggcggctctgccacttgagtaaaggaaactggaaacctgaattgatctgggtggctggacacctacactccaaggcctctagccttcttcctgcccactggactgatcatcccaggaccaccttgggccccttttaccttgctatcagtgttttctgagcttccttatagacagacccctggatactgaaacttgctctctctagttcctcagctgacagctgccacgcctgctgccttccctccagactgccagcctcaggtcaccagcacacaccctgcatcctaccaggggtcagtaccaccctctggccaggctctcacctgcactatccccacccggccctgcccgtctgcaggcagggatcctctgttctggggtgtgtgcaccactctgggcctggtggtgtcattgggggttggttaaaggaaaagccccagaggtgggtggcacatgaggggagcatcccgcacagctgagcccagtcttggtgtgcctgggtctcagaccccatagttgtctcaggagaaatggaggttcccctgagccagcatttctcctgtctgggcttctgggaaacgaagggtcaggtttcactctggaatccacagcaccataggaggagtctcttaagtgcccgggtgtttcctgaagttaattattccctcaacagccacatggtgacagtgggtgacagggccgggctaggagagcacgatgggtagggtcttgaagaacacataggagttcaatgaacttctcaagagaagggaagtgtgccacagcaagtcagtcttccattctcgggtgggggtccctaggccagaggaaggccgtcctggccgccaccacggagcagcctgtctcagccttagcacagcctcgcgcgatccttcgatgatccccttcggtccctgtagtcccacgagggatgcaatgcgttggaggaaggaggaggctggcagccagggactgagccaaagggtgcaaggacagccggcaaggcccgggccaagacctatccccgcccagcgagccaggcctcgcccagcacctatccgcgcccagcaagcctaggcctcgcccagcacctatccgcgcccagcaagcctaggcctcgcccagcacctatccgcgcccagcgagcctagacctcgcccaagacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccgcccagcgagccgactccccgcccaggacctagccccacccaacgagccgactccccgcccaagatctagccccgcccagcgagccttggcttcgcctaggacattgcctcgctcagcaagccgacgccccgcccaacgagccgagcgctgcacagatttatatcctacgcagctgcctgcctgctcccgccccttctccgtccgttcaccaatcagaactcgatcttgcgctttcaggccgcgggacgggaaggctccgccctggcgccccgcaggccaatcgactgcgcgtccgcgtcgcgggggcggggtcagggcggggcgcgctgcgcgggggctgccggcgggcagttgggagcaggcgacgccgacgcgagtctggcggctgctgcttgcgactgcggaggccgggcgaggccggtgaggacgcggcgggcgagcgagaggccgagggtgaggacgtgaagcggcctgggcgcgtggggcaggggtgggcctctccgggtgggcggcgaagcccgaggcccgaggcgagaggcccaggcggggggggcgctgaggccgcggtccaccagagatggtcccgcccggcctctgaaggccatcgtgaggcggctggagctcctaggcgggtccgggttagaggagcgtccgtctgtagggagcctgccgcgtgggggcaggcggggcggtgggccggggagtggcccgcgtggactcccgggttgaggggtgccgcgtggaggaggccggtggggctgtagaccggggagtgtcccgcgtggactcgcgggttgagttgtgccccgtggaggccggcagggccgtgggccggggagtgtcccatcccggaaggacaccccagagtgggccatagggacccgcagggtatgggcctggaggtgcctggtggaggcattttgagccgtttgcctttttagcatttctttaaattgtatcttaaaggtgggaatcaagtgttaggtgttaatatttttactccactaagggctagaaatactcataagccagtgggtagcctttgggaaacccatgaaaactggggaccagaatatggcccagtacattacacacccgaattacgggcaccttttccgtttacgctatggcagcaacccctggcctatcatgtgccattaatggatgtgaaaagcagaaattagaacaaggcatcattgaaggaaagattgtcaatacatagtgttaaaaagggatgggcaaatttaaaacccaaggccaaatctttaaagggtggtttttctctctgggtttttgtttttgttttgtttccgtgggatatttttgtctgggccactgtgtaaatgtttgataaccctgaggtggcagtgggttagcgtgttggtcttgtgtagactgccttataacaggcgacacagattttctcagtaccagagagatgggagaggacatttgaggtagggaagcatggagtaacctttacttgtaggccaaatataatttaaattttctacatctgcttgttgaaagttttgttttgttttgttttttgaggtccttaaaggtttaggaagcacttcatgctcgttatttattcagttttccaaaactcttcagagacatgaccaagttgcacagccccgttttaaagtagaggaaagggaggttgagagaggtggaatgaccagtttagggtcacacctagggtacttgcaaataccatctgtacttctcatgtgccctatccttgttgcagattctcattaggtggttcactgttaacaaactaaatgctgatgatgcagtttcctggactgcagacgtttgctggcttatttacctataggactatcagtcgttagtaaatttccaggttccttgtatactaattcctttcccaaagaggaagttgatataaggtgtattcatttctctctgcctcaggttccttattcaaaaaatgagtttaaaatttacttggccaggcacagtggctgtaatcccagcactttgggaggccgaggcaggcagattgcatgagctcaggggttccagaccagcctgctcaacagggcgaaaccccatctctactaaaaatacaaaaattagctgggctggtggcgcacgcctgtaatcatagctacttgagaggctgaggcacgagaatcacttgaacccaggaggtggaggttgcattgagccaagattgtgccactgcacttcatcctgggcgacagagcgagactctgtctcaaaaaaataaaaaaataaataaaaaaagctgtgttaacaagatgcctggcacaaggtaagtgcttaataaatgttagccattattattatcaggtggacaaataatccgagtagaaagtagaacaagctaaccctggatatttacaaaaaacagtagagaaaaaattaggcaataattaagcaaatttatcctgtttagagggaatggtatgaactggattgccaaagcaaagatcaatgcatgggcaattccatgtgagctcatttaaatccatttggcccaaagaattcagttgcttccttcctttccaaacacccctgcttctagtcacatcaatacctcttctatattcggacagtaacagatttttcttactgctgcttgtcctttcagttttgttcttatttttccttcacccactttcatatcagcttgccagcttcccctttactcagtgcgtcatgagcttcataaacacagcatagtgctagatatacaggcaaaaccccattgtagtgttggatactgagctgaggtaattccggtcatgttctctgagatcagaatatagagtcctttgaccatagcgtatttgtcaatgccacagggagttgaaaagttgaggatcctacaaagcaatatgataaagcccagtctttggtgattttctggggagcgtttagttgacagtgattctataaattggtctaatctttttggaaagtagcagtatgtggcaaagattttgattttggaatcacacttttcaaaacaatctgataaactttgttgtgtcagtagggtagagtactccatagcaagtaaacatgcttccacaagctgaatcccatcctcccatccaaggaaaatttgaaccattttgatccatggaaatatgctttaaaatgtgacttaactgaaaagttgaaatggtgtgtacacagcaatcatagtgttgtaaaaatacatgaggaggtgaacaggatcaggagggtagttagagtgttgtaagtggttttattttaagagtcatgaattgttttcccctaaactggtgttttagcttattgccattttaaaattcaaaaacaaaaaggccctataatgttgtaggatgcagtgatgaatcttgcttaatcccatctttccccttccccgcccatcctcctgattgcttcccaaaatgaaaatgtggtcatgtcctatcccagctgcaaaacctactttggtatgagattccaaccagttggcccactagagctcgcgcagcacaaccccaggccacctccccacctcccctcgggtgtctcagcccaactatactcatcctttcccagctgctcctgcagtttctatgtagtcctctgcctgtgcacacactatgtcctttgtccacctggtctcctgttcccctgtgaggaaagctgctccaggtcaggctagccagcggtgctgcctctttctttctgctctctctgtgactgcagtgggcaggtagtactggttactttctcagtcgtctccctttctgaattaaacttctgtatctttgtgtgctctgtgcacaccatgcaatcacgatggggttgaggccgcttgtggagctgagtgactgctaacaaatcactaacctttctgagcctgagttccttgatgccagctgcacatggttattgtgaggattaaatgagatgacataagcgaagggcttgacatgcatctccttgcagtggtggtcatacaggacacggtagctgttgtaatgtgtaccagtgcatttttgaggccttgtcttggaccttgtcctcttgatgaagcctcctccctgtctccctccagctgccaacttcctctctaccaccctcactttactcac

SEQ ID NO: 17906 - DNA, 42079 bp, Homo sapiens
atatcatccctcctctgaaagcctttactcactccccaggcagaattaattgctctttcttatgtgtccgtatagttccttatttatacctcagttacagcacttgtcaagttagattatagttgtatagagtccagcctcatctctttaaactctgaagatttccaaggtgagaagcatgttttatttatcctcaaataaatcccagcagatttcccagcacacaggaaataataggggcccagcaggcaacagcagcagtagcagcagcagcaacatgtatcgggtgcctattctatgctgggcactgttttaaggactctgtatgtactaaatcatgcagtgctcaccatgactctgtgaggtgggtattacaatgatatgcattttacagataacaaaatcgaggcccagtaatttacctagggtcatacaactagttagcggtagaaccaaaattgaaatccaggcacaagtttagcccacattcttaaccatagatgttaacttcaagagagcctgcccacatgtctctcagggctgtgatgagatttttaaataagagaatagatatatttgtgctagcggggtcttaatcccagccacatggaagatggacttgggacttcttgttgtctttccctggggctcctgaaatagaagctgcttcaacagaccaaaacaggccttttcaggtctgccccggagtggagtgatacagtagaaagagcctgcaattgccaggcaagggacctgcctcctagaactgactcaattgctcactttttctgaccttcactcttcctatttatggaaagacagagtaagatgaattcatctccaaagggcttttcagtcctgacattctgccagcttttgatttccagcttctcaggtgaatgctgcagaaaagaatgttgactctaaaattaagtgtaaaacaaacaaagaaacaaacaaagccacactgtgcagcaggtgaacatcctgttgacttctgagacttatgggtccctttctctgaagctgaaggctaatttccaagacacctttttgggcaaagacaatcagaacagtaacataaaagtttactgcagcctttctagcaatgtgttttttttctctctctctctctctttctttctttttgtgtctgcaattgcaagctgcaaaatagctggggaaatcctttgtccagagctttgggatcactggatatctgagctgggagggtcctcagaaattcttactccaattctcacatttgatggatggagaaacatagcccggtggagggagaagagaccggcttgaacatatacagtaagctcctctgtgacgggccaggatgtctggtggtgactaggcgttccaggtctgcagaaacagaggactctgtggctccaggacccagagactcttgtccactcagtgcactgccagccgctacatccagcacccgcctccaaatccccctcctttgcagaagactgctttcaattagaggagttaacgatgtcttgctttcaaagggtttttttaaatccagtttatcttccacccacacacgatgtacacaaaggcagggagacggagggagaagagggggagcgggggctctggtattttcccacacaggggacatgccatgaggtttccattgaatttcgattttacagatttacatgcccttttgtcaatcatgggagggaggaagtgctcatcaagcctctagtccaacctctccaatttcctttttccacccaaagggacctgcgaatgagccttatagaagaaaataggaaaaggaatggggaggaggagtgcggggatggatactgacactaacagtacccataaatgtacaagtgtgcaacacacacaaacacagacacacacacacacacacacagccagccagtatttctcaatatttctccttaggccacattttaacctcaggcttgcagttccaatgccaggttatttcccaagaattgcaagggtgcaagaaggacagaagttggtttcctgatataaacctccaagattcttaagggtcctgaggactacaggagggaaagcctgctgggagacagcctataagactacagctgtaaagggcctcagggaacctggacacagaatggcccaggtgaaataaaacctcctccataaaccaggctttgctgtttttatcagatgatgttctccctcctcagtgctttcctgggagagtgagagagggcaccagctctttttttttttttttttttttttgagactaagtcttcctattgtaccccaggctggaatgcgatggcacgatctcagctcactgcaacctctgcctaccaggttcaagcggttctcctgcctccaccccccgagtagctgggattacaggctcctgccaccacacccagctaatttttgtatttttagtagagatggggtttttaccatgttggccaggcgtcaggtgatccacctgccttggcctaccaaagtgctaggattacaggcgtgagtcaccgcgcctggccagcaccaactcttaaagatggtctgcccagtatgggtgctgcctgtgtattatctcattttaccttcctaataatcttgtgaaataagcatctttatccccaattgagatataaggactctgaggtttgggtaggcattgatcagcctgccacggcttagcagtcaaactcatgctcgtctgacgcaaagtctgttctcttcttactccatggcttgacctcccaataactcttggtccatacccttgaggtaatacacttgcattatggtttcttgtttgtccatctgaatctccatgtatgagcttcaaagacagtgcctatgcctgacttctctttccttttcatcagtgtctaatgcaggttactgggcagggctcaccaaatgtcccctatgttaaactaatatggctttcccaaggctttataagattggtgacgcattagatctagaaatcaaagtctatagggcctagaccaatgtttagagataataataaccatgtagtgcaggaaagggaccaggagaaccaggactcattcccacgtgacatcagtgctaccattctctcatccattgcacaggacaggcaccattaattacatagtgcatccctgaaggtaggcctctaaatccttctcaacaaaacactatggggagtcactctaattgctcagaactggcctagaagatgaatcctatttgcaattcttgaacttggtcattagctcactgaggggaagaatgagctcttgtcttttctatcttcagtattaagagcagaggaaggtccagcttagatgctaagcgaatgtatggccaggcgcggtggctcacgcctgtaatcccagcactttgggaggctgaggcgggcggatcacgaggtcaggagatcgagaccatcttggctaacacggtgaaaccctgtctctactaaaaatacaaaaaattagctgggtgcggtggtgggcgcctgtagtcccagctactcgggaggctgaggcaggaaaatggagtgaatccaggaggtggagcctgcagtgagccgagatagcactactgcagtccggcctgggtgaaagagtgagactccgtctcaaaaaaaaaaaaaaatgtataacaacaataccactttacatgtctcatctcagttaatgcatataatgaacaaacacaactcaaatcttccaacttcaggttcagggcctctcccactacctgcggagcactatagacctctcctacctgagatcttctcttcattcctacttctatccctgcttccctcttatgcctctaattccaaactgaccaatgaacacagaaaactttaagggaagccgagggttaacagatacacaacacaacacaacacacaggcacacacacacatacacatacacacacacttcctttttacacacttaatagcaatggcagaaaaaagagaggggggagccaggctttcttttaccaaccattagaaacaattatcactttccccaggcctccagagcagctttcccctttgatgcctgccttaaagagatagaggggaaagggaggggtggtttgcgtttctttcaatatgagcatttattattcggcatagacagacaatcaaggaaagaagcatttcctgtgtgcagggccagagtgtgaaacagagagatggcttcttcttccctcccagagttctagaaatagcagcagatctcagagcctctacccaggagacactttctgataagataacttggcattggatgccctccagccttggggctcagctctgggctgattagcacctcgttgctccagggatctgtccctaacacattaggcatttcacactccttaggggtctcatacccttcaggctggcacctccccacaagtctgaaatcctgggatttagggtgcaaacccctggccagaccaaatgatcatggaggaaaagccaggctttcaatggaaagggaatatagaaatcatataagacgtattgccctacagcatactaacatttttacagatagggaaactaagtttcttagaaatgatatggttcagaatcatagaattgattcttagagactactcattaaattcctcaatttcatacacacaggttcaggatttctgggggacaacagatagatgtctcaaccttcttctaagggaaaagcttatgttagaggcctaagacaccattcatgaaagtggtaaagctaacatgttttctttgccatcatttactgtccagcacctatgttccaaacatagattccccacattcccgggaagccagtattactatcctccttcttgtttgtcctacagataaacagcctgggctcagaggtaataaataaggtgccaaggccacacctgttcggagtggatgttgaagtctgtgttacttcagttctatctcctattcccagtccattctgcagatgagaaaactgagacccacacagtgtacatgctgatcttaatgagaatgatgacaataacggtgaggatgataaatatccaaatgcttccacctccatggacaccatccttatgtcactgtgatggggagattcatcacccaccccaccccctttttcaaatggagaaagaaaattcacaatagcagtggaagtactgattaatataatgacactagtcactcatttatattgcatgaaatgttagttctcacacctctaccccatggggttggcatcagctccccgttctgcagacagtacagccaggcattgggccgagtcccttcccagatgcccgttttgaggaggagatgggcagggggcttgagctcctccagctagtaaatcctctaacaagggagagtgattagtgtcggatgtggcggccgccttttgtgctgctgacaactgctgccattaaaggcctggctgggctcatttcacacgggccctccgcaggcctgctccctgtctccctaattatgccattcactagtcgcccaggcccgcctatgaactcctgacccagcagtgaaagacttgggatctcattactaatctcttaagccacctagtcctccaaaatacatccatttaagttggaggccaaggctttggggtgggaggcggggagagggaaagtctggcacagagacttctcatgacatggccatttcccctttcgggagactgtggcctgagccacagggcagctggcatgactgtccggctcagcccagggcaggccctgctgagggtcggcggctgggcctcaagaataggaggcccttggatgggaagggggaggacatctgggcccacctgtttgtaatttcaggggtgcgggtgggggatgaggcctgtgtttgttttaattattattattgttgttgaaaagggaggaaaaaaatgagcagaaactgctaacatctggaggctgctgtccagtttacgtaatctcttgctgcagaggaggaacacgggatccccagccagatggtccgtgggtgacttcacagcacatgtgctacctccaagagtaagatgctgacggggttaaaagagtgggatgcaaaaccttccttgtattcttacagggtgagaggcagtggtttgggtgctcccagggatctgttttcttttgaaagcatcttttttttttctgtccagcctaggatcaaatgtttctatgtctctctcattctgtcattcattcattcaacatttatttagcacttatttatgtgttaggttcttcattcccatggtccacatgaagaaaatggaccccaaaggaacaaaagcaacaaagataaaaattccttctcctcccatgggggtgggaggtgaagaacgaagcaagcaaacactcatagagaaatgtggtaggttctgtgttcaagctctctgaaggctgagggaggggcttggagaagggagttgctgaggcaatctatatctgaaggccaggtctgaaaggcaagatcttaatatcaaatgggctctggagagcaggaactggaggaaaaaaaatggccagaggagaaaaactcggccacagctaagccatgacaaacccagtttcccaaatgatgtcaacagcggaggcgtgaaggataagtttgagatgctgaatattgttgcaaacacagttctgagcacgttatttaaaaaaatacattgctaactttctgtagtttaaactttatttttgcatttgtactgaaagaaattaatgaaatgtcatgaattctagatcagaatataaaaccagtgtagactctggatcagatcaagagagcactgttaacttcagtcaggatgaacactcaactctagacaggagcacagagctattgccagcagtagaaaattctgaggcatttccagctccagataagaatcctgaaaaatcatgaattttatttcagggcccgaggcattgtcagttctagagcagtatgttgagcactgaaacacttctaagttctggaccagaatacgaaaacaccataatcctaaaacagggstgggtaatgccttctgctctatagccccaaacctgaaactgactgagatttagacactgaagataaaaaacaaaaatctacttagctttaatccaaatgctttctctgctggctctagagtgaaattcagaaacacagacaaccctggagtaaggcactaaaatatggacatctccatcactcagctcagagctattaagactaaagggggatgtcttaggaagcttctacacctctctttgtcctttgattttaaatcaaagtccctgggcattcatgggttaatcaggaaagtgatgatcacatccaagttcggtgcctggtcaccgaaacccttggttatgaatagttgaacagtggttaatggcagtcttgaccgcatcggcctattcaagaaaggtcagaggaatgattttttacttaaaaacatctgtcttgaaagaacaagactttctcaagttcataaaactagaagtttccaggttgttgtttttgtttcctcccctcttccccctttctcctgttattcagctttccaaattaagatctgtgtgttccagattgtgttgaaattgaagtacaagtcacattacctgcagggaaccccactagatgccaagatgatcatgcagagtgcattgtctctgagtcctgcttctcactgcagacctcagggtcctcccatcccctcctatagcctcaatgagtaagggctgggaatcactacatgattcgctctcttccttttgcttttgaagaggaggcagtactcttgtctaggttgcctcgagcttgatttttcctaggaagagtctycaaaggatgcaatgcagtgatgtatgaaaggaacaggtggacagcagtcacttatgtttttaacagcatcctgcagaccttccaactcaaacaagaactcccatttttaaagacaaaagtggtatttctccctggcctgcccctccaggcttcagaggtagaaacagtgactgtgatgtacaaaccggggagctttgtccaccacaggtgcaatggacactgttgacttatatgtccaccactctatcagcagggttctctgaggaacaaggaccttccagagtgatgcttttccctagtggcagccttggccagggcaacagacatctgcacaaacgcagggtgttgaagcagctgttctgagatgcagtgcctgagaatctgggatccacaatgtgaacttctcaacaacccctgcacctgccacttccctgaatcttccactaagcaccagaagacacatgyattttaaatcaaaggaatgtgagttggaatttcagcttctgccattcactgacaacatggccttgaacccttcataaactctaatatcttccactgcagaatgagatgatggtacctatgttgtagcattgtgaggattcaaagagctcttgcacatgcaaatatttagatacaccctactcactaaaaatacaaaattgacattttcctccatcacttgctgcttctttcttcctggctgtagagggacatggytctggtttcaaattctagacttccctgttctaccactgggctacctgtagaacttgggtaagtgacctaacctttgtgagtcttaattacagtagttacctcatacrgtggttgacaggtttaaatgtacaaaaaacagtgtagagttctctacataatgtaatcactctgacagccaagccattctctttactctactcatcattatcaatttctgtgattactattacattatggttattactggtatttgttgttattgtgtagtccttcctttttctctgtctcttcattctatattccttctttccttttacctctacctcttcttcctcccatctttcttcctcttactccttcacaccctcctgtgctgggccttgtattgggagatctctctgaaggtgaaccacattctcaagtcagaaaggaagacccttagatttccatccatctctgtaggaagccaatcacaggaaaattgcttagaccccaatctttcctgcaaaaacaagaagcaaagggtagagcttccttcctggcgctcagcctccagaagctgtttcctactttttgcccaaagctgttagcagagaaaaaaacatttatttatcagtatttatcatgaaattctatatgccaggccctgttcttgatgctggaacacacaggagtaagcacacaaaaacagttaccaaacaacccttctcactgtgcagtgaacattccgggggtgaggatagattatggaggcacagagtagcagaaagaacatgaggtctgggttcaggatgggttttcgggacctcttcctcccccaattcacacagtagcacttatctcctttgtaatgtgaagggatgaaacaggggatttcagaaggccctgcctgctttgatcacctatggtattaacaggaggctgtaatccggaaacataagggaatcacttgtagacaccgatttataaatttaatccaatcataaaagaggtaacacccagcagctattgttcccaacaacatcatttaatgagtccattttctgagtattgtccacacagcaggtcctgtgctgggcacaggaaatacctaaaggcataagatgagggccaaatcgttagctgctaaccggtcatttggtatgaaaagctgtggacacaagcaatgcacactgaaagtcagcttgtgctcaagcctgtctgataattccagaagtattctgtacatggaagagggaggctgctcatgggctgaggttgtcaggggagggatatggaagaggagccacttgagctaaaccctgtaggataattaagccctaagaaggttgaggagcaaatgatggtgtttccaggcaggagaaaaggaaaccccaagatatatctggaaattgcaagttggtccatactgcctggaacgtgccccttaggcaatagtctgtaaagcaaaggtagagattgtgcatggccttgtctgctaagacttttggagtttataggccatggggaacaaaatagagagcttcacaggtgagaaatcactgagaccaatatttcttgtgaatacggagaatatgatccaaaagcaaaagtcctccagtgagaatttatgcagacttaaaaaatttaagacattgagttacaaaaagattagtatgtcatatctcactctgggaaagagaaatgtcattttaaaaatctctggagagaccgggtgtggtggctcacacctgtaatcccagcactttgggaggctgaggcaggtggatcacgagatcaggagatcgagaccatcctggccaacatggtgaaaccctgtctctactaaaaatacaaaaattagttggatgtggtggtgtgtgcctgtagtcccagctacttgggaggttgaggcaggacgcttgaaaaacctgggaggtggaggctgcagtgagccaagattgcaccactatactccagcctggcgaaagagtgagactccatctcaaaaaaaaaaaaaaaaaaaaaaaaaaaaaagattcgatgcaatgacagaactgaatgaatttaggtagtacttactctattccaagcactgtcctaagtgctttaagcgtgctatcccatggaattctcaccatctccccttaattatttaattttacagatgagaggactaaggcacagagaggctaattaagttgctcgagatctcaatgcaagtagcagccctggcatgtgaagtactctagacctgctctgtccagtaggggaacccaatgcccacaaataggctatttaaatttaacgaattaaaattaaaccaattagttcctcagtttcatgaaccacattcctagggcttaatatcataggtggctagaggctactgaacaggacattcatatgtagaacattttcatcatcatggaagkttctactggacagatagtctggagcctggcctgtgaacactgatacaattttgctctctctgaaacataaacccctgaccgtagctccctggtgcatgtcagtttatctcctccttcccgttgctttaaattgatattctcttcctggaccccttgccaccagtcagttgcactgcagacatgggcattacccaggtggcatctgcatctctgaaagcagtatcttgccagtagaccagatctctcccaaacctgtgacttccccaggggcctctcttccaggaaggagagaaatgtagacatcaccgaagtgtcccctttcaccacctgcacatatgagtcatgtttggaaaaggattctggggtgggcaggagccccagggacaacttttttggactgccctggcacagggaacctctcagcagggacatctctcatgggcctctctgggcccatttctccctggaaaacaaacatgtacaaatgtacccagggtgctctggtgcttggatctggctgaagaattaatcagggtttaagaaaatcatggttggagtttctttttttttttttttttttgagatggagtctcactctgtcacctaggctggtgtgcagtggcccaatctccgctcactgcaagctctgcctcccgggttcacgccattcttctgcctcagcctcccgagtagctgggactacaggtacccaccaccacgcccagctaattttttgtgtttttagtagagatgaggtttcaccgtgttagccaggatggtctccatctcctgaccttgtgatccgcctgccctggcctcccaaagtgctgggattacaggcgtgagccaccacgcctggcctggttggagtttcttaagaggaggcagaaggccctttctggtctcattctacaggtaacatacccagtctaatttatcaaagtaaggatgggaaggaatagagagtggggaggaatagagagtagagacgaggggacttgaaagacaaacaaaaacaaatgaacacatttgtgtgtacaaaaataaaaacaaaatcttgtgcacagccaaactctaactcmcctcaaaaccccatcctttgggyctggcttgagaaagtttactttcagacttagagaaatgagtatgtggttttagggacaaaattcaataccgccaaagcagcaggctcagcaagctcaactggctattgcttcctaagtgcattacagcccaggagagtgaacgctgtttacattttttacatgtttcttgggtacagaacatgaaactaaattacacagcaaaggccatgctggctgaatgctggtgaccccacttaaaacaaaacaataacaaaaaaaaaaaaaaraaagaaagaaagaaaagaaaagaaaatgaaagacaagaacaaagaagggttttaagggagccagaacaaatgacagggataaaagaaaggtttctggtcctgaagctaaagaggatgtggagaatgaaggtaatgagataggggtaggccaggtttggaagaaaaaggaagacagaggccaaggaatcttcctagatgggccatggaaggggttggcagggttttatctagtctacatggagaaccagtagatgcagccccaaaccacaaagccttgcttattcttgggcttcaagtcaagagtcaagtgtcaactgaaaaatgaagactcgctattcaaagcaggatctcaccgttccacgtggcaccttccctgatcaatcaatatgwgtttgttgtatgcctacaaatgccaaacccatcccttccttgctttcctctcttacacatttttgttccttctccagattcaatttgctcagggataatgtagtttagtagggatgtgaactgacaagaattagatgcctcgcaagacgtagccacgtattatacactttatatatgttagctcattggatcctcataccatctcacagaatgacagcaggatcatgtgaagatgaggacaattgaggctcagaaaactgaaatcattcgccaggcatcagacagctggtaacaaacagtacccaagtcaggtctttctggctttaaagcttatgcttcctctgtgaaacaatatggctacactacaatgttttttaaagcttcccccaaatgcccaagtggaaagaaaaatcactttctacataacctgtcactttattcaggttcgcccttcctcctcaaaggttaacctctaaggttaattccatttgtccacatatcacagcactttgcaagctttgtcttttcttatcgaaagaagctattttggtgtcttccttcctccatggcacataacttactgcctgagagcagtggttgctttgttcaacctcatgttgaaaatgatgctttggacccagaagattcacaagattctgttgattttgaatccaaataccagaatcattttataacggatgggattgagaggttcagggaagttgtttaatcaaaaccaagtcttaattaagtgaagtaagaccaagagactctcaaagtctctctctggttaaatttctatgccccaaatactattctgttagaaaaaaaaaaaaaaaaaaagtccacatgttgttcctaattsgatttgttcctcagttgccaaaacttcacaggcagacagaagtgtttctttaaaactttgtcggttgctaccagaaggaaaactgtatttctagatcaactgtctcatccttgacaaatacctgccatggagatgttattactcctatattacagatgaaaaactggggtgggggcaaagagaactgacttgcttaaagtctcacagctagtaagtggtggactctagaactgaaaatcaggttgaactgatcctagatctcattttttataaagctccagtcactcagagtttttcagtccaaatcctagggccagagtgtctagacttttgtagatttgaacagatattgaaagggtaaatgaccaaaggatgaatagaagagagagccaggagcagaatctagtagatctctttgctggggccccataagattcagtagatttaaagtctcccacagtccaaggtttccatgaaagttttgggggtggttatagtgaccaactcagtgggctcctttctgaggcaggctctgatttttactttcctggagggatttttttggtgccccacaccatgggacaggctgaactagaccatggtactttctgttctgtctccttagatgacttgcacacgtgctcttgaaaaattattcagaaaccaccaggagaaagcagatccyytgggtatttgggaaaactgcttggaattgtctctgaaatttcagcatgttcccttcgcctttcctccttccaccaccattggcaaaggctctctcatttcactaatgagaggagatgartgctttggtgaaggccatagcaggcagagcaggcaaggaaggggcagagagccccttagaagtgacttcrgcattgggtatagagcacaggatttcttcctgccctttgcaaatagcacactctaattagcattgcagaattgcttatcaatgcagaatttccaagtgaggctgttttaatgcaataccagtatcctggtataagaaaagaaaacagaagaaagagtaccatgggtggggtgattcatctccctgagactcagtttcttcattttgagagaggaatattaagaattctcagcagggttgttctgaaatctatgcaaaataatacagggcctggcatgtaagaagtgttcaacacttgtcaatgttcttctttcaatgatccaaacatgttagccccctgctgaaaaactcagaaaaactccccattgccctcaggataatgtcaagttccaagcattggcaggattttcctaaccatgtttcctagctcatctctcttgacttccccttcatctattatttacctttttttggatatacccctcgcagcccccattatgtgattctttcctccctctcccgtcctccctctcctgtcctccagcttatcctcttagttgaaactcagcaatcacttctccctgacctcctctcagtccgcctctctgagcacttcctacactgcatcataagtgtacgtggaaagatttcttatccttgtatccatacaataccctagtgggtatctagtcccttgctgtggagacaaggatgaagaagacacagatgaatggcttctcccctcctgcctcagacttggcagccatcagaaaatatgcacatctggctgggcgcagtgggtcacacctgtaatcccagcactttgggaggctgaggaagatggatcacttaaggttagaagtttgagaccagcctgaccaacatggtgaaaccccatctctactaaaaatacaaaaattagctgggcatagtggcataggcttgtaatcccagctacttgggaggctgaggcaggaggaccacttgaacctgggaggtggaggctgcagtgagccgagattgtgccaccgcacttcagcctggaggacggagtgagactttgccaaaaaaaaaaagaaaaaaagaaagaaaatatgcacatcttacaattccctttcactgacattttaaggtttcctatgtatagcacatagcttgtgacaaaactgtaaattgagcaaagtttcttcttcctatttgtgcatttattatttttttctccccatatccctactataattaagcagacattccaaaatttaagaaataatttttacatgcaagggttggcaatttacaacacttatgtgtctctcttatttccatacacacattttagaaaactctctggaaagggcaatgggtgaaagaatgggggccaaaagatggagatcttagcagcaggcaaaaattgtagggcagtattttgggtattagagagagggaatgcccactttcccggtgttccttaaatacgtaccacatattaaaagatgcaaaagacactagctcttctagcttgttctcatgtgtcagtcattggagcaggcttgagctgcctggtcctgtagctgtatttctattatgaacacagtggcctgcatcttggttctgccccttatagagatgagccctgaagcaagttactctgctctctgagcctttgtgtcctaatctgtaaaatgaaaacagtgattcctatttttgtagtagctttagtaggattcgtgaaatttggtggaaagcctggaagaagttgataaatgctatttttataatttgtccaggatcttctgaaagtgggcaaaggacttttctatcttacacactggctctcatcactactggctgagtaagctgatagcagtgtggtttcttcctcggggaaactccctctagatcttacactctcactcttgggtctttggctactatttctagttgaaaacacccttctgatgacatggtaagctttatgaaggcagaaaaagaaccagtacttctctgaagcttctcaaagtgcctgctgcagttctgaggatgcagcaaacgtttgctgacgcaactgtgtttaattcaacaaaatgttgactgagcttctgttctgtgtgggtccctagagccagctttggggggagtgcaaagaaggaaacctgacatgaacaagacagagaattaacatttgaactacccatcaagttaacaaacccagcacagagtgttttctctgcatccttcatttctaccaggtagatatcattcatcttaatttctaccaggtagatgttatcattctcattttctacaggacactaagattcccagaagagtaacttactcaaggtttccatgtcagaatggaatttaagagagcagagccagatctgcatgatttctacttcacctcattaacggccatgctctctctctctctctcacattcctcagtgcaggactcaaatatatttctgttcaatcaagtgaataaataaattaatgtataaattgttatattacaaggtatagtatggtttgtattttattttatttttatttttcttgagatggattttccctctcatcaccaaggctggaatgtaatggcaccgtctyggctcactgcaaccgcttgaaccgggttcaagcgattctcctgcctcagcttcccaagtagctgggattacaggtgcctgccaccacaaccgactcaattttgtatttttagtagagacggggtttcaccatgttggtcaggctggcctcaaactcctgacctcaggtgatccgcccgcctcagcctcccaaagcgctggaattacaagcgtgagccaccgtgcccggcctggtttgtattctagtagaggcatgaagtattatggatgggccaaggaatgataatagcaactcaaaatgaagtggccaaggactaatatacccaatcgtgggttaatgggacataaagtcagagaatcaattacaaagaaaagaggcatacctaggtctcacctgccttctagtgcaggaatcttctgttcagtcagctgtccagcctgaatgccttatgttggggaacttcttatatcacaaggcactccatttcactgtggatagttctcattctttgaaaagttttctttactttggccctcaaactactccccttgaaatgcttagtctaagttttaccctcaaaggattaaggaaataaattggttggttgactgaaggtctgtaatcccttaggagagcactgtaaattccagatagtcttagtatttccatttcctcctcaggccactgcaaaggagggaggtgcctgtttggataggaggaaacagactttggtagaaatgctggaggccggggtaaaaggaaggaatatcaacatctcattttggcatccttttgtgtaaagcattagagaaatgtgaaacatggagaccaaataagaacaatacaagatatttgcaagcacttaaaccaaaccaggttctgaggttcccagaagagagataacttgattttttcggttaatttccatttttttctgtctcaggaacttcttgattccagctgggccaggaaggtgcatggccaaaatatccaaagaatgtctcttattataggatgttcaacccaatttgcacaaccaggaagttttgatacttctgataagatttggatatgagactcaatgttcagggttagctttgccctaaccaaatttgggaatcatgtttgaaaagaatgaacgagaaacactggaaaccattagatatggcaggcttttacaacatcaaaactgaagttttaatcaatattctcaagccatatagcacaatgcatgttgtttctttgcagtagtcatagagatcctgcagacttattgtgataagaatgtgcctttgatagaattctcactcctaactcttgtacagtgactaggtcagaggctgggtatttcagttcyttggtttcttccacaggctctagcacagaactaggcacataactccaataaacaccttcgcatttatcatttttattgcatcagggaaagacagaaagtgggaccaaactgaattgtaaagaggaaatgggaatgactaggttatttcatcattccctaagttaatggagtgtcctagggaactccagggcatcatggaacagggscaccttgtcagggaatgggaacagcctgaatttgaaggtatgggcagtgactataagtttgttcaaggagaactgaagtacctcatgaggtctgcagagtgacactcaatgctgagatctatccatctaggagtctttctgcctgttttgtagtgaagttttccaggaatccagccacttccaacttttgaatgtgacctcatgttcccaaggacccactgtcattcatcttccatgagattcttctaatcctagattcttcccttatggaccatgtaacttatagtgaagccactgtgttcctcagtttctccaaggtagacaacaattcctaccttgaagaatgacaaggggattggctgtaatgtgcatacatgtgtccagtgcctggtggaccttgataactactatttctttcctgctattctcttctatctgctttggtactcccatgctcctacagggccttttggtgtgtaaatttgtgtatgtatgtgtgtgtgtgtgtgtgagagagagagagagaagagggagagtatgagcatctggggggaaagtgagaagcacatgatacaattcccatcttcttcctaagcccaacttytaagagcctcccagctcctcctctcaagctatcaacatcttcactggaagccctgacagggtgaaaattaactaccaatctcttctaatcactgtacaaggtaatgaagagcacaattatacttcctcctcattctctgttgttggaaggaaggtacgtttacacttcaggaatagcctttacctctaattatgcagactccgtgtgtgtgtgtgtgtgtgtgtgtgtgtgtgtgtgtgtgtgtctgtgtgcccacgtacttgtgtatgcgtgtgcctgtgcctctgtgtgtggtggtggtagggtgtgtgtgtgtgtgtgtttgtgaatgacttctaggtacttgctttcagatgaggaattcaggagacttttgttctgctgccctcttcctggccctgcacccagcctgcacacatattccctccccgaccctgtattctccagtgagctgatctcattatggcaaatttagttacagctgaaatctccttgtaacaaagattatgtccaagcccagagtaatggaacctagtcgatttcattaaaataaaattggttacaatgaataattcaataggatgattttgtttcctcatctcctctttgtagatcgaagagctagtatttataatgattttttaaattggatttttgtttaggaagagataatcaccagtaattcctgacagcccccccttacaagattggaataattgccccatgaagcttcttttcaaatgctaagactggaaaattctttctctccttttctcacattagtcgcaataacatttgggtgatttttaagcacagctgctacctcaactcttcctcatgggaggttctgagtgtgttaataattctcttgtttgaaggttgtttttaaaacatttctaagaactggatgctagtgttgaatttggattccttgttctcttgctggccccagcactgttgtttctgaagcaggacattctatgtgatagagaggcaatgcrtgagtgttttctgtcagtgtcgttcatttgcatgtggcaatgggatgtatgtatgtgtatgtgtgtgtatctacagtcaattaaacacacatttgctgggcacctatctagcctttgcttgaacatgagaggacaaagatgaataaactgaaacttgttctcaaagaaccagcagcctaatgggggagccagacagacaaatagatacttcagagttcagtatgataaatgcaaccacacagatgattccaccaagtacagacgtggcacagggggaggatgaaccctagccattcatctatctgtgcactcattcattcattcattcattcagcaggctggcactatacattgttaagcatcaggaaatgccatgttaccatttgtttccactctcctgagggcattcaaaaataaatgcaaatgaataaaggctttagtgatgtaaacataaacaaaaagtgaatgaagaaataatcaaatacaggcaacaactaaaaatgaggtagtcctattctgtacctcacccagtgattcttcacttgaccccagaggaaggtcatatctttctttcatctagaagccagggctacccgactaaacctaaatcaagaaagcaatattggaaaggaatgcctgggaatagcagctcatctgcaaggccaggaggcaggctggtctctgaaaggccactaggccaggcagccagaagcactgagtcgtgtctctgggaaatttgagtctcggggaaggcaggtgcttccttggtaggataattggaaagggggctctcgggacagcatgaccatctctagaatcatacaagcactagtggccccaaaactctcactccctggactaagctgtcagtcccttggggaagaactgtggcacataaatagtgcattaggggactgaggcatgagtcacagcttcttagaattgggaaggcccttggagatcaacaagctcaactactctttattttaaggatgagtcgaaaaatagggcccagagaggtgggagaactagtctaaggccacatagcaaattactgtataattactgttaattcaagtagtacacagcttggcgccccctaaaaagtgggacttccaatataaattcattcttacctcattgaaatacatgatatatgcaaaatggagttctttctccaaatattagttattacaggcaaggaaataggaggacagtcattaccctatcatacaatgttccctgccctaacaattccagatctaatcttttacaaatggtattcatgaagccctaacrgtacatttaataaagatatgctcaagtggctatagccaatgacactgccttagaggtgagtagccttgtggggcatagcggagactttgaatgtctgcaggaaatgccacacatggttaggatcttacctgggatgctgctggctgtccgatgatgacccagcctgggcattgctggtcttgatgagatactgaagcattggatgcccactgatccaggaatccctggggcgtgtagacaccacagtccttaatgctggttttttgttcaaactcctcacataccccatcaccatcatggaaatagcaccggctrggttcatctgcaaaagattgacatagaaagggagagaataaataaatatttgttctttggccwcagcaatcatcagcagctgcagagtcagaccaccaaaaccattggtactgtcaagcccatcacattagtcacgatggactattactcagtcttgaaaaaaaaagaaggaaattctgtcatctgcaacaacatggatgaaccatgttcaaggagataaccatgttataggaaacgtggaggccaccatgttaagggaaataatccagtcacagaaagacaaatactgcatgattcgacttatagatggcatgtaaagtagggaagctcatagaagtagaaagtaaaatggtggtttccaggatctcgggggaggaggaaatggagagttgcttttcagtgagtatgtggtttcaattgtgcaacatgaaaaagttataggaatctgctgtaaaatagtgtgcttatagttaacaatattgtactttacatttaaaatatataaagaaggtagaccttgtgttgtgtgtctatactgtaataaaaagttcacaaacactttcaccttcattattcraaatattcctcataaaaacttcatgtggaagatattattcttccagatgaggaaactgagattccatacatctttaataacttgcccaagatcacacagtgtgttaatacctgatctgggtctccaactcaggcattcactttccaagttctgagtgcattatttgacacaaargaatttcacagaggcaaactgggggttgtttaactccaaagaggatttcagttttgctttaaaacatgaactgatttacaagggacattggcttcaattccagctctgaaaccaaattgctctgttaatttgaataagtctccttgccacactgggctcaaccatcagagcagagaaagaggttacactattgagacaccaagaacccttcctgtctaatgctataggcttctaagggcttgtcggataccctaggagttttagttaaagaccaagtgaattctcaagctcccatgtcatctagaccacagcaagtgcttctgtttggaatgatttaaagctgcagccggctgcaatgattctcacttagctgcaaggacaaggataacagaagcacaaagctagcagtaggatgccttctaagtaggtgtgacctatgcatgtttcttgatatttcaacacagaacaatacaaggaaaaacctcaatgtggccaaccaaaagagatcaccttgtccacctttttactaattctagcatcagctcttctgtgctattttcccaacttttctaggcaaagctaaataccacctcctgtgtgggtgcctattttataaagatttctatcttaacacttatcacactgtgctgctattaagtctacatgttgcaggacttttgaaagattctgagctccttgaaatatagttgctagccagtgtcttagggttactatataatttatcatccaaaccagagcactttgaaaatgatagtggtgctattaaaaattatgtccagacaaaaggaacatatcctgggaaaatctgaatttctcaggcaaatcaggatatatggtcaccctaaggcttctgcttgatttagaacattcttccacaaaataatagagtggagctctggagagggcactgaatttagggccaaagacaagggtttggtttctgtcccttacattagctatgtatctttgcacaactggcttcacttacttcttggcctcttccccctgtccccagtctgtaatgtagaaattatagtcccaaccaggaaaacctctcaggataaccatagaactctaataggaaatgaacataaatgtgctttgtacatcctagaataatcatcgagagaaaaaaaaatactcttcttttaatgggttgatttgcttctaagtggaggaattaaatcagcttgtgaaatcagtgctcacttgaaacacattcaagcaactttcccctagctagaaagagcccctgccaaggagaaacaagacagatttctatgatgctaagtatctgaaaagaagagtcattggattcaggggcaccagaatgctgaacttcttccaagctgcaaaatcccttgtttatttctgccaacagtttacccagtgaaatactatcaaaagagcccaaatagggccgggcacagtggctcatgcctgtaatcccagcactttggggagagccaaggcaggcagattgcttgagcaatcagatgagcctgagcaacatgatgagaccctgtctctccaaaacatacaaaagttagctgggcacagtggtgcacatctgtagtcccagctactcatgaggctgaggtgggaggatttattgagcccagtaggtcagagctgcagtgagtagtgatcacaccactgcactccagcctgggtgacagagcaagaccctgtctgaaaaaaacaaaaaaacaaaacaaaacaaaacaaamgaaaaacagaaagagaaaagaaagaaagaatgagcaaaagaaacagaataaatcaattcattataagtgaccagtagcattcatggcagttcaatatagaaagaatacaggctcagtacttctcagtagctccaacctcatgtgaatgtggccactctacatatcgtataacctaggcccaatccaagagtgaccagccataaatccagactttactcttcagaaacccaatacagagaactgaaaagagcaagggttttgacatcaggcagaagtaggtacaaatctgaattctgcttcctataagcactacaaagaggacataaataaaataacctaacctctctgaacttcattttcctcatctgaaaaaaaaaaaaaatggaggtaatgatatttacccagcgttgttgcagtgatttcagatgattgtgggtataatgctggccccttcatccattttatctaatggaaaactgtgagcttgaggaagaagccatctgcttccaggtcacagagacaggtggtagcagagcaagaagtagaagactggcctttttacacctagcagagaaatcttctccctacatgccayagctacagaatgacgaaaacaacctcttggaaataagatcataggggtgcctaattcttggtatcactttcttctcctccaatgtaaagaaaaatagggtaagattatgttctctgtaagggtaagatctagtctctaaagtgacttaatttccttagcaaaaaacctctcggaatgacagaaatkggggttagattttagttcttctaaaggctaatttcttcctgattatgttaaagaccacaataaatttgtctgctaggaatcagcagaacctgagaatggaggaaaggtagaaatagacacaggtaggtaaacaggtatacaggcaggtcgataagtaatagatgatatatagatacgtagaggaagagttaaaagacagaaaaataagatggagttaaaaagaaagcaagggagagagagagaaagagagacagaagatgcagtttcttctccaagattctgctgacaaagctattgtgagtctctttttaaaataacatccttggacacagctattcagtttctgttgctattagtgtcccgggggcccttcagctacatctgccagcccgtgtctggggaattctctctccctctctactccctctgccccaagcacagaagagaacagagtgaggaatggaatacaaatgtgcggccgcaaaaaacaaagacagcaacaacaaaacactaaaacaaactggtcttgttttcattacatcaatttacttggtgctccttaaatactttctgctagatgctgagcaggttgtagtgaaaagagtctgaagtcaataccaaggtcaaataacttccgtgtagtagctaggtagcattgataataatacagtaaatttcactgtgagggatactaagaaaattatacacagacatacacattcatgtgcacacatacacacttttatacacatacacatcctgaaaacataatacactttcaataaatatttgttgaatgaacgaatgaccaaaatctggcatccccgatgtatatactctcaaccaaatacagtttaaactctgtaccctttgactattttctttagactatgtcttagggagaaggaaatggagctgtaagccaggtggtgactagctgatagtgggattgcactgggcattctgatttctccatcccacgccatcttcccctcatatcagggaattcctcacttcagattcattccctttcatgtggtgacacatttagaaatctgttctatccagctaggagacttgacgtgggtaggtgccattagcaaagtctgtcttctccagttgagatttcatatgccagaaactttcttttccttttggaagaaatgagttcagcttcaagagcccgaggcagatggacttggtgtaagtggacagacatagttgatactgccaccagctgacttattttcatttatctggagcatcaaggtgaaatgccatgtccctgagttcctgaggcatgtctgcaggacactacttaagatgcacagagatcgttattcccatttgaaagcttggaaaaccaaatcttaggaaaatgatattagtttaccttgaagcaaaggctcaggttagagctattgttaagagttcttatccttgaagtcagaaatcctggattcaagctcttgatctatctctgattattggttaatcttggacatggtatttcacctccctatgcctcagtttccccatatataaaatgaaaacaaaattacattttagactttctcaacaaggttctgaggatgatcaaatagcataacagactgagatgggaaaataatactggtcttaaagacacagggtctattcttaacaatgatgataatgaggttggagttggagaagaagtcttcttaattagagattctacttttctctacccagccctagaccctaaggtatcttgaaggatagacatgattaaagaggatgcatgagctattttcaatataaatgccaaggaagcaagtaaacaaacaaaagaaaaaagtaacaacctaaagaaaagaatatattgacttacattggaatgatttcaacacaattggtggacaataattaacttagctgaattagaaactttgggaatttatgatgtcactagaatcactcaggtgaataagtgacagaaatacctaaagaggttaaagaggtcagagctggagaagggaggaagaaattaaattattcgtgtcttctcagtacaagatattagggataattttcacaaggaaacttgccttcacattgactctcatcagtttcaaaacgttgaacagatagtcataagttatcggttactgtaaaagctaactgaagtcaatgtgttcttcaaacatggcctgagataatgtgtattctctaggatagtgggataatttaaggtattttggctataagtcttctacctgacatacaaatcttaccatgcccctcctttgatagatccccactacttatagaaggtcattttctgccagacatggtggctcatgcctgtaatcccagcactttgggaggttgaggcaggcagatcatccgaggtcaggagttcaagaccagcctggctaacatggtgaaaccctgtgtctacaaaaaatacaaaaattagccaggcatggtggtgtatgcctgtaatcccagctacacaggaggctgaggcaggagaatcagttgaacatgggaggtggaggttgcagtgagctgagatcacgccactgcactccagcctgggtgacagagcaagactctgtctcaaaaaaaaaataaacacataaaaataattttaaaaaacatcattttccttagcttggcatacaagaccatccacaaactgtcctcttcatgcacattccacacgaacaattccgtttcatttctccacacccttacaaaggttgtttttctctgcctgaaatgtgctttccatttttcactttgctaactcccactggttcttcaaggttcatctagagcatctcctttgcaagtcttctctattcctcatccctttttcctgaccccaccctagctgagtgtcattcctgtgttatcacagttcctagatttcttccatcacagtttcctcactgtctgtctgtgggtctgtttccttatcaggcagacaagatctctgcgaacagaattgtggagtccttcacggtagtatttccaacccataacagtgctcagagtaaaggggacaccaaaccagtgattgaggaatatatgactagataaacaacaaatgaaaggtaacaacggatttatctttgagttcatttattaccagattatacatagactaaactaactaggtgcttgtgtacttatttgtaatgctattactgaccataccatgatagtactacaaaccagatttcatcaaaacagaggcaccttcttatagggtatgtcacactttttctaaaagatttatcagcttcactataaaatttcctcaaaccttgggattgcagttttcaaaattaaaccccaagggattgcttctcaaacatttctgagatgcccagctaacactaagaacccagtaattcatttttgattatttcagcaatgaatgagcaacagataagagctaccaaagctttctggagattttaggagtgagggctattgcaatccccagctaaaatatcttctaatcagtagatgagaactggagaagtctatacattcatttaatcaatatactaacatctgcttcttgttgtgctggtgctggaaatacgttaatgaatcaggacaggccctcctcctatcaatacttcttgggaaaatgagagaaggcttccttgacaaaatgatttgggagaaacatcttagagggtataaatagtttgagcatgtaaagagaggtgtctgagtaaaggataaactttgaccaatacttgagtaagggaatgcagtaaatcctggaactaatacagtaagaaactgatctgaagctagatttaaaaaagattgcaatactatgttaaataaatcgaaattatccttcagaaatgaggagactttgaaatttttcttttcttttcttttttttttttttttttgagaccgagtctcgctctgttgcccaggctggaatgcaatggtgcgatcttggctcactgcaacctcttcctcttgggttctagcaattctcctgcctcagcctcctgagtagctgggattacaggcacccgccaccacatccggctaatttttgtatttttagtagaaacggggtttcaccatgttggtcaggctggtctcgaactcttaacctcaggtgatccaccccccgttcagcctcccaaagtgctgggattacaggtgtgagccaccatgcccggcccacttttcaatatataattctgggagcaaaatagttgattacccttaagtaagtctcaatattacttttggaaatctctgatttcactttttgtaacattcactggtattggctaaatataactagtctgggaagctattgaggttactaatcttccagcccattgatgagccaaaaagaaaaccaaacatacacaaaactacctgtagatgaggagatgagagttcttagtcactaatttagagctcaaggagaaagcaaagattttgaatgtgcactcttctgaaatgaacctccttccaaacgatgagtggattcacctgtctttctaaatttcttgcaaataaagataggacagcttttgagaaattagcatctatttctatttctagctaataaaacagtgattggcattatgatattctcttttagtccaacgattacttttcaaaaagatctttaaaggccagaaaaaaagtagcatattttaagtttagctgtttatttagagatgggttcaataacaacagtctttatgccacatcacaattcttccaaacagcaacaaaaagaaacacccccacacacaacaaagcgtgatctttgtacttaaacgttagtttcttggaacagggggagcaggagtgcttacctgctgaaggtttacaaaggggaagcttgggtggggctgggaggtggctatatattggcatatgtttcctctgggacagaaatatcttgactttatatagcctatctttcaaaggcttcgtgtcaaacccacattgctgacctcatttaattctattcaaaccagggtttcttcttaacctcctcaaccagatcagcctgcccagagtacaaaagacagggtagtgagggctcctaaggaaccatgaatctgctaacaagcttcagatgctgattaggtctactgaaggagacctgaatctgaggagcttaagttggtttccagttccttcaaaggttggccacatacccacatgggccagaaattcctccctgtgtttcactgtgagaatcaagcatcctccaacaaactgaaggcactggaaaagaagagcatccctggaagtaatcacattatcacactaactctacactcaggcccatcaaggaaggcacctgtagcacagcctcatattctatctacttagcccttacacactcaaaactggctttgcatcttcctcacctcaatcccttctcacaaagcagcttatgaatctatgaatgatttatctaaaatatgaatattttcatgtttgaaatactttatttatttatttatttattttgagacagagttttgctcttgttgcccaggctgaagtgcaatggtgcaatcttggctcactgcaacctccgtgggttcaagtgattctcctgcctcagcctcctgagtagctgggattacaggaatgcgccaccaagccggcgaattttttgtattttgaatagagacggggtttctccacattggtcaggctggtctcgaactcccgacctcaggtgatccgcctgccttgacctcccaaaatgctgggattacaggcatgagccaccgtgcccagcctgtttgaaatacttcatagactcctacaaaattttaacttccccaactagctttcaagtctttttgtaatctagctccaactttcctatttattcttagttccaaccacatctccaccgtcaaatgcatccagttctttcccagaactcacatctcagagcatctgcccttacttccttagcctgaaaggctggtcctgcctatgagtcttccattaagattcagttctagcaacttcagctccatgacatctctcacttttctgcatcactacttgtttggtacaaaccatttccctctatttcctacatcattagtctcccaaatcagcaaaatagaatatagcccatctaaagatttaaaaatgtaaaaattcttgaaaaattcaaagtttttaaattaataaaaacgcaaacctcctttcattctgttatacgtctcctaaatactatttctcctatcccacatctctctttctatgattcacagtaaaatttattgcgttatctaaactagtgttattcactttgtctcctgcacttcacctatcggttctctccagtctagcttctatactcaccactccaccaaaatcaatctcattaacgtcgtcatcaacctcaaagttgctaaagctgagcatgatgtcaaaatccccatcttgctagactgccttgaagcatataaagaagtagccccctcctgtcttcttgcagtcctccctctcttgacttccatgacatcatgtcatcctagttgtctgggatcctcccccacagactcatttgagggcttctccttccctaactctacatggaatgctgccagacttcagggttagatggggacccctttttcttttttatctacagtttctcatcctgtctcagtttctaaataaaaattttaaaacctctatgtgccaatcactgaaacatttatagccttagatatgacctcttctctgagtcccaactgcctaaaattatatctctactaaatatctgcctatttaaaggcatcacaaaatcatcaaaagacatcaaaaaacatatctaaaacaaaaatactgatttctccccacattccctttttctccaccttagtaaatgacaacaccatcacttaacaatgaccaaaccaaaaccttcccagtcatctgtcctactttttttcagctcaccctttaacaccacacaaagtccatcagtataccttataggctccttttccctgggatatttaaaatagatctaatttgttctatcattaccaccctagttcaagccaacatcactgctgcaattctcacttaaccagcctatctgcttctcttttctcaaccatttgtttcccaactatccctccttcagaacagctatagtgctcttctaaaaacgtaaactacgccatgccatgcccctcatctaaaactcctcaatggcttaacatctcatgtggaagagttcaaagtctgtatccaggcctacaagcccctgctttatccctccatcttctgttactgtcctccttgctcactaccttccattcattcatgcattcattcattcatccagacagacatctatcgacacaacaagtatctattccttaagtaagcatccaagaacctgaacttgatgttcacattttctggaatatctctttcttggcttttctcatgacctcttcattatttagcagtcatttcaaatattcaagtaacaagcagttaattcacattctaatcctccatccccactgcaaagtagcataccatattgttttatttcctttactgtagtattcactattttaaatatttattttatttaaaataaataaaataaaaaataaaatatttatttattattgttccctgctcccatacaaccaacacaagtttaatagaagcatgtttcaaagtgcatcttttccattagggtcaagaaaactacctggctatattatgtcatgtttaaaaatacatgaataagtgaataaatgaatgattttgtacagctcttgaattttcagatatttctggcccttgtcttactttaattaatatcccgaatacttaggatagtgtcaatctcatagcagatactcagtaaatgatgaattaacaaagttattttggagttttagaatctctgttatcaatgattctgaagatgtcccaaacctgatttcaatctgctttagcagatagtattatgtaaaaatttttatgaaaatattaattataaagaggtcagagcataaatccaagcacatattagggggaaaatccaattctacacaaattgtcccacaatatattttttttcctatgagacatcatgcctcaccatctgtcttatatattgttttattttctatcctaactgaatttgaaaagaaatggaatawctggataggaaaggtagcacatattagagtaaaatttaataaagagatttgacagtcttatgaattggaacttgaagatgcatttacatcaccttaaatttagtatagtaatttgaatggcttaaaaagattgtaagcaaagatagtaatccttataaatgacaatgcagccaacagagcagaatgttcaaagccctaaatgactttcagccagttctcttttgggtttcaatgatatctcaagatatgaaagaggcggtaraatccagtgtcacatgaattatatagcagccaagagataggctggcattctaaccacaaacagaaggaagagcaatacctaggacccaaaggtctataaaagtatgggcaggaaataatgaaatgaaatttggcctggataatataagctaataaayggaaaaaaaaatccaaaacatggatatgcagagagtgtgcaaaaagtggcaaagaaagagggtaataaaagatggcaaactacaaagggagtttcagcagttttagtgtgattgtatctccatattaaaaaaaagagagagagaaaggaaggaagaaagaaagagagagagagaaagaaaagagagaaaatatgagacactttctcaaactctgcagcctgctacagtaatggtcagggagtcaagggaactggagattagaatagatgccctgatcaaccctatgactttggacaagtcactttccctctctgggctgcagtttccccttgtatagaataagagttaaatcaagtagctttgtgatcccttttagctgtgtcactctaagatatatttggttcttgacattttgccctttgatcactaaatcagttattcagttaagaggggaaacatgaaaaaaaaaaaagatggagaaacatgatcagcaaaatgaagatcgagaagcgtgtagatgatgaacccattctgaaaaacatgcatagaactataacgaaaagcagatggaataaggggccagaaggtaaagtgtgtgcctcaactctgttgctaacttactttcatggtaccagtaacatacatcatcattctgcatctgattctttttgcttattaaaaaaaatgacagcattattttcctacccattttcaaaagtgggtgtaaagataaagtaaaataatgctgtgaaaactaaaaactactcaaacataaaaactataagctgtgttgttttcacattttacttttgcagatacaatccagacctcatctccccarttatcaaatggcttttctaattttttgtttaggtcttagctcaaccattaccttctcagtgaggacttttctaaacacactatcaamaaatagttttcaccttcactagagtgtctataccactrgtctattttattcccttcatagcatgatctcacttcttcaaatgtttgcttgataattgtattctctctaaaacagaatggcaactccttgagagcagaaacataggctgttgtgtgcattgttgcagtcagatactagtacatagaagataatcagaaatatttgctgaacgaatgaacgttttaacactgcaaggttctctagacattctatatgattctaattcctgtgcttctctgtataaagtggcaactgaaacttagaaagattaagtaactcactgaatgctgcataawtgttagaggtcaagggttctgactggctgattaaggcttattatacaaatattgggaatattcaatgtcaaataaaaattgctctgtgagaaatgcatgtttgtaagcattaagtaaaacaatgcatgcaaatgaaagtctatatatatatatgctatatatatgctatatatatatagctatatatacatatgctatatatatgctatatatatgccatatatatgccatatatatgctatatatatggcatatatatgccatatatatgctatatatatgctatttatatgctatatatatgctatatatatatgctacatatatgctatatatatatgctatatatatatatatatatatgtatatgcatatgctatatatatgctacatatatgctatatatatatgctatatatatatatatatatatatatatatatatatatatgtatatgcatatctattctgcaatccagtaaaacaagcagcccgtcattctgatagggcatgcataagagtccagcaaagaaagaagcttggacaagtggatgctatgtctaccagtgggccaaggactcgaggatgagtcaggcaccacatgaaaaccaagccagttaccccaatctggcatagctggttgtgactaaggtgaccgcagcatgctatgttcttggcagggctcccatgcagaaaccagagtgttaaaatggatccctcccaccctgaactctgactggtttggttcacctcaaagaccatcctcctgctatatggtttcgataagtctaaaaagatgagccattcaagccacagtgtcttctatctccaagctggtgagacacactgcagtcctctacagaacagaagagagacagtgcacargattgctcttgggtaagttttctttttcttatgtaatgaatgggttactcttcagcccttagaataaaaatactataataacttaaatctatatgttctgatttgtattgcttagctgtaattttcttctttaacaaggtgtgtatatgtctttctcatctctcagtaagaagagggaaagcagtgagagaaggaagaaagggaggcagggagggagggagggagcaaggaaggaaggaagggagggagggagggagggagggagggagacagaaataaattggtcctaaatcttttctctttttctttttttgacacctgggcttgagtgcgctctgtcacctgggcttgagtgcggtggcgcaatcttggctcactgcaacctctgcctctcgggttcaagcgattctcttgcctcagcctcccaagtagctgggattacaggcacggaccactacactcggctaatttttgtatttttagtagaggcagggtttcaccatgtttgtcaggcttgtcttaaactcctgacctcgtgatccgcccatttcagcctcccagagtgctgggattataggtgtaagccatcgcgcctggcctggtcctaaatcttaagagttaactgggaacatttgaaaatatcaatcaaaaccactgccctttttgatcagggatgataagagtcatcataactattcatgttcacgaaaagttccaagaagcagtcactctgaagtcagattccgccaaatgaaggatgtgtttgcccaaacaaaagcatgagactgcagattgagtcattggctatagattccaagctagaggccagagaagttgtctccagtcctagctggaccagtcatggctgaagaggccaattctgggccactgatgtggtaggatatggtcaaagaataggaccctggataggcaccaaccactgagcaataatcatgtaggtatgaagatgcttaacctgaagaaaagaaggctcagggaggacacaatggaaaactcttctaacaaagtacagttggtctaaaattgaaagtggttgccctagaagatactgagttattcattcaacttttcccaacaggagcttgatgatgattgacaaggtgtactctggtccttgcctgcctctgcaggcttctctcttctcgaacgcactctagtctaagctccagacacaaattgtcgttgccctgagtggaccatgttccctctcacctccccacgtttgcagaagctttcttcaaatccccagagctgccttttctgtgactagtccccatttgtcctttattcacagtttaacctctcaaaaacctgcctggaaacccacccccagaagggctaatggaccctcactaggtcttcctataccatcatccgcttccccagttaaaattgtacttagcgtatttgtgaaatgaataactggatgactttctccatgctgggcattgtgctaaatgtttcaagtacataaggcattcaaatctagaagagccccgtgtttggtcctattattatccccattttacagacaatgaaattgaggtttcaagagggtaagtcattcccatgctgtccagttaatctattttgaatggatgtggatattcaggagaatctgatgagatgggctgatctgattctctctcggatgccctatgatttggcactacttgggggctcaggggcctgatggagctgtgatcacaacctggctcttcactaattagctggtgtcaatgaccagcacactttagccctgagtccgtttcctctttggcaaattggcaaaataatgactaccttcccaactgttatgaggacaaaaaaatgagaagctgttgagaaagcacgtagcaccacatccagcatttaaaaaacaaattttttaaagtaaaagatgaggagtttccctttccttaaaggaagtaatctgtctctgctaccttgtgccacagttaaactgcacaggctcaataacttatgttttggttaaacgtttttaatttttttagagtgaaatccgagtttttgttggcaagtgattgaacacgctgggcccagcctgcaggcccacagtccattaggaaatttacgaggcgagatggggaccttcagctcaagtactcccttcagacgcagtacttacaaagccatcaatttccttaacaaagagcattggcttaaatgccccttaaagcagtgttatttacacagctatccacttccttttgaattctctgcctggggggtggcagacctgcagttctttccagctacgagttaattaggctctctccccaaatggaagcaagccgcagactgagatttggtattaaaaagcagctcaatttggggccatccgagagtcttatggggtgatccaaataccaccaaaatcactggttccacccacccattcttctaaaattctaaagcctttggaccttaccaaagagtaatgacctctgtcagtatagagatagagaaggaaaggcagcatttgagcccgtctctacttagtaaaagaagcctcaaaaaagtactgctggctaagatagcatactttctacctcttggtgtatcgatatagtaacattaacattttaaagaagcccccaccccttttgtgggggaactaggatttggatacaagcagcccagttcaggggtctgagcatgaaaccaccaccccaagccacctgacccaagataacctgcccgagatgacagctaagggggaaagtctcctattcaaacaggattgtctgactctaaagaccagcaaagctcaactacactttcttgcctgaaaaataaaactgtctcttaagaaatacatccttcttttactcatttattctatatttactgaactgcaaattatttgtcagtccctggactaactcttgggaaatcagatgaattaaagcaggtctcagtgctccaagaactcaggtcctagtgagaggggagatatgtaaatgatgacggcacaggattctgaccctcatgaggtacaagatactgtgggagcacagaggagggacccccaatccaatctaacccagatttaagaaggtttcccttaggaggcaacacctgggctgtatctctcagaggaggaacgggtggtgaggagcacattccagcagggggacactgtgagcaaatgagatgaggccagcaatatagtaggaggtataaagcacaagatggtattggagtataaaatgcaaatcctggccgaggtgggcaggacacaaggtcaagagatcgagaccatcctagccaacatggtgagaccccatgtctacaaaaatacaaaaattagctgggtgtggtggtatgtgcctgtagtcccagctacttgggaggctgaggcaggagaatcacttgaacccaggaggtggaggttgcagtgagcccagacagtgccactgcactctggcctggcaacaaagtgagaatctgtcaaaaaaaaaaaaaaaaaaaagaaagaaagaaaagaaaaagaaaaagaaagaaaaaagaaaaagaaaagaaaagcaaatcctgggctcagatcacgcaaggtcttaaatgacacagtaaggaatttaaatttatctcaagggcaacatggagccatctgacactctcaattggagagcaacaaaaggtgtctgcactttaggaaacttgctctcacctatgggcaggtagattggggcaagcaaaaaaatgaacaagcaacatgttcattttacaagctttctcttataaaagcctaatcaggagctgaagagggcctcaggtagagtaatgatcatggggcgagagagactgatttggacgcagacaagataacgttttcaaagtaaaatgggaagaatggcaattatttggatgtgggaaatggcagagagggaagagttatggatgtttcccaagcttctgtttaaatgtctggttggctactggcgccaccagttgagattaggaaaaacacttgcagcaggtctggaaagaaagatggcaagctttgtgtaagatgtgtcgaatgtgagttcccttggggcgtcaaagtagagcaattagatatacaagttcatgggtcaaaaaaaaaaaaaaaaaaaaaaaggcccagactaaagatagagattttggagtcatacaaggagagaatggagaatgagaagtgtgcctattatggaacattggagactgctgatacttaaagagtaggtgaaagaaggtctgtggagggatggtcagaaaagttaagaaaaacagaagaggctaacacttcacaggtaccaggagttctgaatttcaagaaagagccagataagacaaaagagaaaaatattgaaatatgtctgtttgaacatgctatttaatagaatctcatgcatgacttccctaaagaatgattctcaaatttctgctcaatctcttccggggacaggtcactctctacttgtgagtaagaactagattattatttttgttagccataataatcaatatttgttgatcactttctggaagacaggaactgtcacaaacacaggcatccttggtgtctagcatgaacctggcacataagaggtgctcaataaataaaagcctatgtgatgaatgaataagtttataaattaataaaacaatatatcataacaatcatatgaagtcaggaatatcactcctacttctcaggtggaaaaaggtatttgggggatgaaccctgaggcagacaagtggtccttgtgcttcggggctggtcaatcagcttttcctccctccctgtccctttagaagttctcttggcaaaatgcacacgggacaaatggaaaagggatttcagactcttgtggagacccttccttggtaatgaggctgaactcaagctatacatgtggttttggactcctaaactgaggaaccaactccagccaggacctttcagagtcctgccaatggcggctgatagttaaatttaaacttacggataatttgggctgggtttctgactgctgttgaaagctaaaatcaccctgatttctctttgggtcagtttgccaagagtattttgttggcccttgaagagcatcccattcagggaggttgatcttttttaaaatactgctcctatcatgttatgcctctgcccagaaactactgcttgctatgggatgagaactgcccactcaccccctgtgacttccctggagtagtttcctttaggactggtgcactcactgtatagagaaaaaccctctgtctggatctttatagtggcagagtgtcaaacctggtcttatctgagtcccactgtccagaaatctttcccaggctcaccaacccctgcaccagaggctttccactgctcccagggggcctctaatgccaatcccttcatatctttaatgaccactgtcttctgcagccctctaacaaaggtttctgctgcttaaccctgcattgcacagaactttgtatgcagcaggtgcttaatatagacaataatcagtgtgagcctggtcacatgcattttaggctgattgcaggaccaccatggctgctgcctggaggagagagaaaagcaaccgtgtgcatgagggcagagtgacaggcactggacctgggctattttatctttctgtccagtaagataaaatgaaaaaaactcagtcctttaataattattataatttcttatttgctttatgttaacatctctttggtacttaatcagtattggcttagagaaagtcagtggtttttagtttcttcctctgttaagtatttaatgatctgtaaacaaacacttcagacagtgtttcttaaaaagaccctgggatccttttgttatgtgaagatttctttagcttcctgcattgtttccccttctcattatctgtttgctgctaggctgttcagctcttgagagtacacactttattagataaccttaatgatggagatgtagcataaattagtagttaagcctgagggcttaagagccagagacttccagggctagaatcccttactgggaacgtaacatctctgtgcct

SEQ ID NO: 17907 - DNA, 108773 bp, Homo sapiens
  misc_feature (1)...(108773): n = A,T,C or G, or insertion/deletion polymorphism (see Tables 1-2)
ctcaatccattgatttctaggtctattgtgtataagtaatacagtattcacttgtaatattgcattcctataaggttaacggttaaaagaagataaagattatgcaagaaaatgtcattatcattatttgaaaagctatatgatattactaattatggcaaaatttatttgccttaatataaaatcataaacttaggtgcttattcttgttaatctacaagtgaagatgaaatacagagctcccaaacatgcccgttcatggacttgacttagtaagcctgagtttagacagatatcacaagttctcagatataatgatgcaaatagatacagatcaatttaaataaaactttgtggataatacaaattaaaaaaattattccattgtaatttttaagcttaaaagtttgtgaatctgttttctctactaaaaataaagaaaacccttctaggatatctgaaatgaaaattgaaattaaacatattcctttctgaactgtggtttaattctattccagaagtcaacttgaatataaaagaaggtgagaacgcaggattctcagataataactagatatttaagtgacatttttgtcaaaggacttgattaataaaactgaattaatgtgagggcttttatgattagaaggatatagactgaataaaaaagaaggggaatacaattacctggtttaaagctaagctatgcgatattactaattaagctgagggaaagatttctttttcaaggagattatcattgaccttaaaacaaaacagagaagttaggtataatgcaaaggaaatgcctgggaataaaaaactaatgtctgagccccatcctcagagattctgatttaatcggtctgggaaagggccaaagcataggagatttctcgagcatcataggtgtttctaaagtcaagtttaagaaccactggcagggaaaattaagaacataagggaggtcatataccgtcacccattttatgcttttatggctgtacttcaatgctgttgcttaattctcagcagaaagcaaaattagagaattaaagatggaaggtggacttagtgggatcgttagttgagagagtttagggttgcctagaagaagaagaacagtaaacattaatttaaaaaattaacaaatgtgcacattctgaaaaaaatttctagttttaattgctaacaacaagaagtaacctgttgtagactagacaggttatggctcacctgtttttaatttatcatataatttatgtgactaaatgtcagtgaaatatcaaatccaatataaattacttaacacaatgaaaaatgattctggagaaattatagttcatcagtactgtggagttattgtcaatgtgtattcaactataccctatattattattatgacatgaagttagtttctatttcttagaaggggtccatactaaacaagacaggattttgaatgatgaagacgtgattatcattagtaatatgagtatttgagaatgatctagatgtgtctaattttataactgtaacattcaaaataaaagcttatcaattctatttatatttataacagaattcatgttttttaagataaacatttcctggagagctgccagaatgttttaaacaatttttttaaaatttttttagtgatgattaaaaaccagaatgagttctttaataaaaatctttggcaagaaaacccaattttctctatgaatatacattcttagggtcagagggtttggtgatgtggtttaccaagtagagactgactaggttagttcaagcttgttataagggctggtagttagagtaaatggagacattaccctatgctagaagcataattatttctgtaagatattttaaaaagtcccataaaatttcattgaggattatgtgagaactgcaattgggtaaataaatatgtggaagtgaggcagacttttttgtgggagtgttgtattcttgggcatatcctgtttgatcttttcatcaatgatctgggtatagacagagtgagccacaatctttaattcaaaaaatatttattgaacactacctatgtctgtattagcccattttcacactgctataaagaattacctgagactgggtaatttataaaggcatggtgaggaactgactcacagttccacacagctaaggaggcctcaggaatatacaattatggcagaaggtgaaggggaatcaagggccttcttcacatgacggtaggagagagaagtgcgagtaggggaaaagccagatgcttacaaaaccatcagatcttgtaaaaactcacatactatcacaagaacagcatgggaaattaggattcaaaatgatattgtcacttgaaactctagatcaaaaatagggaaaattttagtcttaattaaaaaatatatttttggaaacaggatagtagacatctggcttggttatttgttcctgggaataatatatagaattttgctcaattaagacatcaaggcaagtgaaaagcatgatggagaggcttaatcagctaatgcaaaaataggctgctttaaagaaatcatagcacctgtaatgattagaacacactggaaatattggctccattctggatgacttgcttaaagcagatctttaaagatttttaggtgcttacagatagtgttaaattagtgggtcaataattaatgtataaacatatttaaaataataacaataggactaaaaaaattaacatgctaacttgggagaaatgggaggagaaagggagaaaaggagtattagtaatttttcttcttctttctgagtcactagatatagttgtataaaaatatatacaccacacacatatatacacacacatgtgtgcacaattatattatttagtgttgtggaaaaaaatcataaacaagaaagagtaaaagagtaaaagaaggccatctctaaggattgggactaggggtagaatatatggcttgagataaaagccctctggtgctatttgactttatacaatggacgcatcttaccatggtttttaaaagtaaacaagggctggatgactaccctcccctagagagaaagtggaaacaaagacattgagagaatcaagaggccaccatggtaggtggtagtgagatctgaaaactgatattgaaatggttgaaagaattgggatcatttaacctggagaaaaggggtaagaggaagcttatgcaggtgtgagaagaaggtaggatagaatgaaaaggtagaagaagatttctttggctgaatatatttaataattactgtagggattcctatcttgtagattcctaggacctgttagtatgtttgtgaggtgtgtctatgtacccaaataaattatatgtaaaattgtacatatatatggctgtgggcatttgatgagttgggatagaaccatcattttcaatagatttttttcccaaagcagtgtatgatttaaaataggttaaaaactataaggttgcctgccttatggggcaataaggactcatctaaacagaaactatcttttatagataatttagaaataattttcatgttggatagactagtttatttgaaatattgttttctgcttttaggttctaatatttacacaatgaaaaaataaaatagacataataataaggaacattcattgaacgcattacaggctggtcatcatgttaagtgcttgacatagactctcatttaattctcatagcattaggtgaggtagacactacattaaaaactcagattaaaaaaaaaacttattggaggtccccctgttagtaaggaacagaactgagattagaacccaggaaatctgaccctaggttacagagatagggttaagataaaagccctgtggtgatttttgattttgtacaacagatacattctacatgttttttaaaagtaaacaaggtcttgatgacttgcctgatacccccttttggagaggtttttcactccctcagtagcctgttaattctgtaccactactgatagcaccaacactcacacctgtgaagctcatctttctgttttcttcctgggacacttagtgtgactcaccctctttgaaatgaagggagccatgagaaaatagaagaaaaggaaaaacaattttttaatgtctattgaatctaaagcaacctatttcttgagcaaggatttagtgtttgccctctactatccattggtaaatgcatgtcatttatgtgtcttgaaggtgtttgaataagaatttaatatctgtggttatatgaacttgacctcatttaatgccacttcttttattttaccaaaaatacatatatacatatatacacatacatacatatgtatacatatatatctatccacacatatatagatacatgtatctacacacacatatatacatatatatgtatacacacatgtatatatagacagacggagagagaactgtattagttttctattgctagtgtaatacatgagcacaaacttagtagcttgaaacagcacaaatttattttgtgttctgtaggttggaatttgacatgagtctcatcctttctggtggctctgggggagaaaccattcctttgtcttttcaagcttccttggatcatggccctcttcaaagccagcaagactaggaagagtcctcatattgcaccactctgatcatttttctgcctccctctttcacatttaaagacccttatgattggactcacccaaataatccaggacaatctcaccatctcaaagtccctaatttagtcatatctgcagaatctcttttgccacctaagataacatattcacaggttctgggaattaggacatggacatctttgggggactactattctgcctacaacaaacacttactaaatgccaagccttataccagggactgaaatagaacccaacccctttcctagaggagcttacaatttaggagatatttaaacaggtgactgaaatacaaaataataggtgctatggcagaattgagaaccaattatagcactgtggaggaaacaactgtctgcctggtattgagggtgagctagaaaaaaaattggctaaaagattacaattatctttgacatattgaaatgattttatcacttttcatccaggttttgagactctgggatattcaacaccagctgtccatccagaggatagcttgttctttccccaaaagtcaggacttcagatgtctcttccactttgatgaagcccatggacgacttttcatctcgtttaataaccagctagcattgttggcaatgaaaagtgaagccagcaagagggtgaaaagccatgagaaagcagtcacttgtgttctttacaattctatcttgaagcaggtaatgatgctttcttttctttcactctcctaacatatctccaagtccagaggctcatttacttaattcagtttaaggtaaaatgaaagacaaatatagtaaaggcaaatatgggaagaaatgatttaatagccatgtgcttttctgcaataatatacattcaggtggacttggagaatgatttcattttcagccagtgaccacaggagcagtgatagagttataaggaattacagcattccagctaaaacaaaacaacctgtaatataattgaacttatctttgttatctgctagtcttgagccaaatgcaagtgaacctgcttgtaaaattctatgaacaccatcttccggtatccctgtggaaagttctgaaatatgcatgaaacataattagcagagatccattttgccagcatattttacaccagtggttcacagtggcagcccagaatgtattcataataaaatgattcagttaaacatgatgccacttggtatgcagcacaagtgttgtttgtctccccaccagtttaatgacgctccgcagccttggcttaggggaccactacctgcatctcaatgaagaagcagggctcccctggagcagagttactgcgcagaccacagcccttcttggaggacagggcggcccaggcagtgaagccagtgagctcagtgtgggrcagcctgtgggtatcatgaagggagcaagcaacatcagaggttagcctgctgcagtgatcccgtcaggcctgatggtaacagcacagcaggagccaagcagaagcaagtctccagcttacagccaattaaacagtaactcaatccattctttcttttcccttctgcagaagcttctgcattcacatagaaatgactagtggagattttgcgcaaggggtggaaagccctttgttagtaatgggtagtgtgtcgtgtcactatttaaaacactgttttctggttattctaggagataaaatcatttagaaaacaactcattttgaattccatctgcgggaaaacatttcctgctaaatgttttactgatctttatgaaggcaaccagttaatttgactcccctggtggccactgagagatgtatttgcttccaagagaacattctcctaattgagatctgcaaagttaaaatgctaaatttgtgtgtagatgttaaaatcctatgttgcctggccataagatgagcaatattccctgagaaattcaggaaattagacacaaagaagatctggatttatttggggcataaagacaaagccaaggtaactcacatgcatgccacttataggcaaccaaaggacaatgtacatatggtatatgatgtaggatgtatcattatacaattgagttgagtatttacacctctacttgctgtgaataacataaataatgataagcattgatatgtatgtaaagcacatagagctgtgtatcacatacatcagcatttcctattagctgctgagttacagaaacatgaacattgtatgtgttacatttataattataaaaatgtattgcagaaaagtacaaagaaaatatcactcacattcccatcagtcagtgataacttatcattttagagtaattagacaaagcaaataacacagttttgaacaagtgtcgtaccaagaatgaagaattagagataataaactatagtttcttgcccccagtagctcaggaagattcaactctttaagggaaaatctgggtcctaaccatagtgctgatgattgttggacaggtgctcatcacaggattgtggaatgaaagaagggaagggagacatattactaacaagaaacagtagaacatagtaaaatgaagtagaggtaaaaaccgaagtgctttttatggagagtgatcaattctgcctgaggccagtgttggtcacatttcagcagagccctgaaagctaacatctctaaaaggaggaggaagtagttccagacagaagatacaacgtgagcacctgcaaagaagcttgagcactcacggtgcatttttggagagagggtttattttggtgtggcaagtttgggaatacttygcagacatcgtgggagttaaagcagtaaagggatcttaggagcatattgacggccatttgttgaatgtatcactgtctggtcttggaaacataaagcatagaattgagattaaaacaatgtttttcacagtgtgatcttggacctctgggagactcagattctctcagggaatctgggaggtcaaaattattttcatcataatattaatttattgtttgctttctaaactttcactctctcaaaagtgtacagtggagttttctagaggctgcatgatgtgtgttgtgtgataacagcattgttcttatggctaagggaatgtgtgctcttatattcttgtgttttaatgtctccctataaatatctaatatggtaaataagtataaaaatacagatctatctatttgtgttgtgtgtgtgtgtgtgtgtgtgtgtgtgtgtgtgtgtgtattccacataaagctatttggattcttcaatactttttaagaatgcaaaggaatcccaagaccaaaagttttcagaactgctgggttggaaacatgtgaattcaaatactggacagactgcttagcctgtctgagctttagtttgccagcttcttaaaatgtgtgtgtctgtgggggtgtaggaatagtaatgggaatagcacgtgcctccctggcattgccttgttaggactgaaatcttggaagtgtcctcttgtctcccatgctgccagccctgtaagggtctttaaagtcccccataccaaagagggcgaatgttgctgctttatgacatctccttttcttattaacttcttaagattccttaatctttattttaacaatgtggcatgtgatgacaaatgttaggaagaattagaaaggggagggtaccctgaactgcagtttttccctacctctgcttctcctcaggaatgtcccttgaggtgggaaagttgtttatcctcctccttctcttcttcgccattgcagtttcgtcttgtaaacatttagtggcaagactcagctttggtcctcagctccctgaagtctccagagccatctcaacccacacttacttctcctcttcctgagcattggtcgcattttttagttgttttcccagtaaaacacttaactaaacttatttctctctcttcctatgtttttggtgtgaggggaagatccttttgttccatttttgtattttcccacagctcctaacactgttagtgagcacaaaatgaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtctttcttgaacattttccctttgcttgaatttaatgaaaaccttcccttgtgttgttatttcaacatgttgcctacactttattatttccttgtatttggacttcagtggggacccaatataattcctatataaaagcagcttggaacatttccgtgacttttatttatcttcctgtcttttgatacccttgaatcctagtctgggaaagtgatgttaagccatgcaaagccttttaaaggaaatcatatactttatttcacctggcaaagtttgccctcacagccagcagcagagcaagttgggactggatgaaggagtcccctggaatgtacaattttgaaagaattaaagcaatccaatatcctggaggcagatctaatgaaccatctttgcacttagttcttaaatgaagctttttacaagaaaacaaaagaacactcatgaatttaggaaactttaaaacatgtatttctagacatagaaactagaatagataatatacttgtgttatcactatgattctcatcctaatgatgtaggttgatgtatttttgtaaaatagataatgtttcagtttgttgggaaccttggacacatttataatcaaggtagacatttaggtgtcatcaaattttaatagagtaaatggtatttacaatttttcttatcaaaataactttttttggtaattgcatgcaaaatgttacatgattattgtaagaaattaaagcaatgcagtaaagctcaaatacaaaactattgctgatatcaacatattctaaacatctttctctgcatagactattttacgtaaacaaggctctgtaacatacttttctattcaataatatgttagaatatatttccttgaggctaaatgtagaactactttatcatttttaaaaggcagcatagtagcccattctatatatgtatcgtaatttactgatccatttcccttgatgtagacttcactattatgacttttttgtagataaatacatttatatttatgactatatctcttcaaggtaaattcttaggagtaagtttctaggctaaaggatatgcaatatcagataatttgataaataaattgccccctagaatcttacttttttatcctgcttctaacctctaatatattaatcacatacttggttacatgaagagataggtcagacagtgctcacctggcttattccaagagatctcctgagattctctgtggggtttttcataatccagaagcatgctggctttgcaaatttgaatactagaccctcttcactttatctggagtgatgctgtttcttgaggcttgattattatactatctacaaactgccaaattatttattaaaaatgggggctggtccaggtcacagccatagagtggtgcccttacctttggttgcttcaacattcactgacaagcaaatatttaccatctttttttttttttttttgagatggagtctctctctgtcgcccaagctagagtgaagtggtgctatctcggctcaccgcaacctccgcctcctgggttcctacctcaacctcctgagtagctgggattacaggtgtgcgccaccatgcccggctacttttcacgtttttagtagagacatggtttcaccatgttggtcaggctggtctcgaactcctgacctcgtgatccacctgccttggcttcccaaagtgctgggattgcaggcgtgagccactgcatccggccttatcatcatttaattgcagctttttgtttctttgctgtgacacaatataaaaatataccaaaggtaaacactaaaaaactttcctgttaaaaaattccattatgtatacatgtatagcatctgtacaaagttattatctatgccatcatattcaaaattttatagtaaacttttccacccttaaccttatttacaatttatagttaccttatcttaatttagattattgcagtccaaacagctctatgtatacatatgcatatccaaaatttataataaacatgtggccttccattatttaaaaaatgagggatgaggtataattttctcttgatagcatatcttttgtcctcttttctgcacataattttttggaaattgagggtatttgggaatccaaacaattcaattggtggttcccttggtaattgtaaaattggagaaaagaggacaggcttgagggaaatttatctccatcgtacaagacagtctaccttttcagggcttacatttagtgcaaaatccatgagtttcttttttgaacagaaccagatttacacaatgaaaattttctcctttcctgcctctttgctgggcaccaagtgacatccattctgttaatacagttgtgatttttttttttttggctagcttaaagctgtaattggttatatgtcagttctgaggctgtgtgctgtagtcacttgatggaaacataagaagttactagttttagaggttatactaaaacatacatgtacatgcacacatacatgtacgaacagatacacatttatttaatgtgattagtttggaagaaataacgtgtttacatgttgaaaaattcaaaacaacaaaaagatakgtggcatatattttctcttatcttcatgccactgcctactcagtttcctgtcctgtagacaacgagttttacgacttccacaatgtttaagggctattctactcttaaacaagtgaatatatatttttctttatatagacagttgatccttcaacatcactggtttgaactgcgagggggcactgtatctgatttttttttttttttttgctgtgtccaggctggagtgtagtggcatgatcatggctcgctgcagccttgaactcctggcctcaggtgactgtcctgcctcagcttcctgagtagctgggattacaggcataggcactgtgcccagctccacatggatttttaaaaatgaatatattggaactttttttggatatttgcaacaatttaaaaaaatacagatacattgcccagaaatataaaaaaatcaagaaaatattatacatagaatgaatgcataaaagatacgtatgtactagcctattttattagttagtacaataaaatatacacaaatctattacaaaaagttaaaatgtatcaaaacttacgtattcaaacacagacttgcagtcaagagaaatgtaaacaaaaagatacagtattaaatcataactgtgtaaaattaactgtaatacaggctgggtgcagtggctcatgcctgtaatcccagcactttgggaggccaaggagggcggatcacgaggtcaggagttcaagaccagcctggccaacatggtaaaaccccatctctactaaaaatacgaaaaaattagccaggtgtggtggtgggtgcctgtaatcccagctactcaggaggcggaggcagagaattgcttgaacctgggagccagaggttacagtgagctaagatagcaccaccgcactccaacctgggcgacagagcaagactcttgtctcaaaaaaaaaaaaaaattaactgtagtacatactgcactgctgcaatgatttcatagccaccccctgttgctgttgtggtgagctcaagtgttgcatttgtttaaaatgccatgtgatacttatctccaaatgagcagttgctctctacattaaattacccatctcagtaaaatgtgatctcttgagctgcttgcatatttcttatcttgtttattgcagtaccataaactttgaataatatcatggaactcataagaagtgccactagggatgctgtgagtactaccaagaagcagagaaaactcatggcattgcaagaaaaagttgatttgcttgatatgtaccataggttgaggtctgcagctgtggttgcttgccatttcaatataaatgaatccagcattaggaccaccataaaaaaagaaaaagaaattaatgaaaccactgccgtagttacaccagcaggtgaaaaaaccatatactttttttgtgaaatacctttttacctcgtattgaaaatacaggtcttatgtgggtgcaggttgctataagaaaggcatacctatagactaatatgattagagaatgagcagttattatacaataatttaaagcaaaagaaaggtgaaatatctaaagctggggaatttaatgccagcaaaggatagtttgataactttagaaaataatttggtacaaaaaataccaaaataacaggaggagcagattctgccaatcaagaagctgcaaatgagttcccagacacaattaaggaaataattgagaagaaaggattgctgcctgaacaaattttttaagcagatgaaaatgcctttgttctgaaaagaaaaacgccacaaaggatgtttattaataaagaagagaagcaagcatcaggatttaaggcaggaagggatagaccaactctgttattttgtgcaaatgcagccaggtttatgatcaggacagcacttgtctataaagctgctaacctctgagcctgaaatggaaaagacaaacatcagctgctattcttttggctgtacaacatgaaggcctggacaatgagaatgtttttttctgaactggttccttcaatactttgtccttgaagtcaggaagcaccttaccagtaagagactgctttttaaagttcttttgatattagacaatgcccctggccccacagaatcttatgatttcaagactaaaggcatcaaagtgatctacttgcccccaaacacgacatctttaaattagcctctagacaaggggggtcatgagggcctttaaggctcattacacatggtactggtactttatgaaaaggaccgtcaatgctatggaaaagaatcagagtagagagaacgtcatgaaagcctggaaggctcacaccattgaagatgccatcattgttatagaaaaagtcatgagagccctcaaacctgaaacaataaattcctgctgaagaaaactgtgtccacgtgttgcacatgacttcacaggatctacaacagagccaatcaaggaaatcatgaaagagactgtgaacatggcaaaaaaggtgggaatggggaagrggtgaagggtttcaagatatgaattttggggaaattcaagatgtgataaacactaaatcagaggaatgaacagaagatgacttgatgaagatgagtgctttcaaacaggtgactgagaaagaagacatagaagaagcagtgccagaaaacaaagggacgttagacaataatggacattagacaatctggcagaagcgttctgattattcaagactgcttttgacttattttatggcatagacctttctacactatgggcactgaaactaaagcaaatattggaagagggattggtactgtttggaaacatttttagagaaargaaagagcaaaaagtccgacagaaattacaatatatttctgtgaagttacaccaagtgtgcccacctctcctgacctcctgcctccctttccacctcctccacctctttggtctctgtcaccccgagacagtaagtccaaccctttcttttcctcctcctcagccttctcaatgtgaagacgacacgaatgaagacccttatgataattgacttccactcaataaatagtaagtatattttctctttcttataattttcttaataacattttcttttctctagcttactttgttgtaagaatacagtatgtagtaactcttacatacaaaatgtgtgttaatcaactgtttatgttatcagtaaggcttctggtcaacggtagaatatgagtacttaagtttttttgggatcgacattatacatgaatttttaactgtgtggcaggtaggcatctctaacccccatgttgttgcagcgtaaacttattctttgaaatagatatgtaatatttaataactcaatatttaagaatatatattattttataggctttttttacaaaaatgagagcattttatatgtacgaactgctttgtacattgcttttatacgtaacaatacatcctaaagatagttttatctcattacctaaagagtaaccttgtccattttcacagatgcatagtatttcattgcatgcatattccaaactttgagcatttaggttggttccagcagtttttgttacaaataatgtagcagtttttcaccttgtccttagaactctgcactgatgagaaaatatctataggataaattcctatagttagaattattggggcagagaatatttacatctgtaatcttgacgaatattgccaaatgctctccataaagctacactaaaccagcgtaggagaggaccatttcctcagcctctttcatcatcacagtctcaactgtttttagaagtagatttttagaataagagaattggtagagtttcagagtcaggcagagttctcagtactttacacagagtgggtgattcaattcctctaagtttcagctttcttatctataaaatactaattataatacatcccttgtagaatttttgttaagaacaaatgatcttatatataaagatacatgaaataaagcaagggtaaatgctaattaatattagtgaaaaagaggaaagttttttttttctacttttgaaatttgttccctagttcttatgggagtttggtagttttggattgttttgaatctctgtgcactgaccgcaggcaatggctcctcccttccctcacactgcttaagccttgctggcttccttgctattccttgaatgtgccaaggacactgtgcctcagggcctttgcactgctgtttcctttgtttgcagctcttttcacccaagtatctggttggcttacttcttcatctcagttatgtctctacaaatgattcctcagggagaccttcccagattccccaattttgcacctatgacaaaagccctctgcttccttcttagctatattttcctccataacctttgttaccaccaaacatcatatatatatatacacacacacactatattacatatatacacatgcattttacatataagtgtgtgtgtgtgtgtgtgtgtgtgtgtgtgtgtagatagatatgcttttttttttttctgatcttgttgcctctctccctggacaaaatgcaagagcagaacttattcactgctggatcaccagtgtctagatctagggccttgcatattacaggtattcagtacattcaaataatgaatttgaaagagcaaattaccaattaattgaagaagagaaaaaatccactaagcaaggtttataactaaagaatggctgccctaaaatatttgaataattwgtacttgtactctgagatatcatcattctcttcacctccctattcactgaaatgtaacttctagagattttctacaaaatggaaataaaggaagtaacctattttatattataggaccataaacaacactaacaaaaaaaaattataaacagcaatggaatcaagtatctcaaccctctgttagctcgtggcatttgctgctgtaatttttgattcctgttttttttttcttagacccaggacttgaaatgcacataaaagacaactaaagtgcctactgttattggaatagcaataagacaattaggtgacatgaatacagcctcacatgtcttagaattgtctgattagctctgacagcttcagatgagagaaacaaaaaggagacacatattcctaaacagttattaactgaagcacatgagagagagactgttctcatcagaacaacgatctactgaggaggcccatgtgtcctggagtgtggttgttagcaccattttcactctgcagactgtcagggccccgtcctcatcagctgaagtctagcctgataagagataatcagaaataaactgcaaacttaaagagatttggtatcattaaaaggtggcatagacatgtgacgccaagacttattcctgggctttattgctgatgaaaacaacttgccaaaaatagttccattgtcgtgtagtgaatccattttcttcatstgccaagtaatgttaaatgcactcctctttcactaaactttgaacgccctttcccctatattgttattcttgtattccaatattgtcatagtgagagtagattctggctaatactggttggatgtttgagacatagtcagtttcaacacattgttttcctgcaaactgcaccgtgaggccgactgccataaaatgaaatcagactagctatatgctgttgtcatgactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtcaggtgggcaggggaaagagtacaaaatggcaaaaagtgaacattactaattcctcattgagtatctacgttagataacagtggtgaatgattagatgctttgtaatgtgggtgatgcccaccctgaacaggtaatcaaatcttttctttgaacatggctcttttatttctgttagggaaataaaaagtatcatcttttggtactgaaatggctaacatataatagctgctcagaaaatgctttttagtacagctagatcagaagaataagttctagtgttctatagcactatatggtgactacagttaacaacaacttcttgtgtattttcagatagctagaagagtggattttgaatgtttcaacataaagaaataatacatgtttaaggtgatggatatgctaattaccctgtttgatcattatacatcgtgtatgtgtattgaaatatcacacggtaccccataattatgtagttattatgcgtcaatttaaaataataaaaacaaacaaatcaatcaatccaaaaatgttttttaatagaaataataaaatcctgcacaatctttaaccttttcttaaaagactactatcaaaattttcacacaagcttggaaaattacactttcatgattttatctgtaatgaatgtaatccaacttcctaagcacttctgtgagaaattcacaagtataattcaaaatttcaatgtgcatctaaaatcaggtttctttcttttttttttttttttttttttttgattcagaatctcgctctgtagcccaggctggagtgcggtggcgctatcttggctcactgcaagctccgcctcccgggttcacgcccttctcctgcctcagcctcctgagtagctgggactacaggcacccgccaccacgcctggctaattttttgtatttttagtagagacggggtttcaccgtggtcgctatctcctgacttcgtgatctgcccgcctcggccttccaaagtgctgcaattacaggcgtgagccaccgcgcccggccctaaaatcaggtttctaaaatttaattgtctacattcactgtcatagttggaggaaagcaagatactatttttcttaaattgatttggatatgcacagtgatacaagcctaagtaagaggtcaggcaaatgaagcttagatggaatagtaacactacctaacttttatgatttatggctatgccatgcactgtgataaatgctttaaaaatattagtttgtttaaacatcgtaacaatggtttgaagtagttactatgaatatttctggtttacagatgaggaagttgaagcataaaagtaagtaatnnnnnnnnnnnnnnnnnnnntgctcctaacaacctgtatagtgcacaaacacaatcaaatagaaacacagttaatgacatggaaatgctaattaatgtgttgttacattatttcaaagatccagatcatttggtcttagaaattacacagtagtttcacaatggtaattcaatatttaaggtaattttgatttcactgagagaaaatgtgtagcataaatacaggtttacttcatttaagaaattgtctcattgaagttgtaatttcaggaaaaaaagggctaaaaggatcacatgctcattatcagttctttgttgagatacacatgttgctaaatcatggccctgtctttcagttgctcccctcctttgtacccccagaactattttgttagttgagaatctcttacctggactagtctgaagcctccaaatggtcctcccaaaaccccagtttgttctccacattgctgcaagaagtatctttacaagccaactgacaaaaaacactgtattactcttttccttattaagaacaataataatgtttttagccttttggattaatcattggcccccaatgataattgatgaaagctgtgggccctctcccagtaaaactgactttataattactcaatattctttggagctgcttaccagagatttctaaaattccatcttcagcttgcctactcatttgatatcccaccatatttgtcccttcaaatactctgcgctcaggctcattaaactttgtattgtttctcattcttggaatattctccaagtacttttctaagtgaactgttagttgtctggaatgctgtgcaggaatagaggaagaccttaygatgtggctgtctatgtcaaggattcaaacctgtaagtttggggacattattagctgattacaaactcaattttgtcgttggtaaaataatgttggtaacattatttcacagagttttcataaagatcaaatgagataacaagtgaaagggcttggggtacacctcataataaatacatgtctccatcttcaattccagaccagttatcacctcctttgtgaatcctgacttgccccttgctcctccactccctaacccaatcccccactccagcaagtggatttcaggttttccactctgtacttccacagtacccaaaggtgattcctctaaacttgaaacattttttagcatttatctgtttcttgtctgtttcttcatctagaccagcaggtcataggtcaggctgtaaatttaaatcacctgtgatgctctttaaagatccatttccttggccaattgaatcagagtttctgatctggtatgcagtgatgctttttaaagttccccaggtggttttaatgtacaggtgtagaccatagacaatagactccttgagagcaggattttgccagtgaagttccattgccgttatggagcctggatgttatgcaagtggctgtagaatgaatgaatgaatgtatgcatgatggccagtattgaatatacatttgataaacttcaacccatttgattatgaaaagcagcatttmaatttaacatattgttaatacatttacatttatacaatggtaatcaatacctaaacagaaaaagaaatgctttaagcttccttaaaatctacatattgctttagagaacttcctagctatgcatttatgtaattatttttctttcattattttggtttccaaagtcatattagctaggtggttttaacctatgaatctcttaaatatcttgagctgaaattagcagtccacttgccactataaaatttctcatttttgaactgctgtgtataatcctttcccttctagcatttgtcttgttgccttcctttcaaagtgtgcatgtagatttatatttaacctgtgctcttttttttttttttagtaatctatcaataattgtgtttagctataaaaatatacacagtagtttgggaaaaaagaaagcaaaggactaatggcattaaaagcacagctctagtaatttgttgaaattaacattttccataatggctggtagagcttcttttctgaatgctaaatgaaagctgctatattataaaatgtttcttttcatatagtaaatagtgtcagagcaccatgactagtaaaatcagctttctcatctaaatgggaaagattcgtaagtttattttcagaatttgatttcggaatggcctctagacactaaagctgaatggtgagtaaggaaagcagattactatcttctctgataaagaggatcacgacttcattacctcaggtctagtcaaaattgaaatgttatcagcttaatagaaagaaagtccattacaaaaatgtctctgactgttgggggatctttggactagaaatgcacaggctggatatgtttattgaaatataaatggttgattctgagactatatttaatttctttaaaatgttattttctcttaggtartcagctctgatacagggtctactgtttccttctggatgatagacactgggcagaaaatcaaacagtttactggttgccacggcaacgcagaaatcagcactatggcccttgatgcaaatgagactcggcttttgactggcagcacagatgggactgtaaaggtgcgaacacaatgatgcttttctatccagatatgaggagactaaaatactatgccagaagacatggctatagatattctcattttttgcctttttggtattgcaagaagagaaatgagacatggtaagagtgaaataactccaaccatctaataaagctgctaggaaaataaacctctgtggaaaaatgaataaataatttttctgaataaattatttagaatgaaaatataacttggcttactcatttcagaaagcccccttttcagtgtagtcaatagggactactttggggaatacgatgcctcgataatttcatgtgctttggctaatgtctctagttttctttttaaaagttgattaaatgagaaatcaggaacacttaactaaactttaaaaaatggcatagatgcaaatttttcaagaaataaatatttaaaagtaaacctattttgtaatcttaatttttgttatgtgaaattcagacagtagaaagaataatcataatcttatccattctaaacttacatgattttatatttctaagtttcttattctataattatcatatatttcttctgggaggaaggtgctaatttccttttcaaaatggtcaacttttcatgaaaaactagatacttgatatctgaagtcatgcccaccagtgaatcttctctgcccccctcagccccaagagtaatgagtctttgattggaaatggcttgtgccattttgaggcaatagaaggtaattccctgaataaactttgaatgtttctcaaacctgctataactgggtattagactaccttccatggtgtagtgtatgatacactcagttaagctgtaggggagagtgatggaaagctacctggatatgtaggtagaacatcctagaagtttaggtattcagggagattacaggctggcagtcattagtgtgaggaaggtgctattgtgggttgaaaagggaatctctggaaatcagtagaagttggcctatgagaaggttaatggaataaggtatggactggagatttgggtttaagtaaagtaatctagtttacaggagagctgataagatgtgtgaaggtaccaggacaaccataatcccaataattgaggtgaaataaaagggaaataactggacctggagtattagacagtggttcaggcaaatagtaaaagccagtatctcgcttaccagtcctggggtgtgagaatgcactgaacattggagtgaacggattaggttctatttacctctatcttggaaagtaactgggtatagaatctagggtaaggcttaccttgtagattctgctaaaatattcccagctaagggacttagtcggacctggggacattcagatctttgcaatacctacttgtggaaattatttaaggtggacttggtaagagccatgtttagaggaaaacatagcgacatggatgaagagtatgtgtgcacctcaagtctcaactgaagcgttgacatcttagaagttaatgtgaatttagtagtataataactgcttctgaaggtgcatttatatttatcacaagagcacaacagaattctgaagtctggcaacttctgtgtaggatacataaatcagggttgagtttctctgaccatattctatgaagaaacaagaatgaatgacattttccaatctaatttataaatttagaatccaaattcagtacctacataatcaaagacttaaaattattaactcattcattatggctttgaacggtctatttttaaattaattaatgttttgaataattaatgtgtgcataaaataaaatttttgaaatataaaatggatatatagtgaaaatatatcatccctgtttccagctccttctctgaggctaccactgttactgttttcttgtgcacctttctagccacaaacaccatttgtttgtttattttcgttcaatcattcttgtttgtttgtttttagagacagggtctcactgtgttcctgggttggtttcaaactcctaggttcaaatgatcctactgcctcagcctcctcctgagtagctgggattacaaacaygtgccactgtgcctggccatttgtttcttgatggcagcctactatacatgctgttctgcatttgcatttttctgtcttggatattgactcatataaatggatacaataataataatgttagctaacatttattccatgctcactatgaaccaggcactattctgagcatttcacacacacatatatgtatatctataaggttggtactcttatcctgattttttttttttttttgagacggagtctcgctctgttgcccaggctgcagtgcagtggcacgatctcagctcactgcaagctctgcctcccaggttcacaccattctcctgcctcagcctcccgagtagctgggactacaggcgcctgccaccacgcccggctaattttttgtatttttagtaggggaaactgaagcccaaggagttaaggcaacttgctcaagcttccataggcagttgagttttggcagagtctaggaaaatggagatgactcattcttctttatggctacattatatgctactgcatagatagtccttattctgattgttcaatttcttacttactaatgagcaattgcattgattcaaatcttttgctttttaacaatgctgcaagaatatgcttgaaaatatgtcattttacatatatgaatrtatctgtggatgattttctagaagctgaattkttaagccaaattttaagccaatttttaatcatctgtgagatgactttctagaagctaaatttttaaagggtatatgccttttaataataataattattttttgagacagagtcttgctctgttgcccaggctggagtgcagtgggatgatcctgtctcactgcaaccgctgcctctcaggttcaagtgattctcckctcttagccttccgagtagctgtggttacaggtgtgcaccaccatgctcggctaatttttttgtttgtttgtttgtttgagatggagtctcactctgtcactcaggctagagtgcagtggcatgatctcagctcactgcaacctccaccttctgggttcaagctattctcctgcttcagcctcccgagtagctgggactacaggtgcatgccaccatgcctggctaatttttatatttttagtagagatggggtttcaccatattggccaggctggtctcaaactcctgaccttgtgatccgcccgcctcagcctcccaaagtgttgggattacagccatgagccactgaatccggccctgcctaatttttgtaattttagtggagacagggtttcaccatgttggccaggctggtctcaaactcctgacctcaagtgatctgcctgcctcagcctcccaaaaagctgtaattacaggcatgagccacggtgcctggcctgcattttaattttgatagcaccaatgtgacctctatgcatgatgtgccaacaaggtttcatagtagggcttagttttaactgctactaatctaatgatgctctctcttaaagtatgcctattgggcttaagttttcactccactgtctaagtaggttaaccagaactgcttgtgccctcttgaggactgggtctggcacccaccatcaacaggaggttttatcggtagaggatgagaaatctagtaaatgatgactgtttcaggttctgtatcagctgtttaatcctccaagcatccctgaggagtaaagttcctgtatcacagataaggaagcagaaatttagacatagtgaaaacttcaggatgtcaacagattccaaaatcgttttcttcatgattttttattgtctctccatttagtatacatattaacttacagtatttgaagaactattattagaatagattgatagagttacaagtagagtcataaactgtctagcaacatttcagttaacaacagactgcatatacgatggtggtcccttaagattataatgctatatttctactgtaccttttctatgtttagatacgcaaatacttaccattgtgttacagttgttgacagtattcagtacagtaacatgctgtacagttttgtagcctaggagcaataggctataccatatagtctaggtgtgtagtagactgtatcatttaggtttgtataagtacactgtatgatagtggcacaatgataaaatcacccagtgatgcatttctcagaatgtatcctgttattaagtgatgggtgactttatataggaaaaaaatcagtttctcctaccatcacactgaatgcaatacacacctctggccaccaaaatgtgtgtagggatttttcccacacaccaattctgtggtagattttacagaggacaccagttgggtgtcctccaattcaattctattctgacactgtctacttggagatagagtcagatcctctaggttgagggctcagtcccacaagtctgcttcttcctttagatgccagtcacaagcatatgttgtaacttgtgcttctgactgacgggctgtaaatcagcattcttgtgaccctctccttggatctgattaatttgctagagtggcttacggaactcagggaaacacttgacttacatgtattcattaattataaatgatattacaaaggatacagatgaacagatggaagagatgcataatgcaaggcatgtggactcagcccttccattgtgggcttttcacccaccagcaacctccacgtatgttcagctgtctagaatctcttcaactcccatacttttgggtttttatggaggctccattacacagggttgattgactccatcactgaccactggagatgaactcaactttaaacttctctctgctccctaggggtttcagggtggggctgaaatttccaccttctaattatgccttggcgtttcttgagaacagcctccaccctgaagctatttagggctccccagcctggagtcatgtcattagcatactaaatactatcttatcattagagaaagagtctgaggattttaaaagttattgtgccgagaaatggggatgaagaccaactagatatttcacaatattacaagagtaatatagtggcaaaattcaatgatgagttgattttctttaatgattacatatcctaaatgaattaatcctggttcagaatataaaaagtttaccttcctgtctcaaagtggttttaatttttctcttaaagatatgggacttcaatggatattgtcaccatacactaaatgttgggcaagatggagctgtggatatttcacaaatcctcattcttaagaagaaaatactggttacaggctgggagaggtatgattatgcctcatggaaaactataggaaggtaaaaaggagaatgtttttattttaatcaaaatctaaaagaaaaaagaacataaaaatcttggttgactctgtgtcattaaaacttgctggtgasctaggtgagtgataccctagttggaattgactgaatgcttagtgaataaaatattagaagaccgcatagcttgagtggctttgagaattgttaggttttcttctggctttggaaatttttctttctttaaccatttcagatggggatgtattaccacttcctaggttccaaaagtttcccaaattttatagtcaatcaattcttaacttgtaaattacattccttcaactgtaaaggaaactcattacttcttttctcatgacttattttcaattgcaacacaagagggaaatagccaactgagtcctgtgatagctcctcctttctatcagtgcagaaaatgtctttcgaaaggcacttactcttctcgaggagcatttcttccatttcattagaaggaaaattacttttccttcctttttttttcctgacagaactaaggatcataaacagttctgtggcactgtagaagcagtaggaaaattaaagtgtgatatgttttgaaaatatattgtccattaattcatcagtttacaaaatattgctctaataggtagtcgtccaacgttattcactatagaattatgaccttaatgctttgaagctcggattaaatcagattttatacctagaaaaccagcagtatatatttggggatttttatcaatcacagggaagagttttttctaatgcaaatgtgcaaatgcagaccagcaaacagtgccacacactgccctatttttaggagtaatttgacaataagaaagtaagtatagccagattattctacttgatattaagaactaattcaatcatcctcatctgtgaaggacaagacttcacatctctgaaaggattcatgatccattatcaacccacaaccactccacagtctatgatctaatgatcgctatacttagaaaatggcaatgaataagtttagctctctaccatgtgtggtgtccagctgatccaatttaagttttaaacataacaaaaaggaattttttaaaataatcaattcaagtcaaaacttggcaatgccatttccttaatttatttttagatatccatagttaggaattaacatcaactgtaagatttttttgattgcttacaagggaaaattagaaagattagatgtagagtcacctaaaagtggtttaaaggaacatctattattctatctatgttggtgggtggtactttctataatttggggaagaagctttggaaaaactggtatgagagtaggaaaaattatcactttttccatcttccttcatgttttccgttatcctcaaggttgtcaggacttggataccttagctgaaattgaaaattgaattaatacattctgttatattatttcactttatattggtggatttaaaaattatatattctaaatcagaggctttatgttaagatagattttacaggatctaagacaggattctttttaccaggaggcatttaacaaaagaggcaagagggcaggaaactgttcagttatagttacaggaggatggaccgttaagccaactccttaatagtttagtgattagagaagaaataactggaagattgacagtcgtcttactaagctttcttcaataccttgttttagagtccattaggttaagttgtaacttttacttcagattttatccaaatacagagattggttcgataattatgtgcaggatgggatggtaattacatttttgagtaaagtacttaaatatgccatctgatttattttatttacagtgctgtgtagcattagccactttatacacgttatctaatttaatccttagcatcatctcggaaggtaggcaatattttatagataactcaaatatctgtcttcaggtcttatctctctaagctcagttatccatttgcttgctgtacgtgtctgactgcaatctcaaattcaacatgttctcaactgaaataattatttatctcctttccaaaacgtgctttttctcttttgtttggaacttcaattaattgccagagacccagtcatccactctggttctccctcttcacacacaacaagaagtcactaagtcatatctgttttatgccctaaacatttcttaaacctgctcctataaattgtacaacagtattagtataattcagagcataatttccacttggatgaatgccacagccttctaacttgtgctttgtcctcctaatgcccacctctcacttcttaaatagattctgctcactttagctacagggatttctttctccaatgaattctatgttatgtccttgcttaaaacctttcagagtgtctatgttatgtgcttgcttaaaacctttcagagtgtctaagctccctctgacctggacatattcttttattttctagtttcattttctcccattttctgtatattctaaactctatcaaatagcagcttgcttagggtgttcacatacaagccgtactgtttcacacccttatggctttattctctcctcttatctagaaatccctctcaaaattttttcatttggctaacatttattcctatttgaagacttgttcagatatcttctctgccaggacatttctcttaactctcagtatagagacaaaatgtccccattttgtctttgtgctctactagtttcttacattttctttaatagggatatttgtgtatgtgtgcattcctggagcttactagatacttggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggctaccgaagcttgaagaagttgggtagctcagccaaggtgacaaagttagtaggccgctgagttagaattctgtgccaaagtcaatactctttctaccactcctgggtaggactaattgcaaatggagtcatcacaccatgagacagcaattatatattttaaactaaatgattaattgaatattttgtcattttaattgaagctaatgaatcagtacatatgaagaaacacacaaaaaaacatgtggtagcaacttaacaacaactcagatatatagcttactctctttttttcccctttccttcccatatatattttttaattgcacctaggttgaaagccctgagttagaaactacagtagactgaatgtaaagaatcatgattcctgtttcaagggcatccacttgtttatggatggcaggcaggtcaatacataaaaggcagaatatggtaaatatgaatgtttgggtctaagcaaaatgaactagagagcacatgttagctatttgggaatacagtcattcatatctagagaatttttctgtcagtaaaaagaagtcccaaatttagaagtatagaaatgtgtttctcattattttaagcaaaatatacttagaaactaagttgtgaattggcatagagtcaattcacaaatacctggttgaatctgtggccatatttatgttgctaaaattaaatgactagataatcagttaactttgcatttgttcaaagtaggcatataatatgtatagttctagtaaaattaaataaattaagaatttaagattttatcctgcctccaaaatctatgattttataatatatttaaagctctctctctctctctctctcaaaaaaaaaaaaaaacctcctagttcccctgattttaattttctcttttctataaaggagaaatctctgtgtttttccctctagctttatccaggaataactgacaaataaaaattgtatatatttacagtatacaaggtgatgtcttgatatttgtatacatcttgaaatgattaaatcaaactaattaacatatccatcaccgtatatatttattgctttcttttgtgagaaatttgtttatgaaggttttatctccttaaaagtctagacatgcacacataagaaaaagagaatcttttgagtgaactcccattcaccattgcttcaaagagaataaaatacctaggaatccaacttacaagggatgtgaaggacctcttcaaggagaactacaaaccactgctcaacaaaataaaagaggacacaaacaaatggaagaacattccatgctcatggatargaagaatcaatattgtgaaaatggccatactgcccaaggtaatttacagattcaatgccctccccagcaagctaccaatgactttyttcacagaattggaaaaaactactttaaagttcatatggaaccaaaaaagagcctgcattgccaagacaatcctaagccaaaagaacaaagctggaggcatcacactacctgacttcaaactatactacaaggctacagtaaccaaagcagcatggtactggtaccaaaacagagatatagaccaatgggacagaatagagccctcagaaataataccacacatctacaaccatctgatctttgtcaaacctgacaaaaacatgaaatggggaaaggatttcctatttaataaatggtgctgggaaaactggctagccatatgtagaaagctgaaactggatcccttccttacaccttatacaaaaattaattcaagatggattaaagacttaaatgttagacctaaaaccgtaaacatcctggaagaaaacctgggcaataccattcaggacataggcatgagcaaggacttcatgactaaaacaccaaaagcaatggcaacaaaagccaaaattgacaaatgggatctaattaaactaaagagcttctgcatagcaaaagaaactaccatcagagtgaacaggcaacctacagaatgggagaaaatttttacaatctacccatctgacaaagggctaatatccagaatctacgaagaacttaaacaaatttacaagaaaaaatcaaataaccccaggaaaaagcgggtgaaggatatgaatagacacttctcaaaagaagacatttatgcagccaacagacacatgaaaaaatgctcatcattgctgtccatcggataaatgcaaatcaaaaccacaatgagataccatctcacaccagttagaatggctatcgttaaaaagtcaggaaacaacaggtgctggagaggatgtggagaaataggaacacttttacactgttggtgggactgtaaactagttcaaccattgtggaagagagtgtggcgattcctcaaggatctagaactagaaataccatttgacccagccatcccattactgggcatatacccagtggattataaatcatgctgctataaagacacatgcgcacgtatgtttattgtggcactattcacaatagcaaagacttggaaccaacccaaatgtccatcaatgatagactggattaagaaaatgtggcacatatacaccatgcaatattatgcagccataaaaaaggatgagttcatgtcctttgtaggtacatggatgaagctggaaaccatcattctgagcaaactattgcaaggacggaaaaccaaacactgcatgttctcactcataggtgggaattgaacaatgagaacacttggacacagggtggggaacatcacacactggggcctgttgtggggtggagggagaggggagggatagcattaggagatatacctaatgtaaatgatgagttaatgggtgcagcacaccaacatggcacatgtatacatatgtaacaaacctgcacgttgtgcacatgtaccatggaacttaaagtataataataattaaaataaaataaaataaatatcattgcaacttgagttacatcttttccctgtgagcctgtaaagataagatgctggtatcatacctgagctcaattaacatttttatagtgtgtagatatgattgatattaatacattataataaaatagactacttaagagttagcgacaaactgttgagatggtggtattgatgaaatatctctgcccattgcaggagagttgcagcaatccactcatatagtgattaccccttgtgacaaaagaaaatatcttcatatttcttcattttaagtcaaaccataaatgtaggcagagatgtttttaactaacatgactatgataatctatgtgccattatctaattgctcacagaaatcaaactgtacaagtgccgaggaatctgaatccagtcttgagctgtcagtggagaatgtcagttatttcagtaaattgcccccttagtgtcatcctgtataattctttaattttaggcctaaaaatctatgaaagaaattttgtgtaaaatgtaccaaaagaactgtcccatttaaaacattttatgccatgcttggaaatgaaaatggaccctacaagtaagtctgtaagttgttttatcaaagtattcagatggaatggtaacaacttggcttgtgtgttctctaaaaaattatcacattttcaaattatgcatttaatctgtattaacatatggaagttttgatgtagtttcctttctcagtcaactccaaagagtcaaaagtgattatcaaagttgaaaaggctttttgtattttcttcaaatgttaaagccatgtaagtgaacagcaaggctgatgaatttgctgttttatttcattgacatcttaattcaaaatgtaaactgaagtttcttttcatttctttgcactgttaatattattctgtttttggttagcttgggtaaaaactgttcactggtgtcattttttataattagccttttatatcttgggttttttggtaagcaaataaatattttaaatgtaaaaaaaaaaaaaaagaaaatcttgtctcctagaatagggacagtttcatttcttccttttcaatttcagtatctgttgtttcctttccttgcttctttgaaattgtaaagatttttgcacaatgttaaatagggctggtgagagtgaacatctttgtcttggtcatgatcttaatgagaagtattctatctttcaatattaaacatgacgttagatgtgggttgtatgtagctgccatttatcacataaaagatttttttctattcataaaaaaacagaatctttcatataattttaaatgattctgacaattttatttatattagcatccttcatagagcactgtagaaagtaggaactcaataaatagctattgatataatttgatttttgaaagtatttttaagtgaaatgagactaaagatttgaagttactcaaaaataaaacttatatatcacaagatattacattcttaataattgccttactaagaaactataactctgtatgactcaattggtttccattattaggataagaatcagaatggaatattccaatgttgcaatttattttagaatagccatattggagggaaagagggggcaggtatttttgaaattcacaaataattcttacatacaatttatatttattctagtattcaaaatttgactctacaaattttgggaaaataggaaaaagactaaaaataagctgaattatatcaaactaattctctgcctttgagataccctttttaagcctaaaaagcaatgaattgaagaacaggcattaacaagacatgacaataggactaacaacaattaacttctgagggaacaagtagttaattgaattcttgtgttctctccatgacaatttttacatgataagtttgggttaaaaagttatttgcctagctcattcatcctagaaaaaaggtggttttaaatatttttctttttttttttttttgcacttgacaggtaaactaattttgttctcacataattggttgtcatatctaaattctaaattagagacgtgattcattttcacaagatgacacaatcattcagtagcagtagttgtgatactctcagggtggcaaatgtggagtgtgtaatggaactagtaaactccttcartgccaggaaaacaagtctctcagactcctaaaatggccttaaaattggctcattctgaactttaattttacttggcaaaagtataaacttaaaaacagttatctttgaaatagagaaagtaagagctgcagtgtagattctcaaattattttaaggacaactgtcatttcaaatgaaagtttcaggttaggttttgaggggaaagtggtagctaactagtttttcaacattttgacacacaaggtcaaatatcagaaagactattttttatgtcatgktataagaaagattttgtgcttttggtgttaattctctgactatacctagtatgtcaatttaatatgagtatcttggcaaaaagacattagatgttgaattttggctgagagataatgcaaaatatgtaagattgaccttctctctcccactgccacctcactgtctccctcctcaaagggtaatctttcaaccaaacttaccagtaggaaaagagaaaatcaaaaatacatacacataaagttactatgagattaaactgcaatttcggaacttcaaattaccttatttgtcttaccttatcttgtgaagcctttttaatattattaaaataatatattaatattacaattatttatttatttgctttttattttttatttcaatagttttgggggtacaggtggtgtttggttgcaaggaaaagttatttagtggtgatttctgagattttggtgtacccatcacacaagcagtgttcactgttcccaatgtgcagtcttttatccctcactccccttccacccttccccgcaagtacccaaagtccattatatcattctcatgcctttgtatcctcatagcttagcttccacttataagtgagaacatacaatgtttgatttttccattcctgagttacttcacttagaataatggtctctaactccatcctggttgctatgaatgtcattatttcagtggtattccagggtgcwtatatatatatataatatataatatataatatatatatggtacattttctttatccacttattgattgacgggcatttgggctggttccatatttttgcagttatgaattgtgctgctataaacatgcgtgtgcatmtgtctttttcatataatgacttctttttgtctggggagataccccatagtgggattgctggatcaaatggtatatctagttttagttctttaagaagtttccatactgttttccatagtattgttctagtttacattaccaccagcagtttaaaagggctgccttttcaccacgtccatgccaacatgtattatattttgctttttgattatgaccattcttgcaggagtaaggtggtatctcattgctgttttgatttgcatttccctgataatgagtgatgttgagcattttttcatatgtttgttggccatttgtatatgttcttttaaaaattttctatttatgtcctttgactatatttggtgggattatttgtaatttttttttcttgctgatttgtttgagttcttgtagattctggaaattaattctttgttgaatgcatggtttgcgaagattttctcccactctatggattgtctgtttactctgctgataatgtcttttgctgtgcagaagctgcttagtttaattaggtcccatctatttatttatttttgttttgttgcatttgattttgggttcttggtcatgaactctttgcctaagtcaatgtctacaagagtttttcccatgttcttctagaatttttatggtttcaggtcttagatttaagtatttgatccatcttgcattgatttttgtgtaagttaagaggcaaggatccagcttcattctacatgtggcttgccaattatcctagcaccatttgttgaatagcatgtcctttacccactttatgcttttgtttgctttgtcaaagattagttggctttaagtatttggttttatttctgggttctctattttgtccctctggtctatttgcctttttatgtctatgtcccaccggtctatgtcccactgctctatgtaacatcctgttttggtaactatagccttgtagtataggttgaaataaagtaatgtgatgcttccagatttgttctttttgcttactattactttggctgtgtgggctctttttaggttcaatatgaattttaggtttgttttttctaattctgtgaagaatgatgatggtattttcatgggaattgcttgaatttgtggttgcttttgaaagtaagatcatttttgcaatattgattctattcatctatgagcatgggatgtgtttccatttgtttgtgtcaggtatgatttctttcagcagtgttttatagttttccttgtagagatctttcacctccttggtcaggtatattcctaaatactttatttactttttttttttgcagctgtcttaaaaggggttgagttcttgatttggttctcagcttggttgttgttggtgtatagcagttttaccaatttctatatattgattttgtattctgaagctttactgaattcatttatctgatctaggagcatttgaaggagtcattagggttttctagagaagtcagggttttctaggtatacaatcatatcattgggaaacagcaacagtttgacttcctctttactgatttggatgccttttatttctttctcttgtctgattgctctggtaggacttccagtactatgttgaatagacgtggtgaaagtgggcatttttgtcttgtttcaattctcagggttaatgctttcaacttttccccattcaacataatgttggctgtgggtttgtcatagaatggcttttattactttgaagtatgttcattctatgctgattttgctgagggttttaatcataaagtgatgctggattttgtcaaatgtcttttctgcatctattgagataatcatatgatatttatttttaattctgtttatgtgatgtattacatttattaacttgtgtgtgttaaaccatctctgcatccctggtatgaaacccacttgatcatgttggattatctttttgaaatgctgttggatttagttggctagtattttgttcaggattttctcatctatgttcgacagggtcattggtctgcagttttctttttttattatgtcctttcctgtttttggtatcagggtgatactggctccatagaatgatttagggaagatatcctctttctctatcttttggaatagtttcagtaagattggtaccaattattctttgaatgtctgatagaattcagctatgaatccatccagtcctggactttttttgttggcattttttttttattacttaatctcactacttgttattggtctgttcagagtttctatttcttcccgatttaatcaaggkgcattgtgtatttccagaaatgcatccaaatcctctggattgtccagtttgtatgcataaaggtgttcatagttgccttgaatgatctttcatatttctgtggtatcagttgtaatatctcccatttcatttctaattkagcttatatggatcttctctcttctattcttggttaattgcactaatggtctaccaattttgtttatcttttcaaagaaccagctttatgttgcatttatcttttgcattttttttgttgttgtttccatttcatttatttttgctgtgatccttgttatattttttcttctgctgggtttgggtttgtttttttcttgtttctctagttccttgatgtatgactttatattgtctatttgtgctctttcagactttttgatataggtatttaatgctatgaactttctaccctagcaccagttttgctgtatcccagaggttttgaaaagttgtgtcactattattgttcagttcaaagaatttttaaagttccatcttgatttcattgttgacccaaagatcattgaggagcagattacttaattttcatgtatttgtatagttttgagggttccttttggagctaatttccaattttattccactatagtttgagagggtacttgatataacttcaattttctaaaatttattgaaacttgttttttcacctattttatgttgtatcttggagaatgttccatgtgctgatgaaaaggatgtatattctgcagttgttgggtaggatgttctgtaaatatctgttaagtccatttgttctagggtatagtttaattcgattgtttctttgttgactttctgtcttgacaacctgtttactcgtgtcagtgcagtactgaagtcccccagttactgtgttgccatctatctcatttcttatgtctactaataattgtttcataaatttgggagctctcatgttgggcgcatatgtatttaggattgtgatattttcctgttggactgattttttaaatcatcatataatgttcttgtttgtcttttttttttgacatggggtcacactctgttgcccagggtggagtgcagtggtgtgatcttggctaactgcaagctcttgtttgtcttttttaactgttgttgcctcagagtctgttttgtctgatataagaatagctactcctgcttgcttttcatgtctgtttgcatggaatatctttttccacccctttaccttaagtttatgagtccttatatgttaggtgagtctcttgcagatagcagatacttgactggtggatttttatccattctggcattctgtatcctttaagcagagcatttaggccttttacattcaatgttagtattgagacgtgaggtactgttttatttattgtgctagtttttgcctgaatacattgttgttgttgttgtttttccactgtgttattgtttcataggctctgtgagatttgtgctttaaggaggttctgctttggtgaattttgaggttttgtttcaagatttagaactccttctagcctttattgtagtgctggcttggtagttgttaactctcagaaagactgaaaaagactttctccttcatttatgaagcttagttttgctggatacaaaattcttggctggcaattactttgtttgaggaggctaaagataggaccccagtcccttctggcttgtagggtttctgctgagaaatctactgttaatctgagaggttttcctttatagattagctgatgcttttgcttcttagccctcaagattctttcctttgtttgactttagataacctgatgattatgtgcctgggcgatgatctttttgtgatgaatttcccaggtgttctttgagcttcttgtatttggatgtttggatctctagaaaggtcatggaagttttcctcaattattccttctaaggaattttctaaacttttagatttatcttcttcctcaggaacactaattattcttaggtttggccatttaatataatctcaaatttcttggagtctttattcattttttttagaaattattttttctttttctgattgggttgatttgaaatccttgtctttgagctctgaagttctttcttctacttgtttgattctattgttgaaactttccagtgcattttctatatctttaagtgtgtctttcattttcagaagttgtgattgtttttttctttttgatatctatttatctggaccattttttcatccatatcctgtatttttaaaaatttcttttcattgcttttcagttttctctggtatatcctggagtagcttaataatctgccttctgaattgtttatttgacaattcagaggtttcttcttggtttggattcattgctggggagccagtgtggtcttttgcgggtgttatagaatcttgatttgtcatattaccagaattacttttctgattccttctcattcaggtagactattccagtgaaaaaatctggaattcaagggctgctgttcagactcttttgtcccatggggtggggtggtcccttgctgtggtgcactgtcccttccccttcccctagggatggggcttcctacgagccagactggagtgattgttactgctcttctgggtctagtcacccagtgggactaccagcctttgggctggtgctggggagtgtctgcaaagagtcctctgatgtgattcatctttaggtgtttcagccataggtaccagcacctgctctggtggaggtgtcaggagagtgaagtagcttctgtgagagtccttgtagatatatttagtgtgctggctttcttgaatgctcattatgctaacagtgaagttgtcacatggacagactcaggaccactggttagccaggatgttacaggcagtgggattagctgttgttttctccttccttggagcagggttgttctgtcatgagttgctgtaatgtcctgagtttgttggcctccagccaggaggtggtgcttttgagaaagcaccagtttttcacctgtctcatggaatttgcagcaacctgttgctccattcaaaggatctgattatttaaaacatagaataattcacacattgattcagcaaatatttgttaaatgcctatcgtggtaggtattattctagacactgctgttgtagaaggaaaaaaacaaagtatttgctcttctagaacttactttataatagaagagatagaacataaacaagtaaatatagatcacagtgtcatacagtagtaagtgttataaaaaatgaaatagagtgagagatgagagactcagagagtcttcagatagggtggtcagggaaggcttgcctgagtagrtgacatttaagcagataatttttttcttcatttatgtgacagatatttattgaacactcaatatgtataggtcactatgcttgctactgtacggttacagattaagacaagatgcatggtttcagaatttataatttagccaaggagctgaaactgtataacattaaatgttacaagttaaatgtgaatgatgttaagaggtcagaagaggaactatttcttttaatcctagttattaaggaattctacctgaataagatgggccttagagagttggtgtgtgaataggtagatgtgggtctgtgtgtaaaaagaaattcatagaggcatgaaaaagtataccatgaatgaaaacaaaaccgacagaaatataagaggtacctagagaagactaagaatattgtttgggttggacaagaaggtgtacttcagaaacttagctcctaacaattcaaaacagctactgcaagcaaaaaataaatttaaaactttgaattctttttttgaaattcaggcaaactttgcgttctcttgcattaattcatctatctttattttaatagaaaattattcttccttaaactttttgagcaaaattaacacttaagaaggtgtaccatatttactctatggcttccagtgcctctctcaaatacttaattggatattcatatataactgaaaagcaaggatagaagaatagagggaaataattctgaaaacatagattagatctatgtattattgggtcttaaataacagagctccacatttgaattttatcatatactaaacgaaaaaactagcaaaggctttctaatggggcattagccttatcttttatcatgttgttttctccatccagagtgttttcatcttgcaaatcctacccatattttatggtccagttcaaatatcagtgttcaactcagccttctttgatttctatgctggcctttcatggcagttgatcagtaatgccttagcacttaccacattttaccttgaattttagtcattttatgctgacggctctgtaccctgcatcactatgaacaaagtgacttccacatggcaaataagaaattcttatagaataaatgaaaatgccccagagtagaataattaatctagtagccagatgaagaatgtgccagagatgggtagactagaagcagtaaaatttgtcagtacgctgttacaataagtcaaccatgaggtagttagcacagaactaggaaactgtcattgactgtttgaagtaaaatagtaagaaacgaatatgtaacatattgcagagatataatctaagtatttgatttgactggggaagagaaagacacccaaagaggctggaatgttggtctattaaccatatttgggaattgcagacagagggctggtatggagggaagatgtcaaatttggatttttgacatgttgagatcttttgcagatggaagcattatacrgaactgtcaactggcaaatggaaactatttctagcaaagattatgaatgaagagaatttaagagccatttgtatagcagtgacattggaactcatggtgatatatgaaatctctaagccagtttgagtggatagagagaaagggaggaatgaagataaggaatgttccattgtgtatatataccacatgttaaaaagggtgagagaaagaagggaatagaaaataaagagtggggaaagaaagatcaggaggcaggaagagaagcagaacatactggaaactctgaggctgaggagtaacactggtaggacaactaagagacctttagagtggtgggaataaaagatttcaggaaggtgaagagagaatgatggtgaaagaccccataactttggttgcaaatgctcacatgagatctagatggctctagaaggaacaagaggcttagtataggctgatggccagagctcggatcatcaagtgaaaacagggtggtattaatgccccaacaatggaatctttacactcctcccttccccaccaggcacaaggcatttcattctttgcccatcctgtcctgtcctcaaatttatcagcagtgccagaagatactgacctctctaatactgttctttctgttcaaaatgtatctgtcctatgtcctacttctttggggtggcattttccaagtatgttccacaaattgtagttcttcaagatgctgtagactccaagagaatggattctgtgatcaggtaagtcttgaaaatgccacaaggagtgctaaatatcctgagaaaattgatgaaaaaaaamccttattgactttgtttgaagtacaaaacattatttgttcataggcctgccccctcttttaattgttattgctataaaactcggtgatttcataatacccatgtggggaaactttgctttagggtcgtggtgatggataattaatctgataaattgttacatggtttgttgttaacgattatgaaaggataattaaccttctattgtcaaaaatttataatttaccagataatttaatgaggtaataaaaatrtttagtgtgggaaactcagtattatggttgtcaagtggggataaattttgggcagcatagtcttttaaaastcttggatcacatcattcaagtggatagtggctactcaatgtctacatcaattttagatccacagctaaattctatatcctttttgctagggctattactgtgtttcgaccccaaaacttcaatcaatttttcatccagcctgaagaatggaaaggaggtatacagcaccatgatgacatcttgtgtgctgcgtttttacctccacaaactcttgttacgggtaaattgaactttcacttgacaatcattggtgaagtttgatttgttttggtttgttttggctcactcacctttagaaaagctttttctcagttgttttatatatatatatatgtatatgtatgtgtgtgtgtgtgtatatatatatatatatatatatgtgtgtgtatatatatatatatatatgtattttgagatggggtcttactctgttgcccaggctagagtgcagtggccagatctcagctgattgtaacctccacctgccaggttcaagtgatcctcccacctcagcctcctgagtagctgggaccacaggcacgccccaccatgcctggccagttttttgtatttttagtagagatgggtttttgccatgttgtccaggctgatctcaaactcctgagctcaagcaattcacctgcatcagcctcccaaagtgctgggattacaggcgtgagccactgtgcccggccatatatttctttttaaatttatgattgacacataatattaataattgtacatatttatgaggcacaacatgatgtttcaatacatgtataaattgtgcaatgatcagatcatggtaattagcatattaatagccttacacatatatcatatcttagtgatgagaacattaaaaaatcttttttctagctattttgaagtatacaatacattattgttaactctagtcatcctactatgcaatagaacaccaaaactcattcctcccatataactagctttttacccattgaccaatctctcacccctcctgtctcccctccccatcctctggtatccactgttctactctgcttttatgagaataactttttagattccacaactaagtgatatgatgtgatatttgtctttatatgcctggcttatttcacctaacataatgtccaccaggttcattcatgttgctgcaaatgacaagcttttattctttttatggctgaatactattccagtgtgtatatataccacattttctttattcatttattcattgatggacatttaagttgattttatatcttggcttttgtgaataatgctgcaraaaacataagggtgtggtgcagatatctcttccacatgctgatttcatttccttacccagtagtggaatttctggatcatatggtagttctattttcaattcctccatatcattttccataaaggctatactaatttacattcccaccagccatatgtaagtgtttcctctgccccatatcttcaccaatacttttatcttttgattttttgataggagccattctgactggaatgaagtgatgtctcactcacttaggttgttttgatttgtatttccctgataatcagtgatgttgaacattttttcgtatgtctgttggccatttgtgtgtcttcttttgagaaatgtttattcaggtcttttgtccatttttaaatcaggttttctttgttgcagagttgtttgattttgttatatattttggatattaaccccttatactatcagatgtaaagtttgcaactatcttctcccattttgtaggttgtctctttgctttgttgatggtttcctttgagcatgaatagatttttgaagaagcagcacttgctcttctttatccttatttctagggaaatatattggtagttctgatcatcagctcctgtgcctggctgtctgatttcccctcacggctctaccaattgccacaacttgataatgagcaagttatttaaactctaaatcataattttgtctggctgataataatatatctatattttggtttatagttcagattatctgtgcaagcatttaacacagtgctcagcacacaataagctcatccataaatattagcttttatttgtattgtccattttccaggagcagctttagggctgtcaggtacgaatcacacgttggtggcacttagatgtttcataatgtgaacatagtaactctttggcataatttagcccagataatgttgataaaagtctgtcctcacaaaatgtctacaaatccaagctcttaaaatgattcataggcatgctttgatgtggcatattaaagagaatgaaaaattgttgtatcatttctggccaaagaatgcaatttatagagacagattgcaccatgaaattttcaagtccatattttgacagctgaattttttttatagaaccaaaaatgtcatcaattaagaggaatgaaaacttacaggaaaagatccagggtatctatgaagtgttacaatatgaggtttactgatctatctatatttaaagttcccctgttttcaggactaatgaaattactttctagtaaggccaactctgtaggtaaattagctttatagccactggaaggccacccctgcagggaggatcacatcctgaaatgtgatgggcactgaagtgtaaaatggtgtggttgttattgtgaaagtattagtaaataccgttgtattggtgggtagacaatctcttcactcattctcctcccatcaatcctatgtggaaatatttggtcagtcactgctagtaaagcataggagaagatggatatttctatggacagctgaactccatccccctggttcaatttgtgagcttcagagattgtgctttctttttctttttttttggatggagtggagtctcactctgtcgcccaggctggagtgcaatggtgtaatctcggctcactgcaacctctgcctccagggttcaagtgattctgctgcctcagcctccctagtagctgggattacaggcacatgccaccacacccagctaagtttttttttttgtatctttagtagagacggggtttcaccatgttggccaggctggtctcgaactcctgacctcctgatctgcccacctcggcctcccaaagagattgctctttctaggacaatacagagtttggtgtgcatttctctctcctctcccctaatcccaaaaaagtcaccatttgtacatcccacccaaactcttctgctctccttaccatagacactctgctcagtgggtagctgtcctcactgagccactgagaacaatggtctgggcgttgctgctttgttcctccacaggacatggttgctcagacttcacctcactttgggcttttgggctatttgggcttttctctgttctctgtgaagagcagtactgaaggactttctgtaggaaaaacttcaggattggagaagacaatattcaataaagacaatattcagtattcaatataggagggaaagtatgaagagaagacacacacacccacccacacacatacacacacaagaagggatgtaggaaacagaaacataggaggacttgatttacttgcttttacccaataataaaaagtaggatggtaattaacattttttccagtacttacaatatgctcagtgctattgtaaatactttcattctctacaataaccctatgagataaataaaattattaactcttttttatagatgagaaaattgcagcatcaagcagagttaaataacatgcccaaggtcacacagtaagtgggagaaccaagactcaagctccagttttttatttgcaaagcatctgttctgaatgctttattaccataaaataaaaggaaacaacagtaatttctacacacccatgctcaggttatactgtggggattgtaagctctagagttaaaacaaataccaattattattattcatgtttctaaaaatatagagtgcccactatgtgccatattctgtggaagatatgttgctaataacttcttctgattgctgttgctcatattttctatcttaatctcctggmaatttatattctccatcctgtcttgtgtagggagttatgatggagaaattgttctatggaacaatagcacagagaatgctcaccatgttcttcaccctgattaccagaggttgctaaagtcaaaattaggtaagtgtgagtttgaaacgaaaataacatggctagtcaaatcacagtaggcctggttgttcatgcatgtgcctgatgcgacttgatcctaaattatagatgattggctataagcctgaaggattaaggatatcattgtcttgccaaagtagctaaagagaaccttgagatttacttggcttagcacactctccatggcatgccatttcttctctttatgctacattggtatttctgaactaccgacagcagggagcaagactgtcatttttatttagtttattttttttcaataaaccttgccaaattacctaagagtgaacgttagataccctttggtaaaaaaatggaaattcatgttcactcgataggctgttcagactcaatctagagcttgtaataaatattatgccacctggaaatcttaaattattccttgctttagaagcccatgaggaacattagatgggagtatattgtattttatgggagtttagcagagcacatgaatattttatacttaagtaaaatgtcttgacaattgcctttcacattttatttcagtttccttagatactaaaggtttttctttagactaatttattttggtaatgaaaatgtcattcttcatggcccagtgaggttctgttgtctcaactgaataaactcatagaggctgaattgaactttaggaatggactgatcatcagatgcagttttctttttgggtgaaaagctgagaagctattttcttaagagtaggaaaacaaacttaagagatttaggggatacttggttgcaaacacaaagctctgacctgctttatgtactaagagctaatcattttaagattcatctgaacttgccatgaggaggttggaattctgcctcttcttctacactgggctttacaatacacagagagataattaatgagaaaagtgaataaatatcaaatttctaaaagacatgaaaggcattgcaatagatttcttattttggaattttgaaaatacgtctgtatagatttttcataactatgggcagactgttcctagattctgagacgaatatccccagtgtttactagtgtggcctggagatgatgtcattagataattgaagtatgcttagaaatgttttctccagagtaactcgctaacaaatagtattgttaaaaaggctcatttaattaaacataaatagtctttagaactcatgttcattataatatttccaagattaattttaatgattaataagttgaaaatgccacagtattggaattacgtttgtcctgggcatattaggatccctaagatgttagcattgatgccaatattaagttcttacttaattcatatcaagtgaaaacagagcaagtgtgtatggaacatgaaaaacaaaaataatgtcaaacaattcttcaagttggggttgagaaatagcagaaggcttgatagatgttgactggaagtctcttgtgagacttggagtcaatggatatagtgatagatgtgggcctgctatttcataggcattagtttgaaaagcagatatttttcttcattaatatacttggctttgtctccctcacagatacaaaacctcaaaaacttctcagtgctgggagaagccaaccctcccaccccatggcagaccattctaccacgggagtccgcaactttgagattgacactgagggcaaaaatgctgttatgagactttgctttcttaaagcaagaaaaaacactgcagtgacaggtaaaatatatatttacattttacatatagttggaaagggagcaataaagaaaatccaatctatttctactagatcttgtagaatttgactgcacgtagctaaccagtcagtagtgtgtcaagtgaggtcacagaccatggcaaaggaagttggaattgaggaggatggattcaagagcaggagccagactacatcccactactaatttatccagtgttgtatatgtcaagatcaagatgggaaaaattctgacaaattattggatacgggcaacaatcagaattgttgtcccagacctgtcataaagaggttttaatacagtaggggcacagcaagatgtatgccgaagtcaaagcttaagtccacatatagcagaaaagttgagtctgagactgactatatgagcacctaatcaaaataggctggaagagaataatgaggagcatggatgttaagaacagtaacagaatttgaaagaattgctaatcccaggacaagagctgcctgctctcttctctgttctcatcgttttgtttttttttttaagtattggttatatcttctccagagatgtatactaacattgatgctattttatgatttactgtagttatatgatattatgtaagtgaaataaccatttgcttaattttttccttgttgtcagtggcaatattagcatggtgttgatgcagcctgcatctttccaaaatgaaaatctgccttggagaataatgtatatttttttacctttcatctaaaataacaatcgtatcttcagggtatatttttcttaacattaggaactagacatatatgtattatgtatttgaaaaggaaatgaacatatctgaattatgtttattgtttcccatatttaatttacagatgaaaatctgtataattttcatataaaatttttaatcattaagaatcaataaaggtatagtttaaaaacattctgggatgtttagaataaactttgaaacaattagattctaaaactttccattttctagaacttgcttatactcacaatatgaattattatcctgaaattactctcatttcctcaatactaattttaatgttatcagtattcccagattgttctcactgaagcagctacatgttattatttctaccttaaatagatatgattgtttattggcagtacatttgtgaagcaaactggaagtcatctacagatttatcaaataataggaaccttgccacaaaagaataacttaggtaaagtgcttcaacaaaacctataaaaatggaaaatgaaaaggttagttctaggctcattcaccaaaaaggggttttataagggtttacaatgaattattgatgaaaacatttaaagaaagctcataaatagaattctaagcatgctgccaaacggagaagtcaatagctattctgctatcactacatattccatccaaatctgtgcatatggacttttacttcattgtatatgtccagtgggttattagggaagattaattttatataatgagaatattatcataatgttggaattaatatttcatgttttatctgaagaaacaattctatctaacttttaaatacccccaaaacatcagaataatgaatgaagaaaagggaactaaacgtaatggaacacttcaatatcctatctcatttaatactcaacacaaaccagtgaggttatcatagcgtcacctccattttatatttgagaaaattaaagtggtgctgggaattgatctcagggctactcacctcttcaacatcacatgctttccacagggaaagccactgaagaagttatttctggcatttgttgttcagttttctagttagatttttcccttacatgttaggaggagctaacctggtatcatgtggaggatctggttatgtcagattttgggatatatataagaagcaacttctggctgaatttttggctcatagtggagttggatcgattattatgtctactgataagatgaatcgataccttaccacaggagatcttgatggatggttgaaaatctggaatatagaggtaaattgaaaaacattatcacattacctttaagatttttggtgaccctttgttgcaggtaactatgaatcaagccttgtctgtctcctaaacaaaggaaaaaatgtatagtctaagtgttttaaataaaacatttacaagtttcatgcagagacttcttttaaataattaatgaggaaaatcatgtttttctcaatattgacaaccttctgttaagtaagtcatccaatttagaaatgcaatattgttagtaaagcactgcagcattatttgaatgtaaataattaggatacaccttatttttaatgtatgtatgtatttatttatttattttgagacaggatctccctctgtcacctagactggagtgcagtggcatgattatagctctctgcaacttcaaactcctggttccagccatcctcccacctcagcctcctgagtagctaggactacaggagtgttccactatgcccagctaattattttattttattttattttattttattttattttattttatttattttactttttgtagagacagggtctcactaggttgcctggggtgaggctacaccttatctgcaatgagattgtaaatgtaatttaaatactagaggactattccttcatttaacattattgttaycctgagttagtttgggattttttcttttttatcactgattacctgctcaattttctaataatatttgaacgttgtatatgtgaccacctgtatgtggtaaagttcatctctatcaaataattggctttactatttatatttttctttccttcctccttccccactagttccttttttttatttcccaagtaatcagataagttagaaacctttttttaatgtaatttcgttttctagcctcttttatcatgaacttttcttttgcatttggatcatargttattgttcccaagtttgaaaatcggcctttttttaaaagtgttatgtcattgtaatcatttcatatttgaattttttagagttctggtatttcttttcattcaggagtactgtcttaactccagtaagaacaaaatcaccaaggccccaactctgataagatcattccaacctcatgaggaccgaataagttccttagagatgtgtgagccaggtggtcagttactgattatctcctcctctgcagactgcagtatttgtgtgactggtgtctgcaatgctcctgtttggatctttggtcaggtagaaatattgcttctttattattctagtatttacttgacatttagtattaacttgggctgatttctatttgaatctcatcagctgtttaatgttcattagtcatgaaagaactgacaacatttccgaagcagtagctccaggcgactcttgccctgttttccattaaccaagacagttccatcaagtggaagacaccagagacatggaaagatgggggctctgtgcagctcaaaatattctaggatttctgagaaaaaattctcctctagaataaatttcttcaatttcaacatttagtaaaagttcaacgtggataaaatgatcatgtaactaaaaagacaggtgattatgactgttaactaagaacgtaataatcaaatgcagaaaattttagaaaaaaaaaccaatcatcctattcattatctggtttactgctgccaaataataatagttaacatttgctgagtttttcttgtgtacgtggggtactgttctaagatgtttttcaagaattaactcatttaatcttcacaattgctcaactcaggagggagcagctctcacaattcccattttacagataaggaaacagaggcacagagagtttgaataaatcacctgagctcacagaagctaatcgtggtagagttttgtttttaactcaagttgggtcacttcagagctcacatttttaacccctttctcaagatctgacttgctcctgcctatgaaatgaaatggaaatgggagtcatgaaagaaaggaaatatttagtctcatattttctgttattttttccttttgctttcttgggaacttttcctgttccatttgtgcttttgcggacaaaatatgtttcactggtttcaaccagtactattcaaacctggtataagtttaaggtgaagcctcaatatctgtttggccagctgatttggttctatttaggagcctcaggtgccaatcttatgccaggagagtaggcaattcttttagtgttggaagacaaggtttgttgttgctgtatttgtaaagtcagtttgatgaggccaacctgtgtggaaagaattctaagcacccctttaggatgcagagggtgttggtaaatcagaaaatcatctgggaggtggacccacattggctagacgacagtctcaatgtaacactccggagctgtagcaatctcttgtattttgtaaataagacaagcactagacttttctcagtcaggaaaaaaagcggctaagtgggaactcatacaggcttgtgatgagtgagacagggtgggacatggctggcagtctggacaggaaagagggtggaagcctgcttcaggccactgaagaagccaaagcattgctgacagaggctgtggcaagatgaggtggaggtttgaacaacaggtaaagaaacgaaacgtcatcaagtgggtgacctaagaagttccttagacatccggggtcgaaccaagaaataacaccgttctaggtgtaggtgccatataaagttcacccaccaaacataatctgtagctaaattttattttaattcagaaatgtgtgcttgtaaaactgcttatttttgtattattgatattatttgttgtttctgtgaagtcttgcttttttgaagatgcaaaaagccctcatgagaataattttattttttcccttctgttcaagacaggagaagagtcatcagagctgggtcagttttacaaattgaaggctagcaaakctggggaaaacggttttctagttccttctgcttgcactacttcttttttttaatttttattttttaaaggattgacttttatcaagctgtcttgaatataagtgccattagtcccaagatgtagagcaaagagtgtggggaagaagaaacagaaaggaggggaaagggaaaggaaaagagggaaaggaaagagagaggagaaaagggaagtttttttttttgttgtttgtttgtttgtttaacaaaaaaacaaaaattagaatcacttttataacatagctattgaccttaggctggttttcaggttagatttttaaaagtaagttgtatggtatgtctatttctagagttggagaaataggagtgaagaggatttattcataaatgcatgtttatcccacgaagctgacaggtgattgtgggataagaagaaattcaaatgatgcttgaaattcttcagtgccccactttgtgcactaactactgttgtgctaggcagaatttatgtactggcaactctcctcatctgattgatttgatgtccagtgactttgattgtgtctcttcatccagtgaataattaaaatttgatttagttgcccacatttaaacaataatagatttcatgtaaagattcaagtttctcatttctcttaaaaaaagagcaatcaggcaagagaaagaaataaagggtattcaaatatgcagagaggaagtcaaattgtctctgtttgcatacaacgtgattgtatatttagaaaaccccattgtctcagcccaaaaactccttaagttgataaagaacttcagcaaagtctcaggatacaaaattaatgtgcaaaaatcacaagcattcctgtacaccaataatagacaagcagagagcccaatcatgagcgaattcccattcacaatagctacaaagaaaataaaatacctaggaatacaacttacaagggacatgaaggacctcttcaaggagaactacaaatcgttgctcaaggaaatcagggaggacacaaacaaatggaaaaacactccatgctcatgaacaggaagaatcgatatcatgaaaatggccatactgcccaaagtaatttatagattcaatgctattcccatcaagctaccattggctttcttcacagaactggaaaaaactactttaaattttatatggaactgaaaaagagcccatgttgccaatacaatcctaagcaaaaagaacaaagctggagacatcatgctacctgacatcaaactatactacaaggctacagtaaccaaaacagcatggtactggtaccaaaacagataaagagaccaatggaatagaacagaggcctcataaataacaccacacacctacaaccatctgatctttgacaaaccttacataaacaaacaatggggaaattattccctatttaataaatggtgctgggaaaactggctagccataagcagaatacagaaattggacccctttcttataccttatacaaaaattaactcaaaatggattaaagacttaaatgtaaaacctaaaactataaaaaccctagaagaaaacctaggcaaaaccatacaggacataggcatgggcaaagacatcatgactaaaataccaaaagcaattgcagcaaaagctgaagttgacaaatgcaatctaattaagctaaaaagcttctgcacagcaaaagaaaatatcatcagggtgaacaggcaacctacagaatgggagaaaatttttgcaatcaatcaatctatctatctgacaaaggtctaatatccagaatctatgaggaacttaaacaaatgtacaagaaagaaaccaaacaacctcatcgaaacgtgagtgaaggatatgaacagacacttctcaaaagaaggtatttatgtggccaaaaaacactgaaaaaaagctcattatcactggtcattagagaaatgcatatcaaaaccataatgagataccatcccacatcagttagaatggcaatcattaaaaagtctggaaacaacagatgctggtgaggatgtggagaaataggaatgcttttacactgttggtgagagtgcaaattagttcaaccactgtggaagacagtgtggcaactcctcaaggatctagaacaagaaataccatttgattcaggaatcccattactgaatatatactcagtggattataaatcattctactattaaatacacatgcacatgtatgttttttgcagcactatttacaatagcaaagacttggaaccaacccaaatacccatcaatgatagaccagaaaaagaaaatgtggcacatataaaccatggaatactacgcagccataaaacaggatgagttcttgtctttgcaaggacatggatgaagctggaaaccatcatcctcagcaaactaacacaggaacagaaaaccaaacaccacatgttctcactcataagtgagagttgaacaattagaacacatggacacagggagaggaacatcactcaccggggactgttgcggggtgggggaaaggggaggtagagcattaggataaatacctaatgcatgtggagcttaaaacttagatgatgggttgataggtgcagcaagccaccatggcacatgtatacctatgtaacaagcctgaatgttcagcacatgtatcccagaacttaaggtggaaaaaaaaaaaaagaatgtatgtcattcyttaagagtaactatggcttttatgtaaaatgggttctctttaattcagtatagtctctgaatttttttattgccttaaaaactgagggtgagttttatttactatttattacccatttattttcttgtattaggttcaattcattcattgatattatttgactggctctgtaggcattttattctgcaaacacttatgacaagtctgatcaatttgygcaccagccaaatatctgcaggatgcctacggttcccctcatatctcacaggctgcattctctggaacattctgtgtgcatgaagtgtattgatataagatgagaaaattggctctgtatttaaaacataaaatagattgttaatggggaacttttgctagatgaatgcattttaagaagtgtagccaaatctgtgaaaactattatataacacacataatttttagaaaacaatatttaataactgaattggcttttgaaaacatttaaggaggtaacacgcaaataaagtagttgagggaataaataagtgtggcawttctttaacaaaagctttgttttgtttttagtaaatrtacatctggctattcagaattttaaaatgggaatggtaaaaaaatttttgtagttcattattatctcttcagagaatttttgtttcttatgacatatctcattttctacctttattaaagttacatgaaactctttcatttcccatgtaaaactgtaagcttcttgtggaccggagtcatatctttttcatcttcttgtgtgtcccaccccaggactttaattagtaatccagcacatggtaaacacacgtaaatgtttgaagaaaataaatttcataaaaataaaacagrtgttttcgtttttttcaggcaaagcactggcatattgaaaactgccttttccttcctaaaagagatactaatttagtggaaagtgagattcaaaaggaaatttctttattttctaaggaggaatcttgtttagacccaacagaacattctctacttaataagaaaaacaaagatgactcaacatacaagtaagtaattttgaacattagccagatgtcaactgaagtctagataagacatagataagattggtccaaatttccttgtgtcctctgtggaatgttcaatgactacctcaagatttctccaaaatttgggggattggtaggtgcgtatgaatgagtgacttatattatcggggccatatttggttcttatttcttgactacattgattcttgatatgtattaagtgccatctagtcttttactgctactccatcatcaatctaattgtgaaaatttgcccctttcttcaaaaacaatctatctatctatctatctatctatctatctatctatctatctatctatctatcttagaatgtgtatcagattttactcctggttttgataaagtgcacagcggtttatgtgacaaaagttcaaagagcttaactttgaagttagacatcacttccttaaggcttctcgtctctctatgttgctcagaygttcttctcttcacatcactctgctagattccatatttacatttcatttatgctctcatgttaaggagtttagttcttttgttttctacacttttgctaaaccatgctctcataacttaactttcatgctaaatggctattttattcttgtagagatagatatctgagcttattacttggagaataataaaaatattttggcgcttttgatttattatttgttcaatgtgagaaaagaaatggggtttactcagagctgacaagaaaatagtcattctataaaactcccaccatgctttaattcattgcttctgtaacattctatgttaaacaggtgaaacaccagagagaactgtcttttcttcttccctttaactcagtagtcacagttttcctttcactgaggatgggaagaaggaaaaaggtagcattgctgttcttgaggcttggcagatgtgcaaagcattctcttttttctgggggtatagttgagggttctttgaagaccccactgagggatctctgcattgcacatttccaaactcatgaactctttgactagtttcttatggctcacctcctccagctcatgccccttgtaatacacatcacagtgttttctgttacagtcctgcacattgccaagcctcccctcttgcacaactcctggtttaacttctgcttggcctgtaggaaactcaaacattttgcaataccaacttttccactgtttccccactgctccctgcaactccaggtacagctttttgcctgtagacttcttcaggtgttagtgagacacaggtctgctgtgtccctctcattgttaccctagaggactaccttaagctatttgggctatgtgaatagaggctagaaatgaaaaagagaaaagctttcctcccctccaatggagtgggtctcaattcacacataagactctctctgatgcaatcatcccttatagtttccgcatcctttgtttatatcttaaagtgatggttggcttaagtgtcacaagatcagttttggagctaccttcttggcaaaatgactcttcacacagagtctaaccacctcattttggcatgtagaaatacttttgtattaaacatctcaataaattactttgctttcaaactttttgaacctccgctgacacatagatagaagaaaaaaattcccctttagcattctgttatgctaaattactttggtatttgttcttccatttccttgaattatggcttgcagaaatgtcaagtggcattttacatttaggcagaaggatattttcagtttagaaatctagcatgagcaatcctgtacaatcatagaatgctgggaatggaaagactttacataggataaaatgtccccacccacctaccctactcaatcttacagatgaagaaataaagttaccttagggtaacacagacagatcattttttttctttccatcacatgcatagcagagtgaaggcaagtattacagattcctgtttaagagtatttcagccaagatactaatttcccattccttatgacaaactcagttatcctttaaacatttttttttttttgaggctgtcttgctttgttgtccagctgaaatgcagtggtgcgaccacagctcactgcagcatcaacttccctggctcaatcaatcctcccacctcagcctcccaagtagctcggactacaggcatgccaccacacccagtttgcacacacacacacacacacacatttttttctttatagatgaggttttgtcatgttgctcaggcaggtctggaactcctaggttgaagtgatccttccacttcaccctcccaaagtgctgggattacagacgtgagccatcactcccatcctaaacacttttttaaaccaatcttttcctagattcaaacattggctgtttgaactcttctttcctgacttcattttcagttaattttattttctattgttcctggaaactttgtattatgaaaatcagtgctgatatatagggttttttaaaatttattttaatttctggggtacatgtgtaggatgtacagctttgttacataggtaaatgtatgccatggaggtttgctgcacctattgacctataacctaagtattaaacccagcatgcagtagcaatttttcatgatgctccccctcccccatcccccacccctggacaggttccagtgtgtgttgttcccctccttgtgtccatgtgttctcattgttcagctcccacttttgagtgagaacatgtgatgttttgttttctgttcctgagttagtttgctgaggataatggcttccagctccatccatgtccctgcagaggacattatctcattccttttgtggctgtatagtattccatggtgtatatgtaacattttctttatccagtctatcattgatgggcatttgggttgattccatttattggctattgtgaatagtgctgtaatgaacgtatgtgtgcttgtatctttataacagaatgatttatattcctttgggtatatacccagtaatgagattgctgggtcaaatggtagtttaaatactatttctggttctaggtctttgaggaatcaccacaccatcttagaccatgagtgaactaatttacattcccatcaacagtgcaaaagcattcgtatctctctgcagcctcaccagcatctgttgtttcttgactttttaataattgctattgtgactggcatgagatggtatctcactgtggttttgatttgcatttctctaatgatcagtgatgttgagccttttttcatttgtttgttggttgcataaatgtcttcttttgagaagtgtcagtttatgtctttgcccactttttaatggggttgtttttttttttcttgtaaatttgtttaagttccctgtggactctgaatactagctctttgtctgatggataagttgcaaaaattttcacccatctgtaagttgtatgttcactctgatgacagtttcttttgctgtgcagaagctttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggcaatcattaaaaagtcaggaaacaacaggagccggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactgtaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtccttttcagggacatggatgaaactggaaatcatcattctcagcaaactattgcaaggacaaaaaccaaacactgcatgttctcactcataggtgggaattgaagaatgagaacacatggacacaggaaggggaacatcacactctggggactgttgtggggttgggggagggtggagggatagcattaggagatataactaatgctagatgacgagttaatggatgcagcacaccagcatggcacatgtatacatatgtaactaacctgcacattgtgcacatgtaccctaaaacttaaagtataataataataaaaaaagaaaagaaaagaaaagaaaagaaaaaaaaagtaaaggttaaaaacggaaaaaaaaaatatctcattkgtcaatttttagtttcattgcaattacttttgatgttttcatcttgaaatctttgcctgtacctatatcctgaatcacattgcctagattttcttctagggtttttatagctttgggttttacaattaagtctttaatccattttgagttaatttttgtataagatgtaaggaaggagaccggtttcaatttcctgcatatggctagccagttctcctagcaccatttattaaatagggaatcctttcttcattgcttgttttcatcaggtttgttgaagattagatggttgtagatgtgtggtcttatttcttagttctctattctgttccatgggtctctgtgtctgtttttgtaccagtactatgctgttttggttactgtagccgtgtagtacagtttgaagttgggtagcctgatgcctccagctttgttctttttggttagcattgttttggctatacaggctcttttttggttccatatgaattttaaaatagtttttttctaattctgtcaagaatgtcaagagtactagtttacagtcccaccaacagtgtaaaagtgttcctatttacccacatcctctccagcacctgttgtttcctgactttttaatgctcaccattctaactagtgtgagatggtatctcattatggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagattagtagattgcaaaaattttctcccattctgtaggttgcctgttcactctgatggtagtttcttttgctgtgcagaaggtcgttagtttaattagatcccatttgtcaattttggctcgttcaaccattgtggaagtcagtgtggcgattcctcagggatctagaactagaaataccatttgacccagccatcccattactgggtatatacccaaaggatcatatatcatgctgctataaagacacatgcacacatatgtttattgtggcactattcacaataacgacgacttggaaccaacccaaatgtccaacaatgatagacttgattaagaaaatgtggcatatatacaccatggaatactatgcagccataaaaaatgatgcgttcatgtcctttgtagggacatggatgaagctggaaaccatcattctcagcaaactattgcaaggacaaaaaaccaaacaccacatgttctcactcataggtgggaattgaacaatgagaacacatggacacaggaaggggaacatcacacactggggcctgttgtggggtggggggagggtggagggatagcatttggagatatacctaatgttaaatgatgagttactgggtgcagcacaacaacatggcacttgtatacgtaactaacctgcacgttgtgcacatgtaccctaaaacttaaagtataataaaaaaaatttcaagagtagtttgatgggaatagcattgaatctataaattactttgggcagtatggcgattttcatgatattgattctttctgttcatgatcatgaaatgtttttccacttgtttgtgtcctctctgatttccttgagcaatggtttgtagttctccttgaagagggttcttcactttccttgatagctgtattcctagatattttattctctgtagcgattgttaatgggaattcatctatgatttggccctctgcttagctgttatttgtgtataggagtgcttgtgatttttgcacattgtttttgtatcctgagtctttgctgaagttatcagcttaagaagcttttgggctgagtcaatatggttttctagatatagtatcatgtcacctgcaaacagagagagtttgacttcctttcttcctatttgaatacgctttatttctttctcttgcctgattgccctggccagaacttccaatactaccctgaataggagtggtgagaaagggcatctttgtcttgtgccggttttcaaggggaatgcctccagcttttgcccattcagtatgatattggctatgagtttggcataagtgactcttattattttgagatatgttccttcaatatatattttattcagagtttttaacatgaagaaatgttgaattgtatagcaggcattttctgtacctattgaggtaatcatgtggtttttgttcttagttttgtttatgtgatgaattacgtttattgatttacctacgttgagtcagccttgaatcctggggatgaagccaacttgattgtggtggatacgctttttgatgtgctgcagaatttggtttgcaagtattttattgaggatttttgcatcaatgttcatcagggatattggctgaagttcttttttcgttgttttgttttgtcttgaccaggttttggtatcaggatgatactgagctcataaaatgagtgagggaagagtcactccttttcaattttttggaatagtttcagaagaaatggtaccagctcctttttgtatctctggtagaattcagctgtgaatcactctggtccttggcttttttggtttgtaggctatttattactacctcaatttcaaaactcattactggcctcttcagggattcaacttcttcctggttcagtcttgagagggtgtttgtgtccaggaatttatccatttcttctagatttcttagtttatttgcacagaggtgtttatagtattctttgatggttgtatttctgtggggccagtggtgatatcccttttatctttttttattgtgtctatttgattcttctgtcttttcttctttattaattcagctagcaatctatctattttcttaatttttttcaaaaagccagtttagggatttgttgatattttgaagggtktgtgtgtgtgtgtgtgtgtgtgtgtgtgtgtgtgtgtgtgtctgcatctccttcagttctgctctgaccttggttatttcttgtcttctgctagcttaggggtctgtttgctcttggttctctagttcattagttgtgatgttaggatgttgatttgagatctttctagctttttgatgtgggcatttagtgctgtaaatttttctgttaacactgcattagctgtgtcccagggattttggtacatggcctctttcttctcattagtttcaaggaacttcttaatttctgtcttaatttcattacttacccaggagtcattcaagagcaggatgttcaacttctatgtagttgtgtggtgtttagtgagtttcttaatattgagttctaattaaattgcgctgtggtctgagagactgttatgatttcagttcttttgcatttgctgaggagtgttttacttccaattatgtgatcaattttagaggaagtgccatgtggcaccaagaagaaagtatattctgttgtttttgggtggagatttctgtaaatctctatcaggtccacttgatctagagctgagttcaagccctgaatatcttttacactttctgtctcgatatctgtctaatattgacagttgggtgttaaagtttcccactatgattgtgtgggagtctaagtctctttgcaggtctctaagaacttgttttatgattctgggttctcctgtattgggtgcatatatatttagcatagttagctcttcttgttgaattgaacactttaccattatgtaatgcctttttttgtcttttttgatctttgttagtttaaagtctgttttgtcagaaactaggattgcaacccctgcattttttctgctttccatttgcttggtaaaatttcctccattcctttattttgagcctatgtgtgtctggcatgtgagacacatcttttgaagacagcacaccaatgggtctttactctttatgccatttgccattctgtgtcttttaattggggtatttagcccatttatatttaaggttgatattgttatgtgtgaatttgattttgtctccatgatgctggctggttattttgcagacttgttaatgtagtttcttcatggtgtcattggtctgtgtacttcagggtgtttttgtattgactgataacggtttttccttttcatattcagtgcttccttcaggagctcttgcaaggcaggcctagtggtgatgaattcccgcagcattttcttgtctgaaaacaatcttgtttctcctttgcttattaagcttagtttggyttgatatggaattctggattggaaattcttttctttaagaatgttgaatattggccccctccccccaatctcttctggtttgtagagtttctgctgagaggtccgctgtcagtctgatgggcttccctttgtaattgacttggcctttctctctggctgccctttaatttttttccttcatgttaaccttggaaagtctgaggattatgtgtcttggggttgatcttttcatgtagtatcttactggggttctctggatttcttgaatttgaatgttggcctgtcttgctaggttgagaaagttctcctggatgatatcctgaagtatgttttccaacttgtttccattctctccgtctcttgcaggtaccccaatcagtcataggtttggttatataatctcatagttctcagaggcttcatttgttctttttcattcttctttctcttatcttgtctgcctgtcttatttcagcaagatagtcatcaagctctgagattctgtcctccgtgtggactattcagctattgacacttgtgattgcattgtgaagttctcttgtgtttttcagctctttcaggtcatctttgttactttctaaactagttattctggctaacagctcctgtaatgttttatcgtggttcttagcttctttgcattgtgttagaacatactcttttacctcagtgaagtttattacccaccttctgaagcctacttctgtcaattcatccatctctgcctcagcccagttctgtgccgtttctggagaggtgttacaatcatttggaatagaagaggcaccccagctttttgaattttcagtgtttttgtgtggatttttttctcatctttgtgggtttatctaccttcaatctttgaggctcctgacctttggatgagattttgtggggtattttttgttgatgttgttgctttctgtttgtttttcttttaacagtaaggcccctcttctgtagagctcctcttctgcagtttgctgggggtccactctaggctctatttacctgggtccctcatgcacctggaggtatcaccagtggaggctgcagaagagcaaagatggctgcctgctccttcccctgggagatccatcctggaggtgcactgacctgatgccagtgggagctctcctgtatgaggtttctggtgacccctgtttggaggtctcacctactcaggaggcacagaatcagggaccctcttaacgaagcactctatctgtcccttggtggaatgggtgtgctgccctggcgggaattccactcgtctggactgccttgattcctcagagccagcagaaggaaaggctaagtctactgaaccagagaccatggccactgtttcccccaggggctccattccagagagatcagagttctgcctataaacccctggctggagtcactgaagttaccacagggaggccccacccaaagaggagggatggatccgggtcccacctaaagaagcagttggccacgatctgccacagccactgtgctgcattgtggggaattcctcccaggccaaactgcccagtctccccaacaccggcaggggaaaacggctgattggagccacagtgatggtgactgcccctccctctgggtacttggttgtcttaggcagtctccagcatgctgccactggctgcaacccaagcgttcaccaagaatctgcacagttctgtgcttggaacccaaggccctggtggtgatctgatccatgggtttcacagatcggtggaaaaaaacatggtttccctgggaggtagctcagtcactcaccaatatataggttttatagttcacagacttctcttaaaactggagctttgttgtctaccagattaaataggagtacagcaaactgatcttctcatgttgattataagattatataggcgtcggtagacttctgggggtgagaggcaaagttatttctactgtacagcattttgtaaaatgaaaaaataacgcatcaaaaagtacttgtgatctttaaaatttctgtcttaatctaattcagatgagactggattgatataattttaagactttgtaataatgagatagtatagaaaaatgtcatttaggaattaaactaataaaaaaagggttaaaaacatatcctcagaattgattatcatgtacatccttcagttctcccaggaatatgatcaggaatcctttgcagaaattatacaaacacaataaaattgtcagctgtagaatgtcctttgtgctttccatctagtacggaaaatattataaatcattttatttttaagaaatattcttccgaagaatgtgcccctttacctagtcagattggtaaattcaaggaaagaatcatgctagctctcatccatatgaaaaaatatgaaagaaaaataaaaatgtgaaagaatttagactacaggagaaaaagtacacttggtgtatatatgcaggtgggggtatgtttagatgggggktggtgcacaggaagaaagatgaaggaaaatagaaaaagtctaaagaaaatagaagaaacaagaaacatgaagaaaaaattaagtgtcttaaagctattttctcattttaacacctaagagtctctttccaggttaaaaaattggggtgtatattatcttctggcttatacaaacatacctggcttttcacagggctgaaagtattttataatactatttgtgagaagtaggtagatggtaaagagttatcttcaagttaagtcctggggagatgaatatagaatttaagagattaatagaaaggcctaattctaagttaacaattgatatggagaaatagatttatccttttcctagagtctgcaaaactcatactagctttaaaaaacttctaaaaaaataaataagtgaagggataaaatagtaaaaaaaactacagtggacatatatttttcctagtttataggaatatttgttttttggactcatgtaaaattatctaacctaggaaaattatagataaaatgaataattcagaaaatacagtttcagaatatttccttattataaaattaatacagggattacaggcatatgccaccatgcccagctcatttttgtatttttagtagagacggggtttcatcatgttggccaggctggtcttgaactcctgacctcgtgatctgcccgcctcggcctcccaaagtgctgggattataggcatgagccgctgtgcctggccaaaaatactacatttttattacgggaaaatttggaagtacaaataagcaaaaggtgaaaatatctgtggtaaagccattgttaacattaggcatttcacttttaagaccttgctttaggcatacttacaacaatgaaaaaatgtacattttataaaaataactgtgacttagtagacacagtttataacctgttttatcgctcaaaaatatgcagtaggcacattttcatattagttaatatgagtatccatggacaacaacatttataatgacttgtagctttttaaccattttctttatttcaaatatgtagactgtttacaaattttaactgggaaaacagttctttaaataccttcatgtgcacatattagaatatcttattgaattcataattagaatacattctttgagaggaattgctgagtcaaaaggcataaaggcctttgggtcatcttgctaaaggtcatcttgctgtctggacatatcagctctccctccagcagcaatacaaatggttgctttcctgccttcgaaccaaaaatggttgttattgctgtcttaaaactgtcgctatgatatcttattgctttaaactaaagtttttgattatttgtgaaagtaaacatttttcaggtttattaacctttgataattcaataataaattttaaaggggtattcaaagtctactagactaactcctatggcatctttaagagaaacacatcccagcctttttgaatagttcctatatgacacactcacatctcacagatacccttctctattattgaactattcttaatgtctctaatgttaagtaaaatccatctgtagaactctcacttactgatcttcattcttattctagagcaacaaagagcataaactactccattttttattatctgacacattttcctttggttaccatttaaaaaattgcttatctggaagggattcattattagaaacaagtataaagactcagatgagaaatgaaacaaaaattctactagtttcccagtaagtttatacaaggcagagggcacacctcaaattaatgtttcttaaacatggaaaataattatgatgttttaaattccatgttattgttaggagggaactgatatttaatattatttaaatgctattgattacctaattattctgtcagtagatttcatgtgagaaattaaattagaaaatagataaatagctataagaaaaaatacacaaaatattaaaatcccattttaaattaggctttatgtgatgtaaatacttgacgaattggcagtctactttcaccaacaatctggcaataactatcctatgtccatgtatgacaaatgaaagcatatgatactctattcaatttttgaaatttgaactttaaaaatactagaacagcaaattgttatttgggggagtgccacatctttttattttttgtctgatcattctgatagttctgaagaatattggagcttgctgtaggggggtgttagaactccctgctttgagtgaaaaatattgtcttgcttttgcttaaagtgatagtagccaataccaactgagccctgattatatttcagggcctgttctaaggtctttatgtgtttacctcatttaattctcactgtaatcctagaagatagctactattgtcatccccatttcacaacttgaaaaacagaggcggagaagttaacagatttgcacaaggtcaaccaaccaagaggtgaactagggatacaaatgcaggcattcagcctccagagttagtactttatcactgttctgtgttgcctgtccaacaagcatcatgtgaaaatattgacaaattattggtttctgagtcaagccatcaaatattttatcaagtacctgctatgtataagccactactctaagcatttttcacttcctttttkatgcctaggagggtacttgagtaattgtcacagtcattatacctcccttccacagccagagccaagagaagtgagattagttagagcctttcctcctcataggattgatgccaaagctggtggatcccatagtagatcgccttcctgcatcacctactaaggcatttttgcaaaatgttttaaaactctatttaagcctggtattacattattctgcttctttgtcttcatccatcacttctcctcttgagaatatttgcctttttccagttccctgtgcattttcagagtaaccactcctgcaaatgtcagatgtctgtctgtgaaaaggaagcaatagattgttgacttaatttgttgtgatttccaagagattctctcctaccgtctgactacttttctccctctgtggataaaactctttagtggaaatgggcaaaatgttttgctttatataaaagctacttgatttagattccacaggatgagatagtcagaaagcatatggtctgaaaacagggaagagtttagagtgttttggaaaaaaaaatcaagatatattgttaactactctaaagggaaacctctttaccgtggcccctgccccctcaatcttttgcacatgtttacatgaataattcttttctagaaaaaggtgtattcttaatccaataactgcaaggcctaactgtaccacactccatgctttcagtatccaacaccaacttcttatttttgtagatccccttactatcttaaaatacctctctaaggatatcattatttcttgtcttgaaagcctaaatagtggctaaatactaattcttactcacatgagatggcttatggagagggatgtcattccagtgcaattggggaaaaactgcccacctatccaatgacaaagctctcctaaaagaaaaaaaaatctgtaattccaagtaatttatgttaatactctcctgattcaaggaaatcatgattaactacccccccatcccctcttaaatgtgcattgtgcttgaaaacttgcttccaaagagtaacatatggaaaaagggaaaaagtaactgtacagtagctattgtaaacattactaaaaacttggcacatacaactgtggccaggtaattgaggttaacatcaaccatggaagtcagtttgatagcatgcacccttggtttgatgcaataagagcagcagttcacctctgttgctttcctctcaacaactcataaccccagtctcaccatgagaagaatatcagacaaacccaaactgagggatattctaccaaaaaaatccaacaagtatttcttaaaactatcaagatcataataaacaagaaaaatcgtcacaggccagaggctaaggagttagacaacaaaatataatgttgacgttacagaaaaatcacattaagaaaaaactagtaaaactctaataaaatatggaattcagttaatagtactgtaccaatattgatttctttattgtgacaaatggtagtgtaagatgttataatagggaaaattggctgagggatatactggagctctactaacttttctgcaaatctaaaacctctaaaaggaaaagtttatatatgagaaagaaattaatacattactacttaaagccatgcaaatagcatttgatattaagtttaagagagatacacagactttttacttgtattgatattttaaaatcttttaaaattggaagatacggtaaaaatagagtggaggaaaaagaaagctggaaatgaacattacttgaatgctattatttattaggcacatttctgaactttcatccatcttatctcctttaaatccacagcaagagtcccattacattgaggggaaaattgaggctgaaagtatgggaaacaactcagagtcttatagctacaaaatccatagaagatataagaataaaagttagggagtggaagaatggttaactataaagggctgagggatgcagggaagggaggcagaaggaagagggtgagtcaagatccccaggactctccacgattttgagaygatggatgtgttttctggcttggtgctctgaagakactaataacaatttttggaaacataacttgtagctgttaaggttgaagtctatgacagtgaattttaaatagatttgagatcattttctattttctcacaagattatatacagctatgtaatgattttatttcccatgttttattgataaaaatcctttctgtgaattcaagttacgctaaaattttcttatagattcatatgagaaagcctcagaaatactgaacttctttgcattttggatgccataaccataaagatacaygcctaacactgaataaataagctttgacacaaaggattgatgcttacttctcattatataatttattaataaggcaaggataatgtatgtgtttctgtaaaattttcttctaaataattttttctctaaccttgttgctatggggacagggctttgcttaattagactcttggacactctggctctcactcttttctattatcacctggctagcaggcattttgttaaaagatagggcttgattagtataaacaaatatcactacytcggttcacaggaatagattttttgtttttgtttttgttttttttggtcaaagatacacatagccagaaagagtttctccatccctgtggttaataatgtatttcatcatgaaatattttcttccagtgtcagaccatcagaagatataaatttagatataaaatataaggaaagaagtacctgcatgaaagaaacacaaaaaccttattatggtgaagttataaaaaaatcattcagtaagtagtcactgttgttaatgtatttttataatattatttaacagattagtgtgaatacaaatgtctactctgtgtgtcaggaatgttcctattccttaataamcatgaatgtaatgttctgtgaaccccatttaacaaaggagaaaagtgaggtacaggacattaagtcacctgtccaaggctccacagaatactagcggaaaaagtgtaaggtcttagtcagtgtattggaccactcttgcattgctataaaaaaatgccagaaactgtataatttatttaaaaagaaaaaggtttaattggctcacagttctgcaggctgtacaggaaccataatgttggtatctgcttggtggaaggtgaagcaatagcaagcacatcacagggtgacagcaggagcaagagggagtgggggaggtgctacacactttcaacagccagatctctgtggacttgctaccatgaggagagcaccaagccgtgagggatccaccctcatgacctgaacacctctcaccaggccccgtctccaacactggggattacatttcaacatgagatttgggtagggacaaatatccaggctatatcattccatccctggcacctccaaatctcatgtccttctcccattgaaaaataaaaccattcctcccaatagtcctccaaagtcttaactcattccagcattaacttaaaagtacaaagttcaaagttctcatctgaaacaaggtaagctgcttccacctataagcctgtaaaataaaaaagtcatttactttcaagataaaatgggggcataggcattggataaacattttcattctaaaaggagaaactggccaaaagaaaggggctctaggctccaggcaagtctgaaattcagcaaggcagtcattacgtcttaaagctccaaaataatctcctttgattccatgcgcacatccagggcacagtggcaccaggggtgggctgccaaggtcttgcacagatttgcccctgtgtctctgcagggtacagcccttgtggttgttctcatgggttagagttgagtgcctgtagcttcttcaggcacaggatgcaagctgccagtgaatctaccattctcaagtatggagaacagtggccctctttacagagctccactaggcagtgccccagtggggactctgcatgagacctccaaccccacatttcccctctactagtgagagacaggactagctggatttcctaggccgactaacaatccctaagcctagctgggaaggtgaccgcttccacctttaaacatggggcttgcaacttagctcacacctgaccaatcagagagctcactaaaatgctaattaggcaaaaacaggaggtaaagaaatagccaatcatctattgcctgagagcacagygggagggacaagcatcgggatataaacccaggcattcgagccggcaacggcaaccacctttgggtcccctccctttgtatgggagctctgctttcactctattaaatcttgcaactgcactcttctggtccatgtttgttatggctcgggctgagctttcagtcgccctccaccactgctgctggccaccttcacagacccaccgctgacttccatccctctggatctggcagggtgtctgctgtgctcctgatccagcaaggcactcattgctgctcccgatcgggctaaaggcttgccattgttcctgcacggctaagtgccctggttcgtcctaattgagctgaacactagtcactgggttccatggttctcttccatgacccacggcttctaatagagctataacactcaccgcatggcccattccttggaatccgtgaggccaagaaccccaggtcagacaacaagaggcttaccaccatcttggaagtggcccaccgccattttggaagcagcccgccaccatcttgggagctctgggagcaaggacaccccagtaacactagcactgtggtagcagatattctctgtgagggctatgccctgctgcatgtttcttgctgggcacccaggatttctcttgcatcctctgaaatcgaggtgagattgtcaagcctccttcactcttgcactctgtgtacctgcaggcttaacaccacgtggaagccaccaaagctatggcttacacactctggagtggctgcctgagttgtatctggggccctttgagccacagctggagctggagctgcacggatatggagaacagtggtgtattccttctatgcctgtgggcctgtgatgggaggggctgtctagaaggccttcaaggccttttttctgttgtcttggatattagctcttggctctcttttagttayacagatctctttagcaagtggttgctccacagcctgcttgaatttctctcttgataatgctttttttaaatttgtttgtttgccacatgactgggctgcaaatttcctaaacatttatactctgctttttctttaaatataatttccacctttatttcttgctcccatatctaagctaggctattagaagcagccagggaacatcttgagtgctctgctgtgtagaaatttcttctgctagataccctaaattatcactgttaagttcaaacttccacagatgcctagagcatgaacacaatgcagctaaggtctttggtaaggcataatatgggtgacctttgctccagttcccagtaagttcctcatttccatctgagactttgtcagcctgtacttcactgtccacatcactatcaggactttggctactaccatttaaccagtctctaagaatttccaaaattcccctcatcttcctgtcttctgagtcctccaaactcttycaacgtctgcccattagccagttccaaagccacttgcacgttttcaggtatctttatagcaatgccccactcttgttaccaattttctgtgtcaggccatttttgcattgccgtaaagaaatgtctgatactgggtaatttataaagaaaaggggtttaattggatcacggttctgcaggctgttcaggtatggcaccaacatttgcccaccttctggtgagggcctcagaaaccttacagtggtggtggaaggtgaaggggaagcaggcaacatcacatggtgagagtaggagcaagctgggggtggtgccacacacgtttaaaccatcagatcttgtgagaacccactcactattgcaaaaacagcaccaagggaatggcaccaaacaattcatgaaaaatatgtgcccataatccagtcatcttctaccaggccccatctccaatgctggggattacaattccacatgagattcagaggggacaaatatccttactatattagtcagaaaatatgtgtgaagtacctgatacagttctaaaaaaagagatggcaccagaatttttattctttcccttaagtatttaagaaatgaagatgaataaaaactatttttgctcgtcagaaatcctgaagccacacagaacaatgcattagtctagttgttgacggaccagaaaacaattaaagaccagtaacctaaaacaaaggagtcattattatactaaggtatattgcttagaaacagataagaatccttcctgaagctttattttataatgaaaatatgttacttactacaaatatcttttcaacttatgtccaagggaatgtcacactttcatagagcagatatgttgatttttaaatttctgatgaaattttgctgtaaaaatggtgcataattatttgttaacattcaatgcccatttatcaactaatctactccacggagtttttgttaggattacacgagatagatatgtaaagcactttgactactgcctggcatattatagcaaccaatacaatcttattagtaatgttgttattgttataccttggagcataacctttgggattaaacatatttcaacttaagtccatgatctgctatttaacagttatatgaactgagacacaaattactaacgcatcctaagcctcagtttcctcatctgtcttaatggcacgataccttacatgttgtgaagatttcttctctaatttgacatagcacattagttttcaaagagtggtccctggcctagcaccgtaagcatcaactagaacttattagaaatgtaaattatgagaccctcatccctgctttcctccattagtcagaagccaagggggtcacatagcagtctatgttttagtaagccctccagatgattctgatgcctgttgtagtttgaaatccactgacatagaacctgacttgttccatagcaggtgctgaatacggattagtttccttttcttaggtactgagtcaccatcgtgacaaaaacccagttcctaccttcacagaactaacaaagaaacataaaattttatcccaaatagatttccattctattatccaattactacatgaagcaaagagaaatatcttttactttgttcaagactttgcctttaagagcatgattaaaatagattcctatcatctcattgtgtgcatrataaatacaataacgcagctctggtttacttgatgacattatttaaaaagtacctgccaattcaaaattttagatgtgttgttaaactaaacactgaaaaaaatagattccatttcacaaaagatacaattttcttgtagataaaagaaaaactggagcttttccaaaactgcagaatattcattttcaagggaaaatagcagaaaaatacaaaataaaaaaaaatgaatgggaagccttgagttcctyttggttcctttgaataaaaagcactatggatttattttgaacagctgtgtttrtagggtttgcagatcactgcagctgtaccagctgagtaacaggaaggttaaawttataaaagttaacttggaaatrtrctggctctttccaaggagttawtgatattgtaccctttttctccctgtcttcctctaaaacctgctgttgtgaaggtacatttaggtcattaaacattggagccctggaagagctgcctgaagtgaataaacctgctttccttctagaccctgagaaatactttaggaaagaaccagaggaagagcgtccccaaattcyggargccccgtcactttttaaaagtaagttctcagccatcatacacctctattatccctcttcaggaaacttagtcatttaaaaatagagtagaagagcatgaaaataacaagtgtttgtcttgtagtttgcagtgaaacaaagtgtggtttgactgttaagatttatagttcagctgctgaagtgtgctctcagataggagagccaacaggctgggatatatgaaatgaatatttttattttgttccttttctgaagttagaatgccatgaacatgtatctatgaatcttccgtggatgagaatctctctccccaaataaccttaattttcaaaactgatgctggaggaagccatcataagaccactttagaacacagtgtctggcaatcttgttttattttcatgtgaaacactctaaatagagacgacttaaaatgtattgtcttaaagtcttccagctgcagtggtaggctggtgtggtgagaagacaagaaagcttaagttagaaactataagtgaatgatccctaaagatatagaaacragatgtacaaaataattctttatttttcagactattatagtcttcagagttcttaaaagtttgaggaataattctgtagaaaaattcttccagcaaagaggggtcctgtgaaagaacaggtaacacaacctgattctcagtgaagcactcagaaagcacatggacactgcaggggaagctcatttaaaataattaataaaaagtttaagttttcaacttgtaacaatcagaaaaaatcagaattaaatgaagctatctgagatctgtggtttcaaaacttctaaaatcctctgagctggggttcaacatcatccttgagaaataataatgtttgcagtagaaagatgtttccttatgtccacagttaggggagtttaagagtctcctctttgctttgtctcttatggaaagggagaacagctggtcaacatttttgttgttgttgaaattctacttataggcaaggtacagctgtcatacttcattaccatagtttacagtctaattattatcaggttttgttttttttattttaaaaaacattttcttagaatttctctttgcttgctcttgtgagggcaatctatggtttctactcatttctcttaaaaacgaagccataactttagggctcttttgggggctcagaaaatgatactccaaaatatgccactttggcatgttgagtgctttgaacaaagtggattgaaaggcctcggaaccagtctctctcttaccttctcctgctgtctaccccacttttcctttcaaagttcagggagggctctctctgaaattcccttatctgactgaggagggttcttcctaaagaaatgcaactgtattgaaccccctctctaggaatctcatcaaacaaccaggaaatgttatttatcagaggagaaattaaaagtcattaccacacctaaacaggctattgcctatttctctggagggtgctctaaaataactcttttttaacctaagagactacctgcataataagacaacctttgttcacagtgcagttctacccctcaccttttaaaacttgtcatcacctcccccagagcacagagaaactttgtcccaggctattttctgttccttggactcattcatttcctttagaaagtatttactcttcctctaaaattggctacccctctcaccctcccccctccaccctgccatttgccatttccctcttctctgtgaatagggtatttaagctccaaccctcaggcccttctttgagtctcatattttgtggggttttcatacatatgtgtacattaatacatttgtatattattccctgttaatcttcatattttcaatttacttcaataagctcaattgcccaacctccagagggaaggtttaaacttctctacagctctaaataactcttagtgtgtctgataaggatttcagtctgtcatcccatcacttttcaccaggatgattcacctttaagaatgaaatgggggctgggcgcggtggctcatgcccgtaatcccagcacattgggagaccgaggcaggtggatcaagaggtcaggagattgaggccatcctggccaacatggtgaaactctgtttctactaaaatacaaaaaattagccaggcatggtagcgcgtgcctgttttcccagctacacaggaggctgaggcaggggaatctcttgaactcggaaggtggaggccgaaattgtgccactgcactagcctgttgaaaaaaaaaaaaaaaaagaatgaatatgggaagtacttatcttgtctttgtgagccacaaacagacatgaaacaggaatgaccagtaaaaaaagatccagacataggacaaagttgtaaagatagtccagatacagggtatgcattcaggaggaaaccaagacagaaaatggattcagaattgaggcaagatgaagaggagacagagaatatgcaaaagctggagaggaaagaagcaaaagagacaggtaaataatgagagcagcaaacacctctcttcagtggtgagagttcctgcttctatgaagaatcttttatataatctgtggcagaaggaagccacagatgaattcttcatatgggcagggaaaaagtgtgggcaaagaggtggggttaatggctgggcagaaataaccaaaatacctmaaagactctaataaattctcaaagagaattttttcccctggatttcttattaaaatttcctgtaacttccccaaagtttttaaaagatgttttctttcttttggttttttattttctttcttcaatttttcttcctttacttccctgttttgaaaatatttcctcttacttgccctttctgcaagtgaaaataattttcttttaaaagcttcaccaacttgtgagagaaaaagatgcaaattattgatgactacttgcgagagaaaatgatgcaaattattgatgacatatgacaccaccaatgaggttccatgaaaatgccaggaaaaaagttcgattcattctggctggagcataggaaagaattcagtcacatttgagctgggacttaaaggatgagtaggaggtcaaaggtgagggagaaaacaaggaaatagtgaggaaggacatatcaaggttgaggaaggagcagaagtcaaaatgaacccaagttggctacaatgaatgacttcagatattgagacattaactgagttttacatttacckycgttagtagaggtaaagtcaaatgtgtttggaatgtgttaagtttggggtaytgatgcaccatttacaaataaagttctggaggactgaagcagattgtatatacactctgtgatatcatagagtctttgacaagcagatactgaaataatgtttgttcatttttgtatttagcttttcctaggatagatattacatatagtagcatttgtgctggatgctaaagaygcagagataatatgtagatacctagccttcagagatcttgacattgaagtggggaaatagataagtagacaaataattatattctacaacgagggctatggtagagataagtactgcatcctatgggaacacatgaaaattcagagatgacttttcagggaaaccagagtatacccgagctagatgttaaaagttaagttgctatgagccaggttaaaaaaaaaaaatagcgggggatgatactctggtagaggagtggtataagcagctctaaggtggtatgaataatatggtgtgctaagaaagctacatgtagttcccactggctgggttctagaaggagcatgaagaaaatgaggctagacaggtaggtgggggccagaccacagaccatctagtaaactatgctaaggactcggcatttatttaatcagaaatagggagctattgaaatattttaatcaatcattctgaattatataattttatatcctatattacctcttcaatgttcatatttatttgtattattcttaaagtgattgttctagaagttacaatgctctttcttgtgctctttattccttcttatggcactagactttcatctgagaccattttccttcagtctgaagaattttctacagaatttcttaaaatatgggcctgcttgtgaataattttcccagcttttacatgtctgaaaaatgcatttatttcattttgactctgaaaggatttttcaytggatttgaagctctagatgtcagggttgttttgttgcttttttttttttttcaaatttttaaagttaacttatttccctgcatccatagttcctgtttaaaatcctgctcttaatgttattgatgcatcttattctggctgcttttaaaatacttctctttagccttggttttcaratgttttactgtgatgagtctaagtactgttttttttgtgtgtgtatttatgctacttggrgttcatagaaatttatcaaatgcatcttttttcaattttgaatacttctcagccattatcttttttcaaattatgttttattctcattcctgctctcttctgttatggaatagcaattacacatatgttagactgtttaattatatcacaaatgtttttgatgctcttttaataagtggaattaaataatggaataaataaaatggaaaaacattttatttccttaggttggcttcagtttgtatattttatattgaccagtctgcttttaagcccatctaatcagttcccagtttcagattatatatgtatgtatatctgaaattatatatatacacacatatatatayakrtagaaycttttatacagattctagttctcagttaaatttttctcatccattttgttcatcttttccctctgtttttgaaacatgtttataatggtaatttttaaagtcttggttgactaactccaaaatctggataatccctgggtctgcttctaatatatatwtttttcctcttggtttttagtctcatttttcctgcttctctgcaagtcctataattttttattgtatgacagaaaatttaaaagatctatagacactgaaattaatattcttttctgtcagcaatggttcactcttttccttaattcggcagagagaatgagacactgatgaccttaatctaactagtacttgagccgggtcagtgctgaggtacagatttagttaggcttagtccacttctgatttcaaatgtctgctttaggcttctccttttagtggggtattgtctcccacgtactgcaaaactgcagaaaacattactctgcattttcagtccaatccacagtctcccacaccaccccagggctcagagaatgtcctatgggaaagactggccaaagctgtgacatttctctagattccaatacatcacaccaacccacatagccatcaaaacacttccaaatttactttcccatgagagagtctctcagtcgaatgcaggtctgtttcttagcaatgccaaaacataataaatccccagaaagaagaaaatacttggcaattttagctcatctaggaagggccctaccatctctggaatttcgttattttggtcatcactgcttccacggccttctgatggctttaaacatatcatttgtaatttatctgtttttttttttcctatctggtgcagtgagaatgataacctgcaactacctattaaatcctatccagaaagaaaattcctgttgaaatgtttaaaacaagaaagtgtcatgaccagatttgcattttagaaagcgttctgaaaactgcggtagatgccttataatggggctagactgaaggcagcaatattatagtaatgggaacttgctgtgtgcagtcagctctctgcttttgaatcatcacttcgccttctactatttgtttatatctgaataaattattcaccctattcagtctcagtttatttttcatctgtaaaattgggataatgatgcctgcctcttggagttatgtgggttaattatagcacaatagctagcacactaaccattcactagatgatgtctattatgattttgaagataaggaaaacctagaaaggaaataactaatttgagagatattaaggagtttgaatttaaaggattatgtgcccaataagagatgaatacatgtatgccgatcagtcttctagtttggatatctatgttgaggtaaaaagactatcatttagagaggaaatacagacgaagatgggatagagttagaaaatgacattagtttctaagatatgttgagatggaggtgcctatgggacacctactaaagaaagctgacacctttctgagaaactagccatcatagaaaggaaaaagaataagtgataactgaaaagaaactatagttgatagacawgtttaaaaattaggttcaatatttttgttctgattttatatttgatacatgcgtattatagaaaattgactagtaagaagtaaacagaactctaaggaatataggaataggaaaatgaaagagcagccactacttctcatgcctgagatatattgaccaaggaagagtcccacccatcccagggctgagcagtgttttccatgcctcactgaatggcaaacccacggagatgctgtacgtggaagttaccagaaaccaccaccagggttccaggagaaactatccacagggaggtgctgtttctcagaactcactgcagaaccaataagagggtacagggaaggctgttcacagggaagagtcacacagttggcctcttgcttgccaaggatattatggaaaaccgttcatggagtggtatcagataggtggcatactgctgacaggggaaactgctagctctgggttctggagaagccttacctgcattgcaggagtctggtgttggaaaaatcactgcgagagcttggtactggagaagtcatgctataagagcctagtgctggagaaactgcagggcaggattcttgggagaggagcacagagaacctggaacttggaaaagaaatccatttctcctccagtgtctctccattactctttagtgacagagctcaacatcatgacagctagcaaaggagacatattgtaggcttgattctgtcagcacagagcaggcatcaaaaagcttgggcaatacattgataacggacatagtctcatcttatccgcctctccatgcttgttctccactcctggtccttctacgtcatgttgggaccttcaaaattacagttttatacccgataagttatgaggtgataatggatgtcttttggggtgggggtgggaattacaatttataaagagaataagccatggaaacgataaatgtataaagatgaaattttaagcataagactggtttcaaaacaaggttctactacttgctagctttgtaaacttaagcaattcgagtaaacattctgtgccttagtttcctcaactgaaaataggcttcatcttagttatcatcataatgtttctgtgaacattaaatgatataacccatgtgaagccctaagsacagtgcctgatacccagtaagactttgatacattttatttattggtaatgycctgtattattattccactaaagagttctacaatgtgggacttactattccccacattttctatataaagaatttgtggcataaagaatttaaataattgacctaagttcacatagatagtaaaggtagagcctagatgggaatgctgaaaaactgactcaggtgtttatgctattaatatttcaaaattcagcctcccctgttcaaatagtattcaaatcaaattccctggtagcttattcttgctcttatttctaaaaccagtcattttactgtattacctatttttattattttcatttaaaattgttcctctccttttcagaaggatactgatgaatttaaaaattgttattataaaataacacttaaaaaaaaaaaaaacttcaattaccaatatatttctcctgcacactatcattgcagaggctaccttacgtctttgcactgcattttttccactttgctgcaatctccgtaattacctcgtgcataggtttttggcagttgtacaatgagaggcattttgctagtctcactttcaatgtcctaaactctcactttggaacttgggacagttttcaaacactttaaaatccccaggtgatgttttagccatacctgctgggttttttatgtccttttgtattctgtttctttccctttcaacttgaaacatctttcttcacactttccctttagctttcaagttgctcccagttggttcttaaacagcttgaaacccctctttgatatgccttattcaaaatcctggaagctacttagaactgcctctgagtcaggttttgccaataaattccccagaacccattcacattgtatctgtaaaatctttaaaacttgaaacagtgtggagaaaatgctctattaatgatacctcaggtgacttgttttgttgtagctgttgctctgtgaaagacaaaatgtacgaaacaattaaagagatggttttattcagcctactgcaatacggagaaagttcattaaacaggaacatctcaaagaaaagaaaagaggtctgagcttttgtagaggtaggtagatgaggaagtcatctgtgattcttataggactcaagaggaaggaaagagagggtcctggaatatatgagaggagaggagtcctttgtggttagctgtttctagaacatgaaaatgtagagagatttcttaaatgtcttcactttccaggagcactggactgaggtaaagtycagcatcgccagtctcatcccccttgtgtttaagaaaaatgaatatcactcattgctgaacaacctaaaagtgattctaaagctcccgggtggggcaaagcagagtctcagaaatagtctctcaggggttcttgttgatgttgctcctacaaaaccacttgaatttatattgccaggtggtggcaaaggtcagctgttttgaagtcccaacgatcctgggagaaagggacagctgcaaggcaaccaaaagtctgtatagggatctgggatgtcaggttttaattcttggtaatgtccttaggtgggagggagaaaaactgaaaatgttaatttggaaagttgtagttaaatgttgaaaaaaaacacataagattgaaaagtttggagagttgacaatttgtgcaaggtagcagaccagtccaatttgcaagtagatcccgaaagtggtgtttccaaggagaagaggaagtcaaatctctagcagataaaacaaagtttgcatatccgtcagtggcttgcaattgaaaagaggggcaaaaatagttcaaaaacagtgaactcaactagaatctaacaacccagaagggtgtgctggagacaatacatagtgttttattgaaacacacaatgtttcacattagcccttaagctacaggtcaaaaatatacacataagcttttattaaaatctttgttttagagtataattttaaatctagcaccggtaaagaaaaataatctttgatatcatataaaagttcttacttgaacaaataattaaaatgtaggaagaaagcatttgtagatacatgcattgactatatgataaatgagagattgctacacatggctcacctcaggaccttttggatactaaacatccagaatgaacagaaaactcaggggcattttaaaaagtagaaatccttcctattgctctacatttttatttacataacactaaattatctcaaaattcacaaatacaacacacacasaccaaaattttgggtctataaaacagaagtcattaatatgtgaacaacatatttaaaaggttcaacaggtcccargcaaccattatttgagagtcatatgaaaactattaaagtattttgattaatcatcaccactctttctcaccaacccgttgctttgttgcctgtttgttactggatggtggctgaaataaaaggacatttgacaatactcacctagagcttagatttagaaatcagaagcttgacmtcaagatgtgggcagtggatagcagcatgggcatcaccagggagctccttagaaatgcagcatctcaggacccaccccagatctgttgcatgggaatttgtattttaatgagaactccaggtgattcttatgcacatawaagtttgataaataagaatttgtctagaagacgcaaaataggacacagaataggaggaagaatgtgaattagaaaggagttttcagaatgctgtacactcatagacaggtagtcattgcatagtacattacatagctgccaagtcctttgttgccagggtatctttgtgagttttgccactgttgttcagctgatatagttagttgccaattagcaggcaagggaaagaccagaagacaatatataaaccaattcttctatgttaagatccttgaatcattttattatagaaaaaatgttttggatactttcctgaccaccacatctttccttttcatcactgtgaaaacagcttttggctatcattataataaaccttgtcaggcagccaactataaagtgaagtgatgagtgtataaatgtcatattttcccaggtagggaatagtgaatgtaagtggttactgataacactagatgttaatttttaagaacttggttgtggttaaatggatgtatatgtatatatgtgacatggagaatcacccttttatgaatattatagggtccccaggtctctggaatgcagggattccaaagggtgaggagtgagccaacccctttgcatgcctgaaagttccttcattcatgtgctcatatattcaacaaatatacattttgagtcccttttccatgagccagatacaatgctgggtgctagggatatatggtatacaaaggcaaacaaagtctactgctgctgaatttattgtctaggaagagagataggtaataataagtagataaatagttaaagatgataagtttggagaatgatattgataagagctaagaagaaaatacaacaagataatataataaggtgacattaggaagaacatcagtgaaggtctctctgacatttaagctaaatcctaaggtagaaagttctacaaagatgttggggcagaatgtcccaagcacaggaaacaagtataaaaccactgggaacaaaattgacatgttccagggacagaaaagaggtcaccattgctagaatggagtgaggagactggtatcagatgagattagagggggctcaggggtcatgtcatgtgggaccatgttgcctgggcaaaaaatttggtttaagtataaagggaagccttcagaggatttaaagaggaatgtgacctgattcatctagacactggctgtttctcactaatctgagcaaactactgtccaggattctaaataagttatgtggccagggaggcaagaagttggaggcttgaggttcctaagcttgtgatcatatgggaacttgagggtgctttaagataagctttgtatttatttatttactttattttttactttttaaaaatttcagcttttattttagatacagggaacacatgtgcaggtttggtaaatgggtatattgcacccaggtaatgagtgtagtacccaataggtagttttgcaaaccatgcccctcactccatccctgttctagtagtccatagtgactgtttttatcatatttacatccatgtgtgctcagtgtttaacccttaattataagtgagaacatgtggtatttggctttctgttcctgcattaatttgcttaggattttatcctacagcttcatcagtattgctgcaaaagacatgatttcatattttttatggttgcatagtattccatggtgtgtgtgtgtgtgtgtgtgtgtgtgtgtgtgtgtgtgtttgagtgtatcacattttctttatccaatccatcattgatgagtacctaagttgattacatgtctttgctattgtgaatagcatggtgataacacatgaatgcattttccttttggtgtatttccagtagtgagatttctgggtcaagtggtagctctgttttaagttatttaagaaatctccaaacagctttccacagtggctgaactaatttaccttcctaccaatggtgtataagccttcccttttctgcacagccttgcaagaatctgttgttttttgacttaataatagccattttgactggtgtgagaaggtattttattgtggttttgatttgcttttctctgatgattagtgatgatgagtaattttcatatgtttcttggccacttgtatgtcttcttttgggacgtgtccattcatgttctttgcccattttttgatagtgttgttttatgcttgctgatttaagtttttcttttaatagatgctggatgtcaaatctttgtcagatgaatagtttgtgaatattttctcccgttctgtacgttgtctgtttactctgytgatggtttgttttgctgtgatgaagcttttttatttaattaggttccatttatcaacttttgttcttgttaccgttgcttttgggggcttagccaaaaattctttgccaaggctgatgtcaggaagggtatatcctagattttcttccagaatttttccagtttggggtcttatatttaaatctttaattcaaccttagttaatttttgtatatgttgaaagataagggtccagtttcaattgtctgcatatggttagccagttatctcagcaccatttattgaacacagagtcctttttccattggttgtttttgtaggccttattgaagatcagatggttgtaggtacacagctttatttttgagatttttattcttttccattggtgtatgtgtttgtttttgtgtcagtaccatgctgttttggttactgtggccttatagtatagtttgaagtcaggtaatgtgatgcctctagctttgttctttttgcttaggattccttcagctatttgggctctttatttttggtccaatgtgaattttagaatagtttttcctaattctgaaatgaatgacatttattgttttgtgagaaagcatgtggttgatcttagaatatgttctgtgtgaagatgagaagaatatatattctgttggttgttccatggggtgttctatagttgtcaattaggtccaattgatcaagtgtagagtttaagcctagagtttctttgttagttttctgccttgaagatctgtttaatgttgtcagtggggtattgaagtctgtcagtattattgtgtggttgtctaaatttttttcataggccaagaacttgttttatgaatctcgatgctccaatgattggtatgtgtctatttaggatagttaaatcttcttgttggattatatgcatatgcccttcttaatttttatttgtttaaaatctgttttatctgatttaagaatagggacccctgctcttttttgttttctgtttcaatgggacaactttgtctatttctttactgtgaggctgtaggcattgttacatgtgagatgggtctcttgaagacagcagatggttgggtcttttttttgtaaccagcatgccgccttatgtcttttaagtaaggtgtttagcccatttacattcagggttagtacttgtatgtgagattttgatcctgtcattatgttcttagctggttgttatgtagacttgattgtatagttgctttatagtgaactgtgggctatgcacttaagtgtgtttttgtggtagtaggtgttgctcttttggttctatatttaggatgcctttaagagactcttgtaattacggctgatcacattgaaataaattccctcaacatttgcttgtctgagaaagattttatttatctttcacttatgaatcttggtgtggagggatatgaaattattggatggaatttttcttctttaagtatgttgaaaataggtctccaatctcttttggcttgtaaggattcttctgagaagtctactgctagcctgatgtggtctctctgtatgtgacttgaccattctttctaactgccttttttttttcttttgcattgaccttggtgaatctgctaactatgtgccttggggatggccctcttttatagtatctttccagggttctttgtatttcttggatttgtgtgtcaaccactctagcaacattggggaaatatttgtggactatatcctcaaatatattttccaagttgcttattttctctcctctcaggattatcagtgagtcctagatttggtctctttatataatctcatagttttcagaggttttgttccttttataaaaattctatttttgtctgactgagttgatttgaagaacyagtctttgagtgctgaggtttttcctcagcttggtctattcrgctgttaaaacttctaattgtattataaaatccttgtagtaaatttttaagttctagaagttcatttgggttcttaaaatagctatttaatatttcagctcttggatcattttattggattccttgggttccttgcattgggtttcagctttgtcctaaatcttgttgtgcttccttgccatccagatgctgaattctatgtctaagttgtgtattcaagtatacatacattttcttttttttcaacttttatttttatttatttatttttatttttatttactttgagttctaggatacatgtatagaacgtgaaggttttttacataggtatccatgtgccatggtggtttgctgcacctgtcaacctatcatctatgttttaagccccacatgcattaggtatttgtcctaatgctatccctccccttccccccaaccacccaatagaccctggtgtgtgatgttctccaccctgtgtccatgtgttctcattgttcaactccgacttatgagkgagaacatgtggtgtttggttttctgttcctgtgttagtttgctgagaatgatggcctccagcttcatccatgtccctgcaaaggacatgaactcattcttttttatggctgcctagtattccatggtgtaaatgtgccacattttctttatccagtctatcattgatgggcatttgggttggttccaagtctttgctattgtgaacagtgcagcaataaacatacgtgtgcatatgtctttatagtagaatgatttatagtcctttatgtaccccagtaatgggattgctgagtcaaatggtatttctggttcataattttttttttttacccgtggtattccaccatctccagccacaaaccacaggaaatttgacaaatcagcctgtttgttataaaaagaacacatcacttttttttttttttttgccatcatcctgtgatagtgtacttcatggaaagtgtatcaatcagaggggaaccagggaagtaaaatcagcaggacttcatattgagatttattacaagaagttgacttatgggtttgttgggctgagtgagcaagttcaaaatatgtagcactaactcaagaagaaaagatcatggcaggctcggcacaggcagaaactttcattggtagaatttcttcacttatacatatatatatattttattatactttaagttctagggtacatgtgtacaacctgcaggtttgttacatatgaatacatgtgccatgttggtgtgctgcacccattaactcatcatttacattaggtatatctcttaatgctatccctcccctgtcccctcaccccacaacaggccccagtgttaaggccttttatctgattaagtctggctcaccagataatccgggataatctcccttatctaaagttcattgattagggacttgaactacatttgcaaaatcccttcaaagcaacacttatattaatatttgacttcataactgtggactttaccctaggcaacttaatacatcaagaaagtcatcacagcaaggttaaggacattttaaaaataattgtaagcaagttcaataaatgattatttcttacatgtattatgatctactgcatactctgttgagtatcataaaaaatcattatgccattaacttagcagatgttactatgaatagtgagaagaattgattaccattacgcatttaaaagatgttaagttaatgacatcatttttgccacatatagatttacaaatgaagctaatgaaggttaggttttctgggcctcatctataaagaccctttgagtattagaaattgctaggagtttgagagtgttctaggtgaagagcagaagcaaggttacaagcaacaatcatttccaggtaagcatttcaggtatctttttaaaaagagatctcaggagaaaaggacctaactctaaaaattactagtaatttgttgaaatttattttatcttaaatagccacttttataaataaatttatatttgtaattttatattctgtttttctaaagagagctaccaaaattgtaactttcaggcccaagaaacagggatccacccctgcatatgtactttttataatctgtttgttaactaaaaagaaaaaaaattaaaaatgagtcatccaagtgagttcgtctctcttaatatcttacagacttatcagttagctattgggttaatggccttgaaacccagtcaattacaatgaaaatttgtcgtctagttgagagacaaatctcaataaaacagaatttcggaagtaacattctggcttttacaatatatttcagaagggctcaaaggcattctgaattgcttgtgattctaaagtgctaatctgcagtcatatgggacaggatcagctgctgatgtacagttatccacattatctcatactgctggtattaggcaaatggaaaatactatctttcattttatctctgcttaatgccagttgcagatttattcattttcatcttattgctctagttcttcatttctctaagacactattagatgtatgctcagtaatgatagaatgaacttgttttctccttctcctaccccccttctaccacacaattttattccataacatgattttctttatgcttacttttattttgttaaatttgcttatactgctmttagttgatttgtcagttttcagtgttattctttgtctctgatttatcataaacaaggtttctttctcctttatgctcacaatttttgtcaattgtatcatttatacattgtcaggcacatggactttaccttctatttttgtcagccttaactccacattgtttccattttacttctgcacttaaatacattcrgtgatcaccagcaagttatttttttcaaaattttctctgtcatttctcagtttagctttttttttttttttgagacagagtctcgttctgtcgcccaggctggagtgcaatggcacgatctcaactcactgcaagctctgcctcccgggttcacgccattctcctgcctcagcctcccgagtagctgggaccacaggcrcccaccaccaggcccgactaattttttgtattttttttttttttttagtagagacggggtttcaccatgttagccaggatggtctggatctcctgacctcatgatccgcccgcctcggcctcccaaagtgttgggattacaggcgtgagtcaccactcctggcctcagtttagctttttgaaatttcctcaaagaggactcttgggaacaataatccctaaatttcttgcatattgacaccatttatagtttttggatttgaaggacaacttgaatgtatgtaatattcttagcttacatattctttccctgattatcttgtaggcattgctctactcttttctggtgttggtcatttctataaaatatctaatgcaagatacttttctcctttttaggtgacttgattattttgtgtggttgccagaagatttcctctttatctctaaagtctaataacattactgggatatcacttggttttgagtattctaagtcaattattcctagtacacaatgtgtcctttcaacatatgtcaggttgacttttatttgaggacctttattaaatgatgcctttaaatatttgttatactttggttttctttcttaagtactgatatggtttggctgtattcccattcaaatctcaatttgarttgtatctcccagaattcccatgtgctgtgggagggacctagggggaggtaattgaatcatgcgggccagtctttctcgtgctattctcgtgatagtgaataactttcatgagatctgatgggtttatcaagggtttccacatttgtttcttcctcatttctctcttgctgctgccatgtaagaagtgctttttgccttctgccatgattctgagacctccccggccatgtgaaactgttaagtccaattaaagcttttttatccccagtttcgggtgtgtctttatcagcagtgtgaaagcgaattaatacaagtacctactctaattatatgtttgttgatctattttttgtctgtcttcaacatttattatttttctaattcattctgtttataattttcattttattatatattttttctcatttctatattctaggtttcctactatgttccaggaactctgttctcccttgtgattttttccctctttttctgagttttgctacctcatatttcatcacttcctcttgtgtcttcatctcctcccttagttttttcacttctgctctgtgatcttccttcatagaggcaactgctgttttaatttttaaaatttaatttttgtcaaaatgcttggtaacaatgtttgtgcaatggcaatattttttggtggtggctcatgtattgattagttttgctgctctttcttcaatttgattggttttagtttttgcttatataagtttgtgttcatgctgtgttcrttttaaaactttcctcttttaattaattagctttaatgaggtgattttttttttttttttgcttgaaatatgtggtaaatccttgagtaagaggctgggatgtgagatcagggtatccttcaagttttacaacccatggggacagactgctttagcaaaaaatgactcatgtgtgtgatacaggtagccctgactcatctatttcaccgatccaaaccaggtcccagagagcttctgcttccaaccatgttcacctctttttagcatccatgtatataagggataaagcatttgtacttcatggtgagcctgtaactcacagtgactatttttttcccagcacattctaagatgctgctgctggccttcgtatactctctatacttttcactttttcttgggcaacttttgtcctatctcagctgttttgcttctttatattttgtaagctgcagattacatctctctttgagttttgcttaaagtagaatttatttgcaaagttattatctgtaattttcctggttgctttcatataatttccatgagaagaagaggaaagatcttgacttttgtagccaaggtctatataacttcctctctacagtatagtttacactggaagtggaaagtttttgtttcgttttgtgtttaatccaaatatataaagatgccactatactgtaaagtcattcaatgtttactttttaatttcatatgctttggttggtgtttaaagtgttcctaggtccagctccaaatttattccactttactttctttcacatattttatgcttcttttaaattgtactgaattattcagagttattctaatagtagttattatttttccttttttttttttttttttttttttagacagagtctctctctgttgcttgggctggagtgcgatggcttgatctcggctcactgcaaactctgcctcctgggttcaagcaattctcctacctcagcctcccgagtagctggcctcccgagtagctgagattacaggcgcctgccaccatgcctggcttatttttttgtatttttggtagagacggggtttcactaaattggccaggctagtctcraactcctgacctcaggcaattcacctgcctcggcctcccaaattgctgggattataggcgtgagccaccgtgcccggcctttttttccatgctttattcaccttgtttcctccagttgacacttcctatccaacccttgccaattcttccccacctccatgtttcttattctcaattaaagtcctatctggaattcaagacctacctcaaataagtacctaattcttaaagctttttaaaaaatctttatatattgttataatatcttttacatgtttatacacagtttgcattgcttatattctcttggaatgatatcttattgtatatgatgttttggttatttgggtactgcttctagtttccaccaattggaagaaaggttgtgacttagtcatatttgtgcctcatttatgcctcaacacagaacattgtgtataatagacattcaataagcatttgtttaaataataaaattatgcaaaatgccaaaattattttctagaatgtatggcacaatttcctcctacttctcactgatgcgcaatataaccactcatggaaataatttggttcttttttttcctaaaactgcaaacccctatggacgtgattatagatgcgcttgtttattcatgcagacagtcaaactgtgttttgactattttaattgccttatttcaatacagaataattttttcttggctctttatgtcttgatagctgttaagtagattaaaaaacaaaaatggaaaacatgaacttctataatcctctacccttagaatggtggatttctattaagatatatgcattaaaagaacaaactctaccaaaatttaacttttagatgtaaattgcagtaaacagaatagcagaagcttagagaaaatttttccaaatacactctgtgttttagaaacaaagatttttagaaaaagcaaaatttgagaattttctccccactatttcatttaaataggtctcttaacaaatataattcacttgtgattttcctcatcattttgtagctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttraacttcaggaagttttctcttcatgggataatttagtactgcttttatctatcrtctgtcaatttctctgtattcttaataaaataaatattgaactaaagtgggagcaacatcttggtatttattctcaaggatttttatataaaaactttatgattccagaacaaagttctaaccagttgcccttctggttgttcctatagacaaacacttttgatcagttttcattgtaaaacctgcattgaaatatatgaaaagtactgacggagtaaatatctacaaatgtgaataagaaaactgtttccacttttttacactttctagtagtttttaaatgattctcataatggtgattagactttgtcaatagcaccacttcctgttaattcttattggcttttattcattctataaacttattggaaaattactgcatatgatctacttcaatagtttgttatactgtactttaaaattgaatgccatagcacattgaagatgtaatagtcttgaaaaaaaatcaaagggcctggggctatataaaggacccactctatgtggaaagtcaagtgggaaatatttggttctttaacttactgcctctgtttgttgacccatttttatttacaaatataatcatcttccaggcaatattattattctgctttatttattgtgtcctatagaaagaattggtaaattcatttacataactataatgacttactgtatatttatattttaaagagtgctttcaaaaccagctaaagtttaagaagaatttttcaataacacatgtagtaaaggaaaataatttgcaataggtaggggaccacttggtatagcaactgcaaatgtccattgtgtttaaaccacacaataatcatatgaatatattagcttagagctaaaatatgagatgcgaatctattaggagagtgctcaattatcaatggcagagttgagattggaacccaggtctgttttactcccaaaccatggtatttgccattcatcattctgtacacttgcttcttattagtataaagccaatggaatgaattctaacactagactttccagcaccagtggagcaaatattttggtttggtggagaaggcggtgatggaaggactttcagaagacagctgcctattctaactacatttaagtgtattctgagttaggcattatgacttctattcatatcgcctttcctcctcatggaatgaaaattacatgcaggaaagattgtaggagaaaagtatatttgtctctgtgtgtgtgtgcgtgtgtgtttgtctgttgggtggtgtgatgatgtacaagaagtgtccttgttttagaaaaatataataatagaatgtttaagtatgatagaaattatgtttttagcttgctataaaatgattcagaaaatactaattatatgtatatataaaatgtatatatatgcacacacaggtaacacatatacatatctatatttacatctgtttgcttattgggaggatagatacatagatgaaacacacatgcggtagatgctaacaattggggaaagaggaggaggtggagatagcagttctttgaactatatctgcaacttttatgtaaatttgaaagtatttcaaggtaaatttttttaaaatataaaaagttgcttttgaacaaaaagattatttgagatgttcaagcagacactgggtaactgtctcacggggatattgcaaagacttcttgcactgggtaggaggtttgactgggtaatccatcatttcaaactcagagcacatgatttatgaatcataggttggtgatagtacaatggagtgaaatctgagccacatgcccagaaatttaatggaatgttaagatgttataaaagtagaatgcgggtaccaaataatttgcaaaggctcttttccccactgatccgtccatccctcatgtaagtattgaaggcatgtataagagattattttaggttccgggtattcacatataaatagaatgcaccttttctaccctcagcgttctgaagtgaagctatataaaatgtagtggtttattaagccaatactaaatgagcccactggcataagttggaaattcataatctggcatattttttccagtctaatttgggaattcttttgctagatatactttactgtttacccttgaagataactttgtttgatgtgatagcctgagatagtctggttcatacagacagaccttctctctatagcctactacatgtgcatggtattatgctgtaactctaattccatccttaattaacatcagggcttcttctgtaaaaggaattaagaagagctgtctcataaatatattcaatgagaagagaacttttaaaggtatgagactttcaaggtaactgtttctaataatttggagaaaaaacacaaaaagaagaaaaaagacaatgtctttttttctgtgtcttactcttcttttgtaactcacagcatctaattttctaggcaggtagcaggatctcacctgtcaactcttaacagaactgaaggcattataaactgtttctgaaattaacattcagattcaattacttatgatccatttttctgtggtaaaaggaattggtcacattaaaataggatatgtcataattttcaataggctaccttgtttgtattacttatatttacactaaatataatttaacattttcttttgtcagaacattttcctattatcactcaaaatttaggaacaatcttaccaaaaaaaattgcctgaaatgagtccatgcttaaatggaagaattaacttttaagttctttactgatgagggcatttgcttatacatttttaaagtttggaattaagtgcacttttacttgaaaaaactataaaaggataagaaaattgatgagatgataactgtaaccctttgctgtggtttttatatatattcctaggcttatactttacagtcggacagtaatggcgatcaaccttctaccaagacaccttggctctcattaatgaataattctccccccaccccgattttctaggagcaaaatagaattgtagaaaaaagcggtttgggaaaatattttaaaaatttgtggtaatattttatggacaattgtattgtcgtcattgtctattaaaagaggttaaaccagggagaataaatttatggctattgctttttactcctcaagagacaggaaaatgaacattctgcctgaactgctctaatataaggtccttacagaacaatttcattaaatggtcttagtaggacagagtgacggtctctgccattggtaggaaaagtaatggactatttctggataaatcacattgtgatctgagcagtgtacagacataatgatgtggtagccaagggtactggtgatatatgtttgctggtgtcagtaaatgggtagaaaagcattgattgaatgatagtcttgacattcagacttaatatttatgtattgcagtgtgaagcaagtagaatgatagtattcttgtattgcacaactctttttggaaaattatctctgtgttaagttaaagctacactagagtgtgcttatgatagagtaggtaatattagaataaaactcaagatctagaaaacatttggagatgcctatatgggaaatcaaaaaattttagttaattagtagattatggcctataatgatctattctcaggcctatttttaagttatagccatgttaggacatggaaagatgttaacagggtcctctgacaagtttttaaaaatgaattccatttaaagctatctatattcactttatttcttttacatgagtttatcagaaatagtattaaatttggggatcaacagatatttaattaaaagtgaactaaattttttttctcttctcaaaggctatagataaataatacaatgtgcttaatatctgattgccattgaggtgattgatttgaactacaaaaatgagatgaaacccattaaattatgcaattttttattaatgacctttttgcaaagaaaatcatgtagagtttcaaaagcacataaaggtaacagcaatttttatcatccaattacctatggctaatagtattgtcctgatatattttggcaaatccattatcttttttgctggcctttctgctcagaataaagaacatatttcttcaatatccactctttttcttaaggattcaaatggaccttatatccacaggaaactcctctgactattgtataatttgatgaatgttgagaactctgtcaatgcagcagtgatttgtctctgtattctggacttgatttagctttattctttttctcataggcattctgaaatatttatgacaaagtgcattggtaatctgatgtaggagtcctgtgagaaacaaaaagaactaattactagcaaatttacaacgagtagcgcatcctttcaaattctgtgcaacttttaaaagaagcaaaataatggataaaataataatataaatttaatacttttaaaaaattctataattgtttttttctcaattcttgcacatttcatcagttgatcattaacccgattgtgttagttcttaatacaaatgtagtgaacacctgcttttgttctagaggaattaatcaagcaatggtcaagataaatggagttggccttgatcgctcaggtgtttatgtacaagagttttccagcaagcgtattttagttgtaacattccagtgaataatcagaagtcagtttggggtaagtaccttagaaataaatagcttttgaataagtatgtatgcaataacattgcctatgaatgtttagtagagtatggaatggcatttcaatttactttggtgtaaaaatcatttgaatttatttaattaacatatcgcttttattctccttaaatgatttcaccacaaatcagaagatccagttcttataggactattcatcaggttgtttagttcagcattactttgtgctttctgataagatatgatccaaaacctgatgaggtaagtgagtttttaaaaccaatatttgtctgaggttataatttattaagtgcttagaaattttctagaaaaaatggatgtggatgctcaaataatataaatttaattattaagattattaataataatgagaaggaaactctaatactgagattctaccacaaagaaaaaaattacatttttaataatactgttcattattccaatataaaccaaatacataaagctatatctaatgtatttccagttgataacttaaaggtactaataacattttgactacgtatctacaaacacatattttggtcagaagtcttctgagaaattgaatatattagaagataatgatacacagacatttattttgcatgtaaaacttctcttactcactggtttttaactattgttgcactctcatttataagctcatatgctaaattaatccctaatgaaacatttgcttgatattaatagcatataggtctatatctaaagtttaccaacacattttctaacaattgctttggattgttttttgaggcttttgtcttttgcaaatatatatctaaacaaatacagtttaacaaaatacattgaaggataaataatgactccatagtttaatttggaacaatatttgactattagtaatctttatatataaatatagttgttcttagggactcctaccatttatggtacccttaatgatctgcaaaacactctagaaatgtaagtctctacttaaggctgacaacagactattctaaaggctttcatctttacccctaattaagggttacttcctagtaacttactgatggataagtttttaaggattactaacatgtattatttataaggtaaaattattgttactaaaatttatgaggccttggagtcaacattctaccaaatatgtggtaatattgcaaaactaattctgcttgagatataatcaaatggttgaatttcctgcaattttagtggagagcactttaatagggtattattagtcttgtgaattgtttatggtttttaattgctgctactctt

SEQ ID NO: 17908 - DNA, 29618 bp, Homo sapiens
aattgagtttggatctcttttacaaaatgtatgatttttaaaataaatcatttctactctttattcagtgtgtgcatttcctgacctttgttttcatttaagacaggacaacagttctgagagcagttctggatgtaagtctgttaagtaagatattaatctccttaattacggaaattacatagaaacctttatttttattttaaagtaatacacacatcatttattaattgttgtttccagatatattaattacaagcatggttttagacagcattggaaaagtatttatatggtaaataaaataacttctagttgtcaaggaaagtgaaaaacaggataagttcaagcaagacaagactcatgtctgtgtttcagaaccttcagatcagcctagaaccttctgagacaaggattctgaaaacttttagtctttatttgccattttatcttcaatgctgtttttaaaagctggttctcttgcaatccctggtcccccaacactgccctgataggccaattgtctaggcagcagttgtggcaacagctggaactgcctgcactttctgggcactagtgctggcataaggaccttgccaatcatgctgagcaggagtgcctagcttcccttcacgcgaccctcccaaaggtggctcagatctggaaggtccaaagcccatctcgtggcacattaggtatgaaccccaagtgtttatacctacttttgaagtaggttgttgtctacttttgaagcaggttgttgtctacttttgaagccttgcatttttacatggtccacacccatatccatagcaaaataatagttaatatcagatagctaacacttaccgagtgcttgctgcctgccaggcacaatccccacctgtgatttaatttccataactttgtggaggtgataatattgtaactcccatttaacagacaaggaaagtgaggcacagagagactcaattacacacatagaggcacatgctcaggcaacacgtggccagtgcagataacaggaaaattcactgctcttccctctcataatacattttaatattatggaaatgtggtccttgaaaaagtggtcattgagcacttaccaggtgctacggatacaattcctctgcagcttgcattctagtggggagagacaggaaacaaatgctaaaatgtgcagggtgccaggagtggcccattccctgaaagaaaaggaaaggggagagtggttgtgtcaggagattctctctgatagggcagcatctgagcagagaccagaggatatgaggggagtgagcaacagggctatttgtgggggaagacagtaagtgcaaaggccctgaggcaggagcgtgcctttgaaaagaaatggcaaggaatggctggaggacagcaagtgcagggaggctgggaggagacggaggaaagggcaatgagatcctagagggccctggccacactgaaagaagctcctgtgaaacggagtctctcagaataggtcccttttaaagtcacctgaaaccaggtgtcagtgcctgcctgcctgccttccctccttctttcctttctttctttctttctttccttcttctttctttctctctctctctccttccttccttccatccttccttcctttctctctttcttctctttctcactttcttctctttctttctttcttctttgtttctttgtttgtttctttctttctctctctctcgcttgcttgcttgctttccttccttccttccttccttccttccttccttccttccttccttctttccttctttctttctttctttctttctttctttctttctttctttctttctttctttctttctttctttctttctttctttctttctttctttctttctttctttctttctttctttctttctttctttctttcttttctttctttcgaagtcttgccctgttgcccagactggagggcagtggcacgatcttggtttactgcaacctctgcctcctgggttcaggtgattctcctgcctcagtctcttgagtagctgggactacaagtgcccggcaccacacccggctaatttttgcatttttagtacagacagggtttcaccacattggccaggctggtcttgaactcctgacctcgtgatccacctgcctcagcctcccaaagtgttgggattacaagtgtgagccaccacgcccggccctagtgcctttcttacttccaaacacatgtttctgaactgcataaggagcctggaaggctgatggcagccaaggctaagtgccattgtgagcactgtgagactctagcagagttctggggtcctggtcgccccaggtgactctcgaatgggagcagctgccctccagttgcaatgctggtctctgagatgagtgactgtaatgaagagattgatgataaccccatgtcctcagaccttcattgtttctgcggaagggaactgggaaagtcttccaccaaggaatcttttgtgaggcagtgagcttgccttcctgttttctgtaattcctcccattctcccatgtgcttgcggcgagaggaggacgtgaggattgtgttaaagggtgatgagagagcaggagtggttgcagttctggaaaaagatctaataaaacacttacctgcctgaaggcagtgtgctgaaatgaagaggcacattcaacagcattgtcatacattggacctgtgaggggtgtcattgaattgaccacttaggatgtttaaatgtttatttaaagttgcccttggctataaagcctgaagtgggtgttggagtagtcaacgactaacccaggatggatttgtgccaatacacaagtgacaacatctttcacagctgaagagtcggaggataaagccatgcccacagatcgttgtcacacaggtataaccttacattttccaaaatagtcttttaagtgccagcattgttgagtggcatgcactttttgaattatgtaatctgggcatattgtatacctttattttaaaaattttgtttaaaaatgccaatcacgtttattttactttatacatataagtaacattttttctatcatatataatttaataaaatccaatctcactgtgaacactgtactgctgaaaattcatttttactataaaatagaattctgtaaattgctttaagaaagcatttattggctgggtgtggtggctcacacttgtaatcccagcactttgggaggccaaggtgggtggatcatgaggtcaggagatggagaccatcctggctaacacggtgaaaccccgtctctactaaaaatacaaaaaattagctgggcgtggtggcaggcacttgtagtcccagctactcaggaggctgaggcaggagaatggcatgaaccagggaggcagaacttgcagtgagccaagatcgcgccactgcactccagcctgggtgacagagcgatattccatctcaaaaaaaaaaaaaaaattatttatatagtacttatatattatctatgtactttttcccagacacacacagtgaacaagtgatcactgggctcctttcccaggcacagtttttgtaagtaattgtgaatgcaggatacctaatatctttgatcatttaagtttttacataaaactaactctagtaggagaaaaacaaaggtgcgtaagtcacgttcacatatcttatgtagtcactttgattgtttccttggataatgatgctctgacagagtgctattgagttctcttagttccttccttccttccttccttccttccttccttccttccttccttccttcctttctctttctctctctctctctctctctctctctcacccaggctggagtgcagtggcatgatcttggctcactgcaacctccgcctcctgggttcaagagatcctcctgccttagcctcctaagtaactgggattacaggtgtgcaccaccacgcctggctaatttttgtatttttagtagagacggggttttgccatgttggctgggctggtctcaaactcctggcctcaagtgacccgcccgcctcagcctccaaaagttctggaattataggcgtgagccaccgctcctggcctcttagtgcttttgaatgaaataaaaacccgtaattattttaagaagtcttcttctatgtaaaaattagaactaggctgggtgtggtgactcacgcctgtaatcccagcactttgggaggccgaggtgggtggatcatctgaggtcaggagtttgagaccagactggtcaacatggcgaaaccccatctctactaaaaatacaaaaattaggcgggcatggtggtggcgtgtgcctgtagtcccagctactcgggaggctgagtcaggagaattgtttgtacctggaaggtggaggttgcagtgagccaagatcgccattgcactccagcctgggcaacaagagtgaaacttcgtctcaaaaaaaaaaaaaaaagaaagaaagaaagaaagaaaaaattagaactaaacaggtgttcttgtctgtccaacatagactggtagactcagagggagtattccaatgttcggaaactgaaaactttatttgaggtcaacagaaaagaagttgagatcaagtatcatgttttgtcctggagccaaatatgtagactttgctgttgagcctggcttgacactggacctttgattgatgttaactgtgactcaccctctcttgcctcctttcagtttccaaattctctctgcttgggtcaaaagtcattgcttgccagaagtttaatagtgtgtgcattgtgtgtatgtgtgtgcatgccaatatgtatgcaacccatacaatgcctggaacaccaatttagcttcatattttaacagaccatgattccaacatcatgtcaaagtcttatatgttaaaagttctgcatccacattagaaggtactatggatcactgtgtatcccatgccaaatggtacatgagctctctttctcctctgggtcctgatattttaaacaaagaaacagtgtgccattatgggcccttgattctgtgcaaagtcattgatcgttacccatccttgaggtttttttcttgaggcagagtcttgctctgttgcccaggctggagtgcaatggcgcgatctcagctcactgcaacctctgcctcccgtgttcaagcgattctcctccctcagcctcccaagtagctgggattacaggcacctgccaccatgcctggctaatttttgtatttttagtagtgacagggtttcaccatgttggccaggctggtctcgaactcctgactttgtgatctacctgccttggcttcccaaagtgctgggattacaggcgtgagccaccatacctggccccatccttgacttttaacatgtacagagcaaccaataacgagtccttcctcaaagtaaagtgaaatgaataataaatgtctaagactttgtggttaaacctaactccacactgaggtgggtcctgtccctgttgatctaaattttcctccactaggggtctaatttggagcttccctacagaggattgtgtgctgcatcctcagatccatggcgcaaggttttttccacgtgtgaaaagaagataacagatgggaaagagctatccagaattggtgtgggcgctggtaccaggcctggccatggagaggactcccccatatttaacctagggcatctattttctgcagccttgctgcttaaaatggggtctgggaaccaaggtaccatgaggatcagcatcaactgagagcagcttgttaagacgcgaagtctcagccccactccagacctgcagcactgtaatctgcagtaggcaggattccaaggcaactcttgttcacatcagaatttgagaagcaactgttctagaatacactagggagccatatgagatctcaggatcaagtgtagagtgacttgaggtttctccttggttgagagctcctcaaataagataggcctcccaggttaactaatttcagagcaatttttyagatttagaaaattggagtcaggcgcagtggctcacgcctgtaatcccagcactttgggaggccgaggcgggcagatcacctgaggtcaggagttcaagaccagcctggccaaaatggtgaagcgttttctctacyaaaaatacaaaaattagtcaggagtggtggtgtgcgcctgtagtcccagctgaggcataagaattgtttgaaccagggaggaggaggctgcagtgagctgagatcttgccactgtattccagcctgggtgacagagtgagactctgtctcaaaaaaaaaaaaaaaaaaaaaaraaaagaaaaagaaaaagaaaaaacaaaaattgggttcattttgggttttgttgcacaaatatacatatttaagcacctgttaggtgcaaggcattatggcctgaggggaggtggtttggatattcataatggaacgagattcctagaatatagaacaaagctgcaatgtttaaaccatttttctaaacttttgtgtaattcagcattgaatctcctttctcatctttacctattgtaagtccagttaaaatgagggtagacgtggatggtgaactgaaagtagcaaagtagacagatgcaatggtgrctacaaatcccactttctgatttgaaatgtgggattgacagcagttgaaaaataaggattaggtctataataaactgtctttattaatgarctatagtttragtaattaacacaaattcagaataagtagtaccatttaatgrgtttatgtttttaacaagtacadtaattagaaaggcctcatgcacacttcctgggaagctagaatagctgatcatattctgctaatgcggagggaggttcccccaagaacaacagggacaatggcatgggaaaggctggacgtccttcctggctgatgttttacacctttcttcttgggttgattgtttttttcctatgtagaagatttccttggacttggccttcagaaaacctaaatttaaagttcagctttatcaggggagcctgggmgaatggttacattaacctctttgtggcctttgaaacatacatagaaaatatcaagggatagwtgtaaaaatgaggataaaaacatctaaagtgctaagtagaaagtaactgagtagaatggaagcctgtagagcaaaaaattagattgtggtttgagtgagtggtttatgcctgtaatccgagaaatttgggaggccaagatgggaggattgcttgagtccagaagttcaagaccagcctgggcaattagcaagaccctgtctctataaaaaattaaaaattagctggatgtggtggtgtgcacctgtagtcccaacratttggtaagctgaagagagaggatagcttgagcccaggaagctgaggctgcagtgagccacatcactccagccaaggtgacagatggagatgctgcctcaaaaaaataaagttagattgtatttgcatgaagggcatgtagttagcctacaggtatgatgctagtgcttatttaattttctgaaatcttttagaagaaggctgcttgtgccacrtggggtacctgtgttcttttggctgtggagtttgcrcaggaagaggtttggagatccaggagcctgaagtcagatgacaggtgccttgacctctgtggcatgtctctttggactctgtgaaagttatttaattgctgtggttttcyagaagaatatgaagataattgtaaggtgccacatgcactgcttggactcttacagttctgacagttattcctgacaaatttcaaaaccaaagtctgtttctacttgtaggatatttctaagatatcccctgagaaattaatgacaatggagaagcctcttgtttgccagaatttattgtagaatggaaataaatacagagtgatgagtgaaccagaaactgtaattaccctagaaatacatattctttttcttttcttttcttttcttttctttttttttttttgagacagagtgttgctctgtggcctaggctggagtgcagtggcacgatcttggcttactgcaacctctgcctcctgggttcaagtgattctcctgcctcagcatcccaagtagctgggattacaggtgtgtaccaccatgcctggcttatttttgtatgtttagtagagatggggtttcactgtgttggccaggctggtctcgacctcctgacctcaagtgatctgcgagctttagcctcccaaaatgttgggattacagacgtaagccaccacgcctggcccagaaacacatattctawaaaccaacttgaattagcagcagagatgtatatcccttagatatggtattttctttctttctttctctttctttctttctcttttctttctttctttctttctttctttctttctttctttctttctttctttctttctttctctttctctttctttctttctctctctctttctttctcttttctctctctctcctttttttttttttgacagcattttgctgtaatgcccaggctggagtgcaatggcatgatcttcactcactgcaacctctgcctcctgggttcaagcaattctcctgtctcagcctcccgagtagttgggactacaagtgcgtgccaccacgcccggctaatttttgtatttttagtagagacggggtttcaccatattggccaggctgttctcgaactcctgacctcaagtgatccacctgcctcagcctcccaaagtgctgggattacaagagtgagccaccgtgccgggccagatatggtattttcaatgtttcaaaatagtgcattgtgttctcacattttataatcctatttctgaaaaaacaatagtttgttaaccttgtagcttattccaaagaagcagctttggaggatttgcagaagtggagtcatgggagggcattttctgagctctatgggccctggtgattgtcagacactcagaggatcctttaaaagtttctaggactaggaatggaaagagagaggagccaggttaaggcaatcaggtggcgatggcaatgcccagtgcagttaagtgctttgttcctgtatttcctccagacttgctgtcaaacctggacaggagccgaggaggtgggaggcaagggccagtgcatgtagtggggttcaaattccagttctacccyttcctagaggaggacttgggcaaatggagtagctcctctgaggttctctgtccataatatagtgataagagggctttctggggggaaggtggtattcagtgaggggagacaactaaactattagcttatttctgtaaatgttctccagttccaggttggagaatgattcaagttagcaaaaatgatgaggaggttggaaagctccaatgaaaccatggtcagtgggtgataagtgtgtgttgcagtttgataacatgaaagactgaaamtgagagagagttgaaaaataagtctttagaaaaatagagtttagggactggaagcctcaatgaggtagaaaaccagggtggagtaaggaggaactgaaagcaaaagaaaagcacgtgtgtgacttgagagtgagatttccaaagtcagtttcagttaccacccaagcaatcactaacccttctaaaktgtcattatttcgtatattgatatggtattttattaattaatacactttttttttcaagatagagtttttctctgtcacctagrttgaagtgcaatactgtgatcatggcttactacagcctcagcttcccaaacgatccttctaatctcagcctsctgagtagctgggaccacaggaatgtgccatcttgcttgtctaactaaaaaaaaattttttattttagacatggagtctcactattttgcccaggctggtgtcaaactcctgggcccaaggaatttacttgttttggcctcctaaatccycttggattataggtatgagccactgtgcccagtctaagtagaattttaaaaatctccttttctaaagaaaattgmatttgttgatagtaaagttttaaaattgggamgttatattgaaatgtrtctggtgcaaccagtggagtttaaattatttttgaccaaaatggattctgaagaaatggtatggatagaaaacaaagaatgtaagttttatcttgaataaaaactagttttcagggtggggtgagtggaactgagggtagaaaagggtgagaaagcaaatataataattgtctcatctctataacatttaaagatttgattaagtgaaacaaagccccagctgctggagcagaggttccactygggttccacagacacccacagcccaaatccctggaggtcagtggggctcacagtgagtgtggggatgcttctaatagtgggtgtgctcagctgggagtgggtttggtttggtttggtttggttcaaaggcagcagaagtctgcatcttagctgtcttaatgtgaatgtgggrtcttgtgacagggtctcttctgtatcctgggggtggatctgcactctgcctgatggcytagctactttgccagaccctgcctgcttggtcttcaccaggttgctcctgctgtgtatgattacagccttgrcatgggactgcatttcccttgtttaatgttggtgctgggaagccctcttgcaaccactcctttaatatcctcctttctcctgggagaagctggagagagctacaggtcmtgaggtcctcctctgggagaagggagatggagagaaacaccagatacacctccatctcctgcagctgttttgagtttgatttcttattctatttgaaggaaattttttagaataacagatacatgtataataaacacattttcgaacgtaaagagggaaagtagsaatgggatggaagtgagaccactgaaattcactggctccatgtgggagctcagggccatagtgtcatcatctacaaatggcactgaagtttctcctgccattgatacaagtttgcagcagatgttatttctgcatcatttgcattttcagttatgatacttcacctctttctcagtatcacacacaattcagtgttgactatgatattctgaaaagcacacaggccgggcatggtggctcatgtctgtaatcccaatgcttttggaaggagaagcaggtggaycctcggtgccaggagtttgacaccagcctgggcaacaaagggagacctcagttcttttttttttgaggtggagtcttgctctgtcacccaggctggagtgcaatggtgcaatctcatctcactgcaacctccgcctcccgggttcaagccattctcctgcctcagcctcctaagtagctgggattacaggcacgcaccaccaccccctgctaatttttttaatttttttgtatttttagtagagacggggtttcaccatgttggttaggctggtctggaactcctgacctcgtgatgcgcctgcctcggcctcccaaagtgctgggattataggcrtgagccactgcgcctggccgagaccccatttctataaaaatttttaaaaattagccaggcatggtggtgcgttcctgtggtctcagctacttgggaggctgagrtgggaggatagcttgagcctgggaggttaaggctgctgtgagccatgatggctgcagtgagtcatgatggtgccagtgcactccagcctgaatgacagagtgagactctgtctcaaaaaaaaaaaaaaaaaaagcaagcaagcaagcacacagatgagtttagtagatggacattaaaggagttttaaccaactcttttatttcttctctctcttaaaaaactatatgttgctgacaagaaattatatttcttctgtcatgtagaatttttattttgctccataaatgtaatgacattgggatatcatggatctgttttctgtacacctacttatcacttaaataacttttgaatcatttttcaacttgtttctattatatccatcaagttatatgtggacagatgatttggtaacaaccaatgctggcacagaatgagtgctgtgcacaggtcatccattgaagtctgtctcctgtcatgtctttgtctctcaaaaggaaactgttttggaactcagtcatgtttagaattctcagtctcagtttaagcataagcctctcctatggatgtggctgaattttactctagatactatcccattcaattagccagtttaaaacaggccagtttattcaaagctaaaattacagctgcataaagaggtagtttggactctctatgtcaggaattgggttgttttttgtggtattcattgctatgttcaaataaatgaacctgaaaggtgtgactttttcatcactgcagatgcctcagtaatagggatatttaactggtagcacccagaataacagatgttcttctacactgagtttcttggctgtttaaaaagctactttataatacctctggtttacttgtttagaatctattttaataatattttgcattgtaagatgcttctggtctctgctctttttttcaggcctaaggcaatagctaattgagactatgcatcactattaaggcatcttcactaaagggcgctgtggaaacgctgcctgagatgcagacacctgtcagaagggggctaaatttcaaacaaggaacgtggtgttgcatcacaataaagtaagtgtccagagggaacttctgcagtactgtgttttccaacgtgctgagtgatattgtaggagactattattttgctggaatttctatgaatacatctatgaatacatttaaaataaaaagtgttttttgtttttttttttgagatggagtttcactcttattgcccaggctggagtgcaatggcgctcccttggctcacacaacctctgcctcctcggttcatgctattctcctacctcagcctcccgagtagctgggattacaggcatgagccaccacgcccagaaaattttttgtacttttagtagagacggggtttctccatgttggtcaggctggtctcgaactcctgacttcaggtgatctgcccaccttggcctcccaaagtgctgggattacaggtgtgagctactgtgcccagccaaaatgtgtttttttaatatttaattttgtggccaggagtctcacgcctgttatcccagcactttgggaggccgaggcgagtggatcacgaggtcaagagatcgagaccatcctggccaacatggtgaaaacctgtctctactaataatagaaaaattagctgggcatggtggcatgtgcctgtagtctcagctacttgggaggctgaggcaggagaatcacttgaacctgagaggcggaggtggcagtgagctgagattgcgccactgcactccagcctgaagacagagcaagactacgcctccaaaaaaataaaaaaaagaaagaaaaaattgttttggtacatagtaggtgtatatatttatgggatatgtgagatattatgatacagaaatgcaatgtgaaataagcacttcatggagaatggggtatccatcccctcaagcgtttatccattgagttacaaacaatcaaattacactctttaagttattttaacatataccattaagttattactgactatagttaccctgttgtgctatcaaatagttggtcttattcattctttctaattattttcttggtagtcaaaataaaatgtttatttttatgacttctttttttttttttttttttttttgagatggagtctcgctctgttgcccaggctggaatgcagtggcgtgatctcggctcactgcaacctctgcctcccgggttcacaccattctcctgcctcagcctcccgagtagctggggctacaggcgccaccgctaccacgcccggctaattttttgtatttttagtagatacggggtttcaccgtgttagccaggatggtctcgatctcctgacttcatgattcacatgcctcggcctcccaaagtgctgggattacaggtgagagtcactgcacccggcctccatataccagtgatagcagtgttttatttacagtaattataggttttttttttttttgagacagagtttcactcttgttgcccaggctggagtgcaatggtgtgatctcagctcactgcaacctccgcctcctgggtttaagcgattctcctgcctcagcctcccaagtagctgggattacagaggtgcctgccaccatgcctggctaattttttgtatttttagtagggacggggtttcgcgatgttggccagcctggtctcgaactcctgacctcaagtattctgcccgcctctgcctcccaaagtgctgggattacaggcgtgaaccaccacgcgcggcctcaaactcatatttgaaatttagagagattgccaagaccctagagttttgcatgttctcacaaattgatttcgttagttcaaatttcataccactttttctaactgatgattcttacaccttgacaggtgactgagttcaatatgattagagctgaaccatttcaaaaagcagcacaagtggcgactgccagtaaccgataataaccgagtttaatccccctcttctgctccttccctctgatggaattctcattttccctggcctcccccattgacattcatccaatgcccatgctgctggatcagtcttcctggagccatatctaacttagaaagatgaaggacttccaaccttttgggagatgacaatgtgttatcaaaatcaacaaactaatagattgacttcctttgcatatttttgcaatgttctgtgagatatcaagtcacttccctggtagtttcttattcagtatttcactgtactgctttaaaaaaaaaaaaaagtcaggcctcaaccctaacagagtcacttggagatcttgttaaaaagttgagtttagagtctgatacaggttttgagatggccctgagaacttaggttttttcataggctctctgggcaacttttatggggcagaggtttagaaagctaggagtaagctgccaggtatcaggaaaccactagatggcagggccatcccttggagccygttcttcaatcaagaaagtggtcagagaggaaagtggagtggggaagagtccaagtacacatgttaaatgcacgttaataagtggatggtgaagatgagcttaggtgttgggtcctagcgggagagtgggaaggattcctgtcacttctcacctctttctagctttatctccagtatttgaaatgcctggaggatccttaactgaaactctccactagtcaactgtgctgtactatagcacaaccactttaaaaaggtgaaagtaggaaaactagctcaatgagagggctaatatttttatggggccaatgatttgaattggtagacatatatgccytcctacatgatataggagatagagtgcaaaaatcaaaccaaagtgttttttcctaccctcactcaccacacactactcctcacatgccvagcaagcaagcaagcaatttttctgcagattctgcagtgcacaccagctgggtgtcctctaattcaactcaactcttacactagctatctagagatactgtcagatcccacaggttaagggctcagtcccacaagactgtcccccacttcagaggccwgttataagactgaattgccagaacttctgatccactggctacaaattggggctcccaagaccctgcccaggggttcaattaatttgttacagtggctcacagagctcagggcaatactttacttacatttactggtttattagttagagatataataaaggatgcagatgaacagccagatggaaagatactcagggagctatctggaatggtcccagcactggagctcctgtccctgtggagttagggtgcacacactcccagcatgtggatgtatttgcaaacctggaacctctctgaaccctgtccttttggttttatagaagctttaatttgtaggcatgattgattacatcactggccgttagtgatcractccattttcagccctcctccctatctgctggttatggggtggagctgaaaatcctaactttccaatccagccttggtttttactgtgacccactcctaacctgaagctatccaggggccctcagctaccagtcacctcattaacatataaaggattatatgctaattatatagtatatattattatgttatataataatataatatatatatctataattacatgctatattatatatgctatctagtaatatagttagcatacactcctttatatgctaatatataattatgctatataattagcgtatacactctaaacactccttagattccaaggattttaggagctttatgccaggaaaagataaggaagaccaaatgtatatttcacaaaaatcacaccttctaagtgtatgacactttctaagaaattagcagacattacaaatcagatataaaacagatattaccatcccatgaggcttttttttgaaatgtgcatttccccctaaaaccaggaagtggcataatggagatgagagctcagatctcttgcttttctccttagtggtcactgaggtcactaagtgtcttggtgtgccactaacatttagataaagacaggtgtgtaagaccaaaactgtatctttctctttttaagccacttgaattatttttgatgtctgaatttttcaaaattccaacctaatttgtgctgtcttcaaaacagtcttattattggaactatcactgtgaatgaacattacactctaacagtggtatgttatatgaaatggtaccatttagtccttaaaattgattggaaaacagtgattggggarcatttaaatatattttaaaagtgagagaagtaacaattaatgctatactttttttaataaggagagtatattttcattgtaagtatctattaatgattgaaatgttcagaggaactactgaattcatcatctgtgtttagatgaagcaaagacgaaacccccttaacagttactcagttttttgattacccttgctggcgacttgaggaaagagtggataaaaactgccactgccagctgggtgcggtggctcactcctgtaatcccagcattttgggaggccaaggcgggcggatcatgaggtcaggagttcgaggccagcctggccaatatggcaaaaccctgtctccactaaaaatacaaaaattagctgggcatggtggcaggcgcctgtaatcctagctatttgggaggttgagttaggagaatcgcttgaacccgggaggcggaggttgtagtgagctgagattgtgccattgcaaacaaaacaaaacaaaacaaaacctgccactgccaatctggagttggagttatcaaaactgatgatatctggaagagggcagaagatgttaccatctgcaagtttaggatgctgaagaagtggcaagaaaaggatcagagccttgccacagcccagaatttatgtaagtgcttgaaagacatcatctctcttgaagtccaagatgtgttggaaggtgagcagaaaattatatcttagttatttgtctggaatcaagctgtgtctttgggaatagytatagaacatgtggcttggttatttataagcttgggttcagagagttatgcaaatgcaaaagcargcaaggggctgctgtcctcttagtaaggatggtgtgtgcagctgagtcagaggaagggttggaagcccagccccagtgctgccctagctttgggactgtaagtaaaatctcaacctaacttgaagcctctctgttcccatctgtgaaatgggttcagaccctcctatgtcctgggctgtggtgagaatgaaaggagaccatgcatgtcaagatccaggcaggtggtctggctcagtaagggagcagtcatgtcaccctggtacttaaggcagggctggtagcattgagccttctgggccttctgtggcactgaagcaggggtcatgggggccactgggtggcgccagcaatattcaaccagcaaagagggcaagggagaaagcagagcccagggagggctggaggggatcgttcctggtgttgatccagaaaaccacagggttccttgtcttggttttcaagcacttctaattttgtatgtgtgtggatggatgtagcacattgtcataactgagctcaaatcaattcaagactttgattattatatgttgttactacaacgaatatagtgttttttttttctaagaatcctcagtaattcagagagaggttttatttaaaattctatttagatttttttattcctggccgggcgcggtggctcatgcctgtaatcccagcactttggaaggccgaggcaggcagaccacgaggtcaggagatcaagaccatcctggccaacatggtgaaaccccgtctctactaaaagtacaaaaattarctgggcatggtggcatgtgcctgtaaccccagctactcaggaggctgaggcaggagaatcgcttgaaccagggagtcagaagttgcagtgagccgatatcacgccaccacactccagcctgatgacagagcgaggctccgtctcaaaaaaaataagtacataaacaccccagaaggttatatcagaagtcaaagtactatgatctctctgcatgcttttcagacatggtgagcgagcgttctgaacccycgggcccactttgcctggaggaccactgaggttttctactctctagtcttggggtgctgaagcctcaagagattagaaacaaatgcaattctctcccacctagcaatttgggatgcaagctcaaaggtgagctcctcatcccctggagaagtacaactggccamacactacttttcttggactttcacrgtggaattatttacttttcatggggaagaatgctactcagagatagctttcacagaaccaagggaaagmtgtcttcttttcttgaaaaagacttgcctcaggaaataatgggcctcattggctsctgctaattggtgaaatgtktttkttttttttttttggtctgtgtagatattgtcactacttcagcatcatgagtgtggtgggtgattaatattctggatatattttacattatttgatccataaattcataaatcatggatgatgagaagaaaaggaagtctgctttttgacactgctcttctttgtattatttacttacaggtcctgttttaaagcatcctattccttggytgtctttcctttggctctttggcaatagttggttttgatcccagctctttggctcctgggccaaggctgagtgagtgccagacagggtaaactagttcaccaggtgttcacacaggttcaggacaacctgcattgtccccacagcccttttgccacaggaataattatggttttctcccttccaaggatgggaaggtgtgtttttatttaaaaccaggcagattcctaatacttcctcatttgtgcatttctcttgacaagggatttttctgcacataatgactctcatttggtccttttgctgtattcctttcggggaaaagtttcctcccgctgctttttcatgagaaagcacgcttcactccattctctaaagagaacacagcagttgctgaatttttaatttgttcccatgagaatcgtggtttccagcagtcagcctaggccactacccgttttctggaagtccttcttagggtgaaccagcacactgcttgctgaagagcttgatcccagggattcactgctggaatcatgtgtttttggttgacaggtgttctcagcctccctgtctatatgtcaggatttgagaagtcctgatcctggctctgcagccgctgatgctaacacggaggccctggggttaaattctaggctctgagttttgagatttctcctgcttcttaagtgagacctccatttccaccctggagcccactgtagatttagacctaatttgttctggtcctgatgtaagtcctcagttaggaagtctagagttagtcagccacctttattctttgcaatcccattcttgctgttttctgtaacctctagcacaagtttccttttcagaagggaagacgctctatgcatttatagcagtgttttcttttcgagcaagcctggaaatcaacaggtggttccattataaaaacaactggagagaggggcttagagtaattcagcaagttttcatttttccttacccacgaaaaccttttgtgaaaggaaatcttacctggaacacgcactggtaaaatattcaaaagtggagctgctgtggtggggtcattgaggggagagggatttcgagggcttaccgaggagccctgcagggcctctgacttgctcctggyagggtagcttggaaaccagcagatcaggtcattatttggatttcttgaagctgtggtgcaggaatgtgtttctaagacatctgcaacctaatgggaagtaaaacactttcccacccctaggtgtggaatatttattggcacgttgtttctgaagcatagacatatactcagaccacaggtatttaaattatgttaactaaatcaaaacgtttatgaatttggatttttccccattatgaacatgtataattattttgaactaagtaagcatatgcattttcaattttttaactctttatttttataattgtgaataagtttctttcaaagactagagacttattttttaaattttatttttatttatgtattttttgagacggagtcttgctctgtcacccaggctggagtgcagtggcacgatctcagctcactgcaacctctgcctcctgggttcaagcaattccctgcctcagcctgctgagtagctgggactacaggcgcacaccaccacacctggctaatttttgtagttttagtagagacagggtttcaccatgttggccaggctggtctcgaactcctgacctcaggtggtccgcccacctcggccccccaaagtgctgggattacaggcatgagccaccacacctggctgagacttctttatttctatctagattaggaaaagacatgagaattgtgggggctcatgaagattccctttgtttctgtatcatttttaagttcctggggctgggaacacaaatacgtgggtaatactacattgcctatatctgaggttcccacagtttagcaagagagagaagggagatacataaataattgggatgatatttatatggttatagggaaagcattcccttgacttagacagtgacttcaacatgagcatagctgctggcacaggctgagaccaggccacttaaaatgttaattatgtgagcttacataatcttattatttattatttttattttttgtagagatggggattttgccatgttgcccaggctggtcttgaactcctgggctcaagcaatccttcatctcggccttccaaaatgctgggattacaggcatgagtcaccgcacctggtcaacttcaataattttcttcactttccacatccataaaaagggttattaggatggttatgtttatttgtggtaaactcttaggaacatgcctggcatttaggaagcacaaytgagcagttgctactactttttttttgtctaaaacagattccattaatatactgtttttgatattacatagatctaattcatactcatatttttaatgtaaaattgaaagatacataaatataactaaagtttttgtgcctgttctcaccacatatatttcaaaacatttatacgcatcctatttcacttttttaaataaaatatttcaagtacatagaattcaatttttggacaatgcggccatatttttttcttacttatcatattgtaatgcagtttgctttaaactaggaagccaaattatgctagccagaaccaaaagtattttttaatttttaatttttttttttagatggaatctcgctctgttgccaggctggagtgcagtggtgcgatatcggctcactgcaacctccgcctcctgggttcaagcaattctcctgcctcagcctcctgagtagctgggactacaggcacacaccaccatgcccaactaatttttgtatttttagtagagacagggtttcactatgttggccaggatagtcttgatctcttgaccttgtgatccgcccgctttggcctcccaaagtgctaggattacaggtgtgagccaccgcrcccggcccaaaatgtttagtcctcaaataaggataataactgaatggcccagtgtgacacagagaagaggacttatgatggctgtgggtgctggcccccaacaaagctggtgttcttttctttttgtctgtagtttcttatcctcctttgggtgtctaagggtcttttacayctcttgagtttttcaatactyacctttggatgtctggccagaccatgtcctagaactgttctgtcttcccaaagtcctggacctttaatggggcagckgacaactaaatatttttcatgttaattctctgatttagtcattcttaggtgtgagatacactttcaaggtttagtttcttttgaataaagtagtttgttaatcaaacgaatctccaattgactggggggtatttttagggggatggtccttggttttgataagttactttgctcctggcctggctcagtggctcatgcctgcaatcccagcactttgagaggccgaggtgggtggatcacctgaggctaggagtttgagaccagcttagccagcatggtgaaaccctgtctctaaaaatacaaaaattatctaggtatggtggtggacacgtgtaatcccagctactcaggaggcggaggcaggagaatcgcttgaacctggagggtggaggttgcagtgagccgaatcgcgccactgcactctagcttgggtgacaagtgaaactccgtctcaaaaaaaaaaaaaagttactttgctctccaccctttgttcttggaaggcagagaccctgccttttgccctcatacttcacaccaggcagccgcttgtgccgaccacacttaatatgctgagtgccatgggggacagcacatcagcgggtgttckgatgtcttgtgagaactgtgacaaatttatgttgagtaataactaggtgytggcastgtattgtgtcatttaatcttcacaataacacagttaattaggtcccaccgttttctgaatttcatcaatgaggaaatagcagcaaagaggaggtaamaaattyggtgcaggtgcttagcccaaagactaataatacatttcaaaatgtgcttacatttattgtgcacttactatgtgccaggtgcaacgctagccctttgcacgagttgttccattttaccctttctctgatcctttkaggtagattctagtattaccttcctttttcagaagaggagaccaatggggagcattggaatgatttggttgcaagcatactacacwacttgtaaactgcagrcacaggcttaaaaaaagtgaaaaactaaccatgcaataaagaatggaatgaaccatgaagctgtttctgtggccagtcatgtttttgaagcatatcccatgctaatttctagaacagaagaaacacacgtgttcttgtgtgtaaacccagtccatggaagagaccgtctgcttgtccctcctgatctctgggcccagacaaccagtagtcaccattccaagtgaggggtggctgcaactctacagccccgttcgtctctcctcactgtcaaagctgctgagaccccagactcgacacttgaaagaaacccatgtctgtgaagcacttgtggaccattcaagattgtggaagaatcactcaagagaaggagataggtgatgggatctagcttctgatggtttctattttattgaatgtctaatagggcaagaatttgaaaaacgagaatgtttgccatgcaggaggacctgggaaggagataacacatttacagggagaaagattgggattcagttgggaggagtaactgaggaaaggggtcactcaaaatattttgtattttaggtcctttttctattaaggaggaatggattatcaaagccttaacattaaattgtattgtgtcaggtgaattgctatggtttgaatgtggtgtgtccccctcccaaactcacattgaatttttttttttttttttgagacggagtctcgctctgttgcccaggctggagtgcagtggtgcgatcttggctcactacaagctctgcctcccgggttcaagagattctcctgcctcagcctcccgagtagctgggattacagatgttcgtcaccacacctggctaatttttgtatttttaatagagatggggtttcactatgttggctaggctggtctcaaactcccgacatcaggtgatccacccacctcggcctcccaaagtgctgggattagaggagtgagccactgcacccagcctcacgttgaggtttaattgccattgtaacagtataaagatgtgggacctttacgaggtgattaggcaatgaggactctgccctcatgaatggattaatgctgttatcatgggagtggattccttataaagggacacgttcagcacccccttgctctctctctcaccttccgccatatgatgatggggcacaaaggccatcatcagatgttggccccttgttctcgaacttcccaacctccagagcagtaaaaaaataaatcactgttctttacaaatggcccagtctcagatattctgttacagcagtacaaaatgaactaagtcatgaaacctaagatttacatgatttacagcagtggtccgcaaccttttgggcagcaggggctggttttgtggaagacaatttttccacagacccggggggcagggggcaaagatagtttcgggatgaaactgttccacctcgtattatcaggcattacttagattcttataaggagcatgcagcctagatcccttgcatgtgtagttcacaatagggttcacactcctatgagaatctaatgctgccactgatctgacaggaggcggagctcaggtggtaatacttgctcacctgccactcacctactgctgtggggcccactgcccaacaggccacagaccagtaccactccatggcctggggatcggggactcctggtttagagaattaaaaagatggaatttaacatttagctcattaagagcacatctcttaagccaaagtaaggcaattatccatgtggttcaggcaaaagttctatacagttttaaacaaatggagagattttctggttgcaaattagagacaacttttctctcagagcccaaagggtcacaaaaattagaataattaggctagaaggcctcttagtgacattttttttctggttgaagaatactatgaagtatttttctaatgcacagcatacttttagtcttatgttgaacaaaaataataaaccctcaaaaaccatgactcacttggctgccttagtagtaaagcatatcttgtcttactagggtccctttaaaatgagatgaaagggactaggaaaggaataagaatattgtggcattctttccagagtaattttgttgaagtctcatcagagttttcaattttcccacaatgtatattttaacacttaaaagtacattagaaaaattgcagaatcactttaattcaatacttttatttttagaacacttaaaaatatttttcaaatacacttgataaataatttaataaatataacataaataaatataagttagctcagatgctttcatgattaccaagttatataaataaatattttaaaataagttatgcttacatgtttgtttccacaaacactttggtacagaaatagcttataaatatttgcccttctattaaagtgaatgaaaaacaccttcaggatggatattttcccttcttagcaattcattcatgaaaacttaaaaacaatttatccacagtaaatgtcaaaaatacttgatcagaggtatcatgtggatgtaatagtcccatccttctttccccctccctagttcttaatccacatcctatcaaagtttcctcatttcaaagttttataaaaatgacaacggtttggagggacctcgctttttaggaagcattcagatagctcatcactctatcaatagtcactgcccgaattctgaaagcatgaagaagtatgcagagcttgattttagttttataaaaatccggttcttcaagggaggatttttgtggcacagtctcactgttgaaattcagggcctaggagaatgaacagtaagcatgacttacatggtattccaaaattcaaatattcattcataaaaatgagtgaagccagtacatgtctcagagcctgcaactcagtcccttatgccactcctaaacccaatccaaatctactctcagccagatcaccaggcagaatgagaaaagaaatactcattttccaagcacatccatcttcaatgagctctgaaaagacccttaaaactatttagaaaaaatcatcagtgggagttgtgtcttagaaagaaacagttcctttaaaatgacatctgctgcaatatctaattaattttatatatgttacattaaaaagcccacttctgtttagcacagggaggtgatggattgctattgatcagaactcactatcagtaacaggcctgtttactgaagacatgccatttgtgtcagataaacctggcaatgaatttcccaagtttagcactttgatttgataacagaatataaaaccttacatttgcacccttgatgaataaatactttcatatcttcctcacaaaaagtctaaaagaaagctagaataaagtcaccccattttatactggaggaaactgaggcacagaggggttaagtgacttgggaatagttgtctggttactggtagaattgattctagcacccaaatcacccaactcttggtcctaaaaatgaaatagcaactacagctctctagatgctaacattctttgatacttggatgaagctcattgcctttcaaacaagaaatctggcacatgcacacacacacacacacacacacacacacacacacacacacacgaaaagaataaaagtaaaacaattacttttcagacaatgatttctgccaccatatttttatcccatgtcctcgtcaccaaagcagtcaccctcgcttatataaatatttgttttatattagcatctgtgttatggtgattcagaacataacaaagcaagttcttgcctatgaataacattatagatgccccagatgataggtcattcttttatttggttcacattttggttcacaatgggtcataatcaggcaccaatcttgcttgtttcccagcaatatttgcagatatgcaaactggccccttgcatgcaaatcctggagcacgtcctggagcctttagaggtgagtgagaaggtaagtgtagtgaaatcctcttgaaggattttaagaggcagagcctcagacaagtggtttaactctcctaaggtttggttccctcctttgtgcagatcccatatggttgttttgaggctgacataagaaaatgcacaaaaacatttgccgagtgtgggggataccacagagtgaatactttggagtctgcttttcataatgtgatctgctcacatttgtgctccctatagacggcaccctcaaggctgtcttcttgaaaatgtaggtctgtcaggcctttaaaaggcctccagacctctttttatatctctttatcaaagaccctggctggttatctttagcatgaaaaaggtgctctcactgatagaatgaagtcttacctgcatcagctcatcaataactgccagcatgttttgatctagaaagatctgcctcttaggatccatcagaagctttgcattcatggtcttgaactccacctggtacatcttcaagtcttcataaatactactaaggcacagggcctgggtgacatgacaagatggggaagtatccattgagatgggctaaaaacatttcccccattgcatttgaggaaagagctgtgtgtcttaccatcataaaagaggtctttctggaggccaggcaactcccattctagaggaaaaaataatcagacatcagtgatatgaattcatcatacaggctgaaacttttcattttttgacttacagttatgaaagaggtctctctggaatttaggcaactctcattctagagggaaaaaatcatatatcaaagtattaattcttagtataaatctttctgactcttcaggtctcaaattttttttattatggtaaaaacacatatcataatatttagcatctgaactatttttaagtgttaagtgtattcacattgttgcaaaaaaaaccattttttaaaaataatttttctcccaaatctaacttctgaagtaggaccagttaaaatcccataatgatggataccagaaacgtgaatttttagaagcaggtgagatttgatgcacagtttttaaccacactgcatgctctgggaggaaaatcctttataccttggttaattccaatggtaaacaggcctccactgtgctggttttatcttttgtgatatcttcatgatcaatctcttcagaagtgcaagggtaaaattctagagtttgtctggcctataaaaaatgaaggagaaactcagtttataacattgataatgcacctggcaccccacaaggctggtaagccagggtgccaggaaggctccggctggctgcccttgacctctgtcactttgacttgcaggaaattctggttcttcataatacaaaagaaaatagattccttacattctgtctctcaccctcctctccctaagcttggggcatgtttctctggattacatattttttcattatgtaaacacaataaatcatgtcaacagcctgtgctaaccagcctccacacctcactgtgacacttgcttctggtgaaaattgtttcttcttttgctaaagtgactgtattctatgaatacctatttcaagtataacttctaaagggggaactgttaaggtcacagtttgatggatataacaaacatgcaaacccttaagacaagctgagatttaatttgcagtgcacacacgcacacacatacacagagatgtcatcttagtgtgttggaaagcaccgttgggtaaaattatgaaatgtatcttaggaagtaaaggactgtatgattgaagattacgatcatttttccattcaacagcctaatgggtggcaggcactccattaggtactaagaacatgacagagaagaggaccatgtataccctcctggattgcaagtttagctgctgagacagacaattgcccaaatgaccaggaggcatcagtaggtgagacatggtgagaagggcatgaagcttctgaggaggggcaggaagggaagcaaagcttcctag

SEQ ID NO: 17909 - DNA, 13363 bp, Homo sapiens
tttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctatatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacacagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctataatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaa

SEQ ID NO: 17910 - DNA, 23063 bp, Homo sapiens
cagactctgtggaggtggagctcaggttatcacataattttataaagctcctcaggtgattctaatgtgcatccagcattgagaacacctgccaacttgttgctcctcagtaatcacactttagtatgcgcaagaatcacctggagaactctgaatgtagatgccagggccccacgcccagaaagtctgggtcaatacctctgatgggggctcaagatcctgcttttctaacaagctctccagaggttcagatgcaggtagcatttggaatattaagagacacttccattgcccttctgtctgctcccttcccaggagactcagctaattagatgagttccttagatcaatgatcctcaatctttgatgaatataagaatcatctagggagcttactaaaaatacagttgcccagacaccagtccagtttgtttaaccagatcctacataaccagctgccccaggtgttaggatgcatcctgaagtttgagaatcaacacctagaagagtggtcctcaaacctgagcaggcaatgtaatcccctggggagcttgttaaaacacagattgctaggccccacctctagaatttctgattcagtctatctggggtggggcctgagaatttgcaactcctaacaagtgccaggtaatacagaattgctaatttggggaccctaattgctttagattaatgttctaggccaggtgcggtggctcacacctataatcccagcactttgggaggccaaggtgggcagatcacttgaggtcaggagttcgagaccagcctggccaacatggcaaaacccccgtctgtactaaaaatacaaaaatttagctgggcatggtggtgcacacctgtaatcccagctacttgggcggctaaggcagaagaatcgcttgaactaggaggcagaggttgcagcgaaccaagatcgtgccactgcactccagcctgggtgacagagcaagactctgtctcaaaaaaacaaagattgatgttctaagcaaagtgtttatcccactctgtctccagttcatcatttctcctcattccctcagccagcacagaattcagttgaggagacagaaagggcagagggaagcactcaaagaggtcttgacttgaagggactttcagagaaggacttctggtgagctcaccactagggaaactggcaaaattctagtaactctctacagccaaagatggtggccaaattccagtgggaaatagaagtaacctgatcaatagctgttaacttcacagatacgtccagttccaatgggactcaagagcttagagcttccctggcagaatctctcagcctgtggtggtgaggagtgtgtaggtatagtgagaaatcagagaaagtttgaggctggggggccgggcacggtggcttatgcctgtaatcccagcactttgggaggccgaggcgggcagaacacgagatcaggagtttgagaccagcctggccaatatggtgaaaccccgtctctactaaaaatacaaaaattgtctgggcgtggtggcgtgcgcctgtagtcccagctactcgggaggctgaggcagaagaatcgcttgaacccgggaggcggaggttgcggtgagccgagatcatgccactgcactctagcctgggtgacacagcaagactccatctcaaaaaagaaaagaaaaggaaaaggggctgacacttgttacattcgttcattcattcattcatttagaaataaggtctcactatgttgcccaggctggtcttgaactcctggcctctagcaatcctcacccctgagcctcccaagtaggtgggattacaggcatgcaccaccatggctggcttcaccaagacaattaaatggaaaaaccaagctggagctagagagtcctccctccaatggcattaaccccagcttgtacaatactctggagagagagctaaaaagacagtagggtgaggatgggaagagccaggtgagggagaaagtcattttcttccctttatatgaaaagagaatgagaaattaagggcaactggagaaccaccaaaaagagggaaggagagactgggctaggaagcccaccagctggagtccttacaaaatctgctccatctccacaacctcgtgccagaacttggtgatgtgctaagggcatgtgatctgttgaaacaccagaagtcacatttttaggaagtcagaaggcagacggctagatccagcatctgctgatttccttatacatgccaccgacctatccactaactcattgccagtgcatcacatgaccagcaggttcaggagaaattccaggtgttagaaccacagtcacagggctgaacaggcctggggtatttcagaaacaagcatcaccctatgcaggcttggatatcagcactgcgtggtgattatggtgatagggaagttctccagttgggtggacagagttaaggaggtaattagcagaactagctgccctgaggtattgatccccaaggttctacaagtggtaactctagcttggtcagctacctactataaatcacttacagcctcagtttctcacctgtaaaattatgctgttgccttatctacccgaaggcaggagactaaaccaagtgatatctccttttcttcccgcccccagccaggcaccaagtctattctatccccaccaatctcccatatttgtatcctctgctcacatcccattgccatagccctggctcagacacttttcagctcctacctcgctgattgcaatagtctccaaactggttttccctgctggtagtctcacccaggcccaagaatcttcctttgatcaatttttcacactgctccaaaatctttaacaattccacatcacaagaaagttcaaagtccttcatgtgtcaggcagagtcctctaggcccgtaggttccagctcttgccaatccctccagtcaaatcacttcaatgccagcccctaccccagcggctggaaccacctgcagtccctccggtgccctgggcttcctccctcctcttcacgtttgcatgtgctgtttcctctgctcagagaagcatttcttcctcctgtatttgcccttcaagattctccccaaggtcacctcctccaccttgctgtcttagccatccctgcccatcttgtaaatcttcctcaccctgtactctattcatttgcaatgtgtctcttccccaacttgacccttatctcactggggttgagactggggctctcatctttatacccaatacacagcacaatgccaggcccatggccgactcccaataagtgtttgctatattaatgagtgaaggatgaatcagtgaataaatgaaacttttgggttctcttctagcccctaatcctcaccaacctgtgctaagaatgcccttcttaggccagccatggtggcttatgcctataatctcagcacactggaaggccaaggcaggaggatcacttgagcccaggagtttgagaccagccagcctgggcaacatggtaagaccctgtctctacaaaagaattaaaaaaaaaaattagccaggtgtggtggcacatacctgtggttccagttacttggaaggctgaggcaggaggatcatttaaacccaggaggtcaaggctgcagtgaactaggattgtgccactgcactccagcctgggcaacagagcaagaccctgcttcaaaaaagaaaaaaagagtgctcttcttttagtggtcctttggtcctttttttttttttttcctgagactgagttttgctcttgtcgcccaggctgtagtgcagtggcaccaaactgggaagctattgtagggtagactgggctcaactaatggtgatggtggggagggagagaaatggacgacttcaagagatatcagtcaaatccccaggatttggtgatggaggggatgaaggaaaccaggagagaagcatcaggatggccccaggtttctggctttcataattgaatggatgtggtgccatcatctgagacagaaagtgatgggagatgtctccacactggggcatgaagactcggccagtttggggcaggttgactttgaggtcccctgtgagtgacaaccaaaaggggtgtcaagtagacaacagaaaataagagtctggagtgcagaagagaggtctggctagagatcagctttgtaagccatctgtttattggtggtcatttaagcctgggtgctaacaagatcctaagggagaaagcttagggtgggaataggaagtttaagatcaggctttaggaatcctaacatttaagaccgagtaaaagaggttgagattacaaaggaacccaagaagccagagatgttaacaatggctgtggaatgctatgaaagtattttacatttgtagctacttttacaattgaataaaaatgtttagtttaaaaagccaatttttttatggcttctagaacttaattcactttctggattttgaaaaatagtgcctgagggcaagaggtgatagtcaaaatatttaactatcaagataccccagtaggacactttcgcctgagccagctggaggagggaggatctcagaggcctttgctgtgccacaggcattaaccctgtggttgctggatcatgaagaagtggagagaggctgatggcaggggccacgcagagaggatctcaggacagcatctgtttagtcattgagcagaaccagtgcctgctgctgagaatcagtcctgcagcagggtcatcaccagctggatcccaccagatccttccccaccatctccacctactcattgccccccagagttctccaccacaatggactattcctcatttccttagaacacctcaccttttcatgcctccatgaacttccctacgcctacaatgcctttcttctagtttggcaaatttctgtgtgtatttgaatgtccagataaaatatcacctcttctgtaaagtcgtcattgacttcaccaggcagaatcaattgcttcttcattatttttccatgcattttatgcagacttagtatagcactttgcaaagtggtgagctccttgaggactaggactgcctcatttgtatctaaaataatgtcctgtgtatgggtactttaaaaaaatgacaaagggccgggcgcagtggctcatgcctgtaatcccagcactttgggaggccgaagcaggtggatcatgaggtcaggaatttaagatcggcctggccaagacggtgaaacctcgtctctactaaaaatagaaaaaaattagtggggcatggtggcaggcacctgtaatcccagctactcgggaggctgaggcagagaattgcttgaacctgggaggcagagattgcagtaagccgagattgcgccactgcactccagcctgggcgacagagcgagattccatctcaaaaaaaaaaagaaagaaagaaagaaatgacaaagattgttgaatgaatctcaatgtgactgaaacctcaaaaagagacctagaacatcctttttttttttttttttttttttgagatggggcctctttatgttgcccaggctgttctggaactcctgaactcaagggatcctcccactttggtatcccaaagtgctggaatttacagatgtgagccactgcacctcgcctagaccatcttttccctcaatttgttattaaaactcagcaacctcactgacacatgctatgccatggataaaacttgaaaacatcatgttaagagtgaaagaggccagtcacaaagaaccacatattataggattctattgatatgaaatgcccagaattggcaaacccacagagaggacagaaagtagtaaattagtgattgcctagggctgagggggttggggagaaaaaaggagtgattgtgagtgggtacaggatttctttgtgaggtgatgaagtgttctaaaattgattgtgatgtctcacaattctgtgaatctactaaaaaccattgcattgtacacttcaaatggtgccagacgtggtggtatgagcctgtaattccagccactcaggaggctgaggtgggaggatcactctggcctaggagtttgagatcagcctgggtgacagagcaagaccctgtctctagaaaagagaaagaataaatgggtaagttgtatgatatatgaattatatctcaataaaactgattttttttctttagagacagggtcttgctctgtcacccaggctggagtgcagtagtgcaatcatagctcactgcagcctcgagctcctgggctcaagcaatcctcccgtctaggcctcccacagtattaggattacaggtgtgagccattgcacctagcccagaattgattttyaaaaaacacctcagcaactcctcttacttcatctaattcaaagggagggcttaaatgtttccttcttggaaggaaggtggacccaatgggagtgagtatggaggggtataggcaggggtgctgctgtggtcagcttgggaaagatagggcatacgtggaaagcaggctgagtgctgttaatataatgggctgagaatacttcagaaagaggggttctggtgaaaacggaaaccacttcaatgaaaccagattgcagcagaaaggctgaggttactgtgagaacagtgaagttttactttgaaaccaatggctgagtgtggtctcctcatctggcctgggaatcttctaggaggaaagaattgttatctaggagaggattaaaattctgatagatgaggctgggcgcagtggctcacgcctgtaatcccagcactttgggaggccgaggtgggtgaaccacgaggtcaggagtttgagaccagcctggccaacatggtgaaacccccgtctctactaaaaatacaaaaattagccgggtgtggtggtgcacgcctgtaatcccagctactcaggaggctgaggcaggataatagcttgaacctgggaagcagaggttgcagtgagccgagatgggccactgcactccaacctgggcgacagagcaagactgtgtatggaaaaaaaaaaaaaaattctgggctgggcgggtggcttacaactgtaatcccagcactttgggagcccaaagcgggtggatcacaaggtcaagagaccgagaccatcctggccaacatggtgaaaccccgtctctactaaaaatacaaaaattagccgggcgtggtggcatgtgcctgtaatctcagctactcaggaggctgaggcaggaggatcacttgaacccgggaggcggaggttgcagtgagccaggattacgccactgcactccagcctggcaacagagtgagactccgtctcaaaaaaaaaaaaaaaattctgatagctgttgcctagaaacccagcaaccataaagtagaaagcttgaaaggggggctgctctccttttgccctagttggactctcctgagaggtgataaatcctagtaccgcgcatgaggactctggagatggctgcctgggttcgaaccctgactctttgcatttggagctgcattgcctcgtgcaagtcactcaatctgtctgtgcctccattttctctactgttaaatggggctagtgatactaccttcctcataggattcttgggaggattaactcagacaacacatgaataatttagcacagtgttggtctggcatggtggctcatgcttgtaatcccagcactttgggaggctgaggcgggttgatcacttgaggttaggagtttgagaccaacccggccaacatggtgaaaccccatctctattgaaagtacaaaaaattagccaggcgtagtggcgggcgcctgtaatctcagctactcgggaggctgaggcaggagaactgcttgaacccgggaggcaaaggttgcacagtgagctgagattgagccactacactccaaactgggggacagagcaagactccatctcaaacaaaaaaaaaaaggccgggcacggtggctcacgcctgtaatcccaacattctgggaggccgaggcaggcggatcacgaagtcaggaaatcaagaccatcctggccaacatggtgaaaccccatctctactaaaaacaatacaaaaagtagccgggcgtggtggtgggcgcctgtaatcccagctactcgggaggctgaggcaggagaatcgcttgaacctgggaggcggaggttgcagtgagccgagatcacaccactgcactccagcctgggcgacagagcgatactccatctcaaaaaaaaaaaaaacaaaaaaaacaaaagcaaaaacagaaaaagcacagtgcttgatcrtggaggcactaataggaggcagtctctggagtgagaatctggaactgtgaaactggttgctggagaagcggctgatgcctgctagcctggggtgagatctaatattaggcaaagagacagcagctggctgggggtcagggtgttggctgggaaatggcctgaaaattgttaacagcctcctggcttaaccctgccagtagggctcatacttcctgttttcagtgtctctgagccctgatgctggagctgctcaagtttgaacaagatctttcttggcccctgaggggaaggcagaaactgaacagccactcggcttgggcagcttcctagcaggtttccactcccgcaaaatagtgcagttctgaggtgggagagggcagagggttcccatctgatctgatgctacaataatttacttagctttgtaataataaccaccgtttttatgcttttattaggtgccagtattatgctaaaggacttatgaactcatgaatcctttctgttgttgttgttgttgttgagacgaagtcttgctctctgttgcccaggatagagtgcagtggtgtgatctcggctcactgcaaattccacctcccagtttcaagcaattctcgtgcctcagactcccgagtagctgggattacaggcatatgccaccacgcctggctaatttttgtatttttttttttttagtggagacagggtttcaccttgttggtcaggctggtctcgaattcctggcctcaggtgatccgcccaccttggcctcccgaagcactgggattacaggctgagccactgtgtctggccttcatgaatccttataacaacccagggaggtagattgtatcatctcttttgtacagatgaggaaactgaggtgcagagaggctaataacctttctcaagtcacacagctggtgttagattctagttcaggccaccggactcgaaaatccatgctctaaaccactgcatcaacctgtgtaaaacagcacactagatgatggggatcaaaagccgaatactaatcccagtactttgggagaccaagggaggcagatcacctgaggtcgggagttcgagaccagcctggccaacagggtgaaaccccatctctaccaaaaacacaaaaatgagccgggtagtggtagtgcatgcttgtaatcccagctacttgggaggctgaggcaggagaatcgcttgaacctgggaggcagaagctgcagtgagctaagattgcgccactgcactccagcctgggtgacagagtgagaccctgcctcaaaaaaaagaaaaagccaaatacttggagttcttgccctctagggaagcacggtccagaaagcctttaaccaggaaatccaggagaccttgtgccaccaaaccccactcagaaaactggctgttcatgcagagaactcatgctgaccatatcttgaatttttctgggcacttcatatattctgaccaattgtccccaaaggctgtcaatcagtggtgcatgttagtaacacygagggagcttttctaaaaccacragacctggagccagccctgacctgaatcacaatctctacaggtggagtgtaggtgtgcatattttaaaaggtcctcagatgactcgattaagaaacactgccccaacccattaacacagcttggcaattctaatttttgatacccaattatctcccaacctgccttctacaccccagcttttcagaacttgatgttttgttcaaaatatatagtcacccccattaggacatcatccagctttgagattctgggccccctaatcataggcatagcaatggctggtcacaagctctgttaacacactgagaaaattccagcatcagtcccacacacagatgatgggaaattatgktttttgtttcctgaatgccacagagtcaagctggcattctggataagcaattttctttmtttmtttatttttttatttatttgaggcgaagtcttccctctgtcgcccaggctggagtgcagtggtgcgatctcggctcactgcaacctctgcctcccgggttcaaatgattctcctgcctcagcctcccgagtagctgggattacaggcacccacccccacacccggctaatttttttgtatttttagtagagatggggtttcactatgttggtcaggctggtctcaaactcctgacctcaggtgatccacacacctcggcttcccaaagtgctggattacaggcgtgagccactgagcctggccagcaattttcacttacaggtcttcttcttcttyttcttcttytttttttttttttgagacagggtcttgctctgtcacctaggctggagtgcagtggcacaatcagctgactgtaaacttgaactccttggcttakgatcctcctgcctcagcctcccaagtagctaggactacagacatgtgctaccacacctgrctaatttttttattttttgcagagacagggtctcactaagtttcccaggctggtctcaaactcctgggctcaagcgattctcccacctcagcctctcaaaatgttaggattacaggcatgagccactacacctggccacaggtgttcttcttggttgaggtcagctcaaggattgttgggggcagagtgaagagactgttgtggagttaaccctaaagaagaccaccatgtacagctgtacaagatgtgcactgcacaaaggcatcaggttaaggaggcaattgggagctgacactaagcctgtacactacttacacagccatgggattgtggtttggggaaactttgtatacattaagtgctgtggtggccctgccctacagctctcctaacctctacctcccaaagctccattaagtccagagatgcagtcccataagaaactctagggtgcagtccacctttgttattttctcctttttatgtactccaactccttcccatacaagcaccagggagatttgtcatcagaaaaatcacattttattgatcacttttatttaaaattacaaaaatataaataaaaatagtgaaatataaatattcagtgtaaggagtggtcctcaccccacccagtgaggattggatgaactaggctaaaaggaagggataactggccaagaaagggacatctatgtgaaagtgaaactgagacagtgctggtcacaggtcatgctgcagaataatacattcccaggcactgtcacgtgggggacccaagaggccccaggagtgacctataacctctccagaaagaccactctgtgtggcatcacagtccacacagtttaaggaaatatttagacttaacaatcagacaccagctcttactcacacttacactcacagcccacacacaagtgtgcaaacatacacamacatatatatttcctgatacattcatggaatatcagagccctgccctgaagtcgttagtgtctctgctccccaaaccgctgctcccacattggctaagctccctcaagagacctcagctgttacacttcctaattgggaaattattcatttctcaaccatgggcctcacaaatgcccaccgtcgggggagctggctctcccttcacccatgcacaggagatgccctgccctttttaactcctgcaggcttcagtccagaaaaagacaagttgctggtcagtaacatgttgagtcaggaccacccctccatcctggccagaggggtctgggcagccagcacccaggcctatgcctgagggtaaagctattgtcgttcrccctggtgggtgscacaggcaaatccatctgtgcagagcctatcttcccagtctcttcttacagctgatggagatgactctactgcaaaaatgacaaccagcaagaaagcgggtggtgcccgtttcctccctggggaccctcagagggccaggccattctcttccttggtgtgactgcggatccagggtaagaagtgtgagactctcgtgtagacgcctggcttgtccttcagggcacatccamggccccagctcacaattccagtcaaagtcatgcggccttggagggaacagacgaggggtccccctgagtctccctgtgacgccaaagatacaaaagatgagccctagagaagtgaggaggggatttctgatcccatcacccaaccataccagagagagggaagagtttcccagtcaaagtccttagcgacttcccattttctttctttttttcggggggaggacagaatctcgctctgtcgcccaggctggcgtgcaatgacgtgatctcagctcactgcaaacttgcctcctgtgctcaagcgattcccatgtctcagcctcctgattagctgggattacaggcaggcaccaccacacctggctaatttttttttgcatttttagtagacacagggtttcaccatgttggccaggccggtctcaaactcctggcctcaagtgatccatccacctcggcctcccaaagtgctgggattacaggcatgagccactgtgcctsacgcagccccattttctaccacatcaagtttaaaatcccctgcttggctttaaaagccctgtcatctgccactattccatccacactcccagaccctagttctcctccccacccggaatatgccagcctccttctcagttttgtatctttcaactgaaacaccttcctttcttccctctgcctcttcaaatgcctatcaagtcacatttcctttaaagcctcccctccctgaccctcaggttggcactcacctccctctcctgaacacctgatcatttatagttcacaacacaccctgggcactgagttacattgtcttttactgtttcctctttctaggatctcgtgcccccagtctgaagtgactagcgcagagctgggatttttttggtaatgtctggcaaacacataaggactggtttaaaccctcaaagacctgagctcctgattctggctacttagggctttggctagagagagacacccttaagctggctggracaagcccaggagctctggggagatatggaagaggtggagagagatgcttggaacactcacctggcaggaatctgttttccactgtgggtcagcagcacacagcattttggtggtgacttcagagccgtagtagtggggctgctgacactcccggtgggaaatcagcttcacaacagtcattttcagctgctccggatagagatagtcggctaggtggagaaaacagggaggcgtttgcatcaagatttatctgtccactgggagtctgccagagaggggaaccataaagtatctctaccagggaaggcccttattctcttccatgcaaatctgagcctttactccacctatagcccctaccatctatttacctttgcagcccatcgctccctaaacaacactcttcatccatccctggacccatctgccaccgcytcagtgctcccacctctaactctgcagtcttcccttgatcacrctgggctcattttcaggtcaaaacactcctcaggaccttctaagtcagtcgcaattgtcacttactagaattctcttttccaaagccagtgatctcacagcttgtgccaaactggggatcgttatacatcgagggcaggcagatggtctgtatagtccgggatggctgcgcacacctgccctccttggaayggatcttcagcaaggctgggggaggacagagggtcagaggagaaagatcactactggttaggcggtccccatctgtcccctccaagtgccgaggaagtagctatgcctatccctaggtcagtcatccagggaggtctgctggtcgcttatcacctggaaacctcccctgccccatgccccaagggctttgttccaggtgttgaaaaaggcttggatgkccagagccactgcatacagctgtacaggtygtttctgcaaaaactcccagctgaggtagttaggctggaatccatcccraggctccattctccaagttctatatcctagcacagacagaggctgcatcccacaaaggaaggtgtgtctttttctaattcatataaacagggccttcccagcccaagccatatacccacagggctgtttccactcgcaagaggctacttgttggggaaattcagggtctctccagaggagcaccaggcccctcagacttcatggaactcttccctgccactccctttgtcatgtatatcgaggcttcaaggtccctcgccccacccctgccccaccgggcagcttcaacctcagctccagtctctccctgggtcccactctccccaagccattatggccacagtagtcgcggggttccccctcaccaatgtcrttgtggtgagcaagcgtgtcagcgctgtagtccttgtgtaggatgaggttttccacctcaaacttcatctccccttgcgtgttggagttaagccttgagcgacccaggtagacgatgtagtcctccttctktgggtaatcactgtggragaagatacccatcaaacagcttagtcccatgaaatctgccacttcttccttccctccctagaggcctcaaagcacgacttgtccccaaggccatgggctgcatggacaggggcagatgagggagaaatgaggcrgaacactttgctgggaaggagaaagggatgtgcttggggtggggcagaagagtcgaagaggagaaacccagggccgtacatgaagcagtgtgtggcgctgatcacccagcaagggctgatgaggctgcctccacacacgtaggtgacagagcccccccggtgcctcctgtagatggccgcaaaccagggctggttctcgatggtggtgaattctcccccaataatcttaaagcggggcctcagagtcttttggccacactgaaattttaattcttctggaggagaggagggcttttttcctggaggacaaacagagggatgtcttagggaggcaggtaggagaaagcatccctctcgggcaccccccacctcctcagtcctcctgtgatggaataaggggacatgtaagtttgtccccttccaccccactgtcatcagcaggtcagtgatgctcaccatctgcgcagtcatgcaccatgcactcttggacaagcrgctttaggcccacctgcacatagcaccagggtcgcctccggttgtctgggttcctggcaacacagaaagataggggatgtcattccaayccagagggccttccctgcctcctcccctcagggaagactcaaccagaggcygcacttctcttgtgctatggccagccctctgggagaaggggatggtaacaaggtttctgggaagctgtagggagggcttttggtccttgttgcccccacctcacctgcagtaattatgtttycccaggcccagctgaagagcatcagatctgtgggcatggtacgtttgctgaaggacagtggcagagttccagggcaggcagggccggcccatggtgtcagtgctggcctttcctcggtaaaagtgaccattcccctcatagcaggtttttgacttatctacaaggggacaggaggatgagagaatatgagaaagagaagaacattccaactaacttttwttttttttttttgagatggagtcttgctctgtcgyccagttggagtgcagtggtgtgatctcagctcactgagatctctgcctcccaggttcaagcaattctcctgcctcagcctcccaagtagctgggactacaggcatccacyaccatgccaggctgatttttgcatttttagtagaggcagggttacaccatgttgtccaggctggtcttgaactcctgacctcaaatgatccactcammcttgacctctcaaaatgctgggattacaagcgtgagccaccatgcccggctgccaacggacattttaaagatgtcgtttcagacctgccagaagactggacagggtctccttccaaccccacctcacatttgtgtggccactgtttcrtgagcgtgtgtgtgtgtttatgcttgtcacatagggatgaagatgtcacccaccctacctccagctcctaactcctgcctgctcttgcctcccacccatccctccctgtccccaaatttctctcccagttgcagtggagatccccatacctatttcacagtgctgccctccgaatttctttgggcagttgcaccagtgaatgttggagaagtacttgttggacacacatgttcctccatttagacagtcacagttcgctggagagaacaaaggtggggtaagcgagggggagtggaagtggtaaggggtggcgcagccctgcagcagagggcagggaggggatgtcccctgaagycttcccaayttgtctgtgcagccaactgttgtaggggtggatactcacatggaacttgatgaagttcattgctgccctggaagagattcgggaggaggcttcatcaaaggtcccatgctccagggactccagggtgagggtaaactggccccaatcccaaaacccactcttccctctccctctcgcctcaccctgttcgtatctagttctcaaatggaagaccatgggtttccagccaggagaaatggattgacccaagcaagcttcatctaccagatgcccgcaggctggggcagtcccggcggcctcttcctcccttgccagccagtgccaacccccgtggttctcaagcctccgctgccaccctgtcccatttcctggggagagtctggccctgctgtggatggaatccggaggaccccagctccctgagcagcccctcctctcccctggtgctgatcagaggtccttgggcagcatcagtcaaagcaagagcgcactcactttggagtcgctcacgaccaggacgcagagaagcaggcgcgccagcagggctctcatggtggcgaggtcggggcgctagacggcggctctgcaaaggaaggagaagtcagggcaagaggcggaggaacgggaaggcaggccaggcgggcgactgcagcgcaggggagatgcccgcggtgaccaggctccccagctgtctctctcctctctgggctccggactccgggcagcctggatcggcacccgcgggggacgcccgggacggggcgccttgactccgtgcagccgccggggagcccagggagcccgggcagcccagggcgggggaggcagacgctcgggagctggggccgccgcgcatccggcccggggatctcaggaccgcggcactcaccggtggctgcggcaggagggcgcgagccggcgctgcggggacaggtggaccctggcccgggctccggggctgcggtctccgcactgtgctgcgacccgcggcgcctgctctatatcagggcccgccccggcgccgcccctccctctcccgcccggctccctcccctgtcttgcagcgctcagcgacccggaccccgcgtgcttccgcaacgctcacaaagatttgggggaagcgcgatctccagcggaggggacccaacagcgtctggactgaggaatcgagaggcttgtaaattctccgtgcttcctcccatgcacctggccgggggcctgccccagtgcaaggagtccccgaattgcagagaggagagaaggcgcacaggagactctctacctcgcccagctctgaagcctcctggggtcctctaatcagttcttctgcaacttctccccgctgggccccaacttgcctaagactgcctcagacccccttgcccgcagctgatggagctgtgaagtcttcatcaacgcgacaaatgtacgagacatactctcccagaagcacagacagaaaaacccctgcctgtaggggctccctctgtgcgtctgttcagtggcagtccccagatatcaccaacacaaccagtggatggaacaaagccgggcttattgctttcggcagtaagggggtttgtttgatggtgctatcagagggggaaaggcaaggccagattactgaaaatttgcagcttggtttaaagtccgtttttgacagggcttgataaggattgggttaggtgtcgtgatatgatgttacaggattgtgggaacaaagtcctagggcataaactgttggtgcttcctattgaagtgttaacgggtcttttgggaagtttccataatgagcaattcatttatttgtgcaggcaagaataaaagtaaagacaatggaaacatgtagacagttctaactgtggaggttctggagggtgtggaagttctgttctcacctctgagtagaggaattgggagactggaggacaaaataagaggaagatttatttttcactgtttgtccttttacactcttaacattttaaaaagcacatctctgtatagcccattccaaaaagataattatgcattttttaatgcatgtgtatttagtgttttacttcatcatagagccttgtttattctattcagatagaaacaattgtttatcaaataaaattgtcctccagaaaaacagaccatgtgtaaatgactgcatccacccttcctgcctgaggataagcagacatttgtgtatacacacacacacacacacgcatctctgggcacacttggaggaacatagcagggattctgtgattctgtcacccccatctctttcccctagtgtcaggaaccagggcttggggtcattttgaacccagtaggactcgctctcttagtgggaaggaggaggctgagtcccagcaatccactagcggctttgggccctttcccagcctaggcctgcagcattttcctgccttgcaaatctggaccttgggtctgggtccacctgagagtgacagaaggaaggcagggagagtgccaggaaggtaggaaggaggaaggctcctttgctctgccccagccgagggctcaggatgccagctgcctgctggggaaagtacaagttagcctttcagcttttgggaggcaggtgacccactgtcttctggagagacttctgtgcttgctgagctgccagccttccaggggacagactgagtcagagatgctataggcttcagagccaaccttgctacttcctctagaagactgtggtcagttttgtttggatttgagaacccattaattgtaaataaacgtgaccagaacataaacagagatgctgcagcctgaggacttaccccgaaactcccaggttagttatcaggaaattcccaggggccgtcatgattcatgttgctcccctagcagctctcatgactccagattacttggctggaggctgtcatgctgattgctgagagcagatgacttcatttcctcctggacaaagaggtttggagaccgttatgaagcgtgacaccctttctccccttccgccccctcctcccccgtgccacctcttcacctagcacttcaactcttcacagaacttccttatccatgcgctaatctttagcactctctgaaatctttgtgcacagttcttttttttttttaaagacaaggttttgctgggcttctgggttcaaggggtcctcccacctcatccttccaaagtgctgggattacaggcatgagccaccacgcccagccatattttttttttttttttttgagacggagtctcggtctgtcacccaggctggagtgcagtggcacaatctcggctcactgcaagctccgcctcccgggttcacgccattctcctgcctcagcctaccgactagctgggactacaggcgcctgccaccacacccggctaattttttgtatttttagtagagatggggtttcaccgtgttagccaggatggtctcgatctcctgaccttgtgatccgcccacctcggcctcccaaagtgctgggattacaggcgtgagccaccgtgcccggccccagccatattttttatattgtatttctgtcttgtgcttcaaggcacattaatgtaaaccatttctctttaaactcataactgccttatgatatagactggtattgttgttcccattttgcagatatggaaaatgaagtggagagaagatacacagttgatgagcagcaaagccagcactaaaacccagcgtcttctgatccttgttcctatgcgctatacctcactgtctccataaaagacagaacgctgtgaagggaggggccagtgagctaagatgatccagctcaggggagccctcctcctgactttggagacctccttccagaaagactgctcggactatggactctgagctcttaagttgcacccgctgtaatacaaattagttgtttgcctgaattccaagaactgtctctgtggtctaggctgtctgaaatttctgttgagggtaagagaataaggaactgaatgtgtatgatttcattcttttcctgactcctagggtgaagccaccaacccctgcctctgtgtctcaagggtacagagctcctgagtcagatgtggcaacacagactgctggagaagccctttccaggagattctcataaaagggaaggcagatgccagatgcgcagggaggggcagggtatccaaacctggccctgagactaagtccaggaaactcagcccctaaggactattttctgacccaaaaggaagttcccatggagtcataggatgcaattctgtgttgtatatgaagaatgctcagcatggcactatagaaagaccacagtgcctagccttcagtctgctacatcaaagttgaatgatcttaggcaagttgcttaactcttttttttttttttttttttttgacgtggagtctcgctcttgtcacccaggctggagtgcaatggtacaatcttggctctctgcaccctccaccttctgggttcaagcaattctcctgcctcagcctcccaagtagctgggattacaggtgtctgccaccatgccggtctaattttatatttttagtagagatggggtttcaccatgttgtccaggctggtcttgaacccctgacctcaggtgatccacctgtccagcctgtgcctcactctgcagattggctgagatcatgcttgcatgtaaaagtattcattcattccatatttatcatggacctactgtgtgctgggcgcagttctggatgctagagataggaagaggaactgtgtaaactgtaattcctacatcgagtgcctgcctcccctttttgactgtggctggattgactcagaagaccaagtcaggctggagtccattccaggattccaggccaatggggatgctgtatccttggccagcagttcccagcaatcaggcagctggacccacagctgcatgtgctgttcactcccacattgcctatgcttactccctctccctcttgtctgtgtccctgtgtggcctgaagcgcctctttccctcctacacatggggcagacggactcttcaacagttctgggaaggaggtacggaatgctggtcacatagcttccttgagtctaaggaccccttcttcctgagtgtctagtgtgaagggtgaagccagctggcaacggcaggcactgaaagccgcttctgggcatgtaacatgatagggggattgctggagctgcaggcccccagcaggctgtggaaggggtggagggaggcagcattcttgcttccttactcatggaaagcaaagagcccaggggctgaaccctgaggttacactgtcgtcagtagcaccatgaaaggggaactaaagctggtccctccagcatcaggctatgacccccctaaccttcctcactctttttctgccttaccagctctggcctgcttcctaggcctacccaggccactcagctcagacttctgcatgtatgtcatgagtcttggccaaatttttctttgtccctccctgacccaaacccacttattacctaagtcaggaacttactgctttaaagtagtttgccaggtgtggtggctcacgcctgtaatcccagcactttgggatgctgaggcggctggatcacttgaggtcaggagttcgagactggcctggccaacatggtgaaaccccgtctctactaaaaatacaaacattagccagtgtggtgtcacacgcctgtaatcccagctcctcaggaggctgaggcagaagactcgcttgaacccgggaggcagagggtgcagtgagccgagatcgggccactgcactccagcctgggtgacaaagcgagactccattaaaaaaaaaaaaaaagtagtgttggtcatggcttaccagaccttctggattctgagcccctcaccaggaaccaaagttaggccctggtcctaaaacttctgctcagagttctggttaccatgttgggtggcaatagatgcttaactagaagcaaaggggcatgcccaggaacaaaggactgggatgactaaccagcaaatggtgggcttgctgaagactgccaaaaaatcaataatatttagggatatatgttcagccagaagctgaaatactgaaaaaatcctattcagaagaaaactaacataatattcataacccatatgatgtctaattccacatgctcatggctctcccaagctggattctatgtgctggattctatatgcatctctgtcttcaaagcaagcacttccccttccattacacagagaggaaaatagaggctaatgaagggaagtgaatcatctgagttcattcactaaaaatgatgagattcaggattcacagattttgaggaacttcatgacacattt

SEQ ID NO: 17911 - DNA, 27954 bp, Homo sapiens
gtgggctgtccacgcctttaccattttcctggttgttaacatgttcctgatcagcactgggtgctgtcccaggtgctgagaggattctcccacaatgccctttgctttccccatcagagggtttatggcacccaattctcattcacattctgtctctcctttctcgttcttctctatctctcctctctctgtctccttttctcttcctctctccctctctgtcttctctccctctctcttcctctctctcttcctctgtcctcttttctctctctctctccctctcacatctctctttcccttcctttctctttcctctctcttcctctctctccctctccctccttctgtcttcctctatccctctcttcctcttttttcttcctctcttcttgtctctttctctcctctctctctccctctttctctttctctctctcttcctctcccttcctcttcctctctctcctcctttcttcctctctctcttcttgtgtgtgtctctctctctctgttctctctctccctctccccccaactctctctccctatacacatcttaagaggcctcagcagtgtaaggtaagtttagcgaccctgttgctgtgtagagataagcaaaggggggcaaggagctccagtggtcccagactccagccatttgagtctttgcagcccaagcactgccccagcttcttgacagccccagccatcaccaaagggcacacagataagctgcctccaccaaggcctgtgcagatggtaggtttttgagtaaaatagatacgatccttgtctgaagccactgagttttagaataatttgttatatggccatagtaaccggaatgattgctgtaggtttattttattttattcatccttgctgcatgcaacacatgcatggctcagtaactagaaggaaagaagagaagaagggagggagaggcagagggtggacaggagaggatggtaggaaggaaagacaggaaaggagggtgttggtggccttgcctgcaagctgagcagacaccacgcaaacaggtgacctcccagttaagatggaggggactcagggctcaggaggggcagaaggtccccgtgtcggaaagctgggcaagctttctgcaggaaatgatggggatcacggccatgtgagccggcaagatttccctcagccagggaggagactccgggctgtgggaacagcttaagcagaaggcatgggacaggaatgcatatgagagatattgtgggaggagggagggctgcctgggctggcatgcagggtatgggaggggtggaagggctgaggcgggagccatcagtaaaaggacccagagcgcggctccaatgccatggtaggaagcttggcgttgactcagagggcgctgggtaccgctgaagagtgttgagccaaggagggtcatgtcacgggcagatacatgttttagaatttcttcttttctggctgagatgtagagtatggactggagagaagcacaggggacataggaaaggtagttctagaaagaggggctgtcccaccagggaaagtcaaccaactgttccccagtatccattcctcccttccagctcatggcactaaagccactgattgattagctgggtgctatcaatctctctctcatctctctctccctctttctctccccctcatctgtgtcttttctctctctcatctctctgtctccctctttctgtccccctcctccgtgtctcctctctctctcttctctgtctcatatctctctcattgctctctccctctttctctccccctcctgtgtctccttctctctctctctttctcccccatctctctttctctcccccttcctctctttctcctctcactcttcctgtttctctctttctctttcttcctctctttctccctgtctctctcttcctcttttcctttgtctctctctctccccccaactctctctccctacacacatcttgagagacctcagcagtgtaagataagtttagctactccacggcctggcacggtagctcacgcctttaatcccagcactttgagaggccaaggcaggcagatcactggagattaggggtttgaaaccagcctggccaacatggtgaaaccctgtctctactacaagtaccaaaaaattagctgggcatggtggcacgcgcctgtagtcccagctactcggaaggctgaggcaggagaatcgcttgagcctgggaggcggaagttgcagtgagccgagaccacacctctgcactccagcctgggtgacagagtgagattctgtctcaaaaaaagaaagaggaggccgggcactgtggctcaggcctgtaatcccagcactttgggaggccgaggcatgcagatcacgaggtcaggagatcgagaccatcctggctaacacagtgaaaccccgtctctattaaaaatacaaaaaaattagccaggcacggtggcgggtgcctgtagtcccagctactcgggaggctgaggcaggagaatggcgtgaacccgggaggcggagcttgcagtgagccgagatcgcgccactgcactccagcctgggcgacagagcaagactctgtcaagaaagaaagaaaagaaaagaaaaaaagaaaagaataaagggagggagggaagggaaaggaagggaaggaaggaaggaaggaaggaaggaaggaaggaaggaaggaaggaaggggaggggaggggaggggaggggaggggaagggaagggaaggaaaggaaggaaggaaggagaagggaagggagggaagggaggggagggggaaggggagggggaggtgaggggaggagaggtggaggtgaggggaggggaggggagggcagggggacgggaggggagggcagggggaggggaggggaggggaggggaggggaggggaagggagggaagaaaggcaggccctgatgttcagggagctgagagtgaagtcaccggctccaacccaggatccaaactcaagtctgtctggggtcctatccccgtcaccaccccccgccccgacccatcccccagagacctgggaaggagccaggctcctccggtttcaggaaagggctgcacaaaccaccccgccacgatccctcccagagaacaaacagctcccggccaccggcagtctccctcctcctcctgccaggctggttcccagacccaccctccctgtgtcataagcgcctctccccgcactctcaccagggctggctgttctcagaggaacgcccaggaaaaacctacccgaacccctttcagctgggaaggggacccgcctgggcttcctcaccgccgatgagacctccctcgtcgtacacttagagctgcctgtgttttccttccttccttaagcgggctgggaactctagacactcagggatgggccagcccattagagtaagcattcggccacctctaggctgctacggtcactgctgctgtcaccatcaacgtgactgtctcacacctcacttcctccggccagccacacccctgcagatttaacccgccagcctccctaaggtttcctctgcctgaaatcctctctgcattcctggctcattctcgaaattgaggtcaaagctcagatgccgcctccttccctgaccaccctacctgaagcagccgcacctgcctgctcctagtcacgccgttccttcacctgtttcgtttcctccacagggtttaccacaatctgaaagtcttattcatgcaggtgtctacttgtttatctccccaccacacctactaggatgacaatatcacaagggctggggtttcatctgtctcctcctcctctgtatctccagcacatgaaacatgcttggcacactgtaggtgcttaagtatttgctactacatcactttgggattttgcataggacactcccaatgcttagaatgtcaatctttgcttcattgtccttggcaaactcctattcatcctttgaaaccccatccatttatcccttaaccaggaaaggcttctgtgcctcatacaaccacccataaagctggattagggctttctctggggacacccttgccctgtgccacacttccattagcgcacatatcccccatgaattgtgcacaccagcagggtctagagtacggcacacattttgtctcaggagctacgtattgaataaataaattaattactttttttgagacaaggtcttgctctgtcacccaggctggagtgcagtggtgcaatcgtggctcactgtaccttgacctcccaggttcaagcaatcctcccacctcagcctcccaagcagctaggaccacagatgcaggccactatgcctggctaatttttaattttttttttggtagggatggaatctccctatgttgcccaggctggtttcaaactcctaggctcaagggatcctcctgcctctgcttcccaaagtactgggactataggtgtgagacgccacactcagcctcattatttaatatgtaagtagctatatctctctgagacccagccccatctaatttataacctccctccttctcaagaacatgcctcagctcccattgccagggaatctgacctttctccttgtcataggattttttttttttttgagtcagaatctcagtcagtcacccagcctggagtgcatggcgcaatggctcgctgcaacctctgcctcccgggttcaagtgattctcctgcctcagtctccctagtagctgggactacaagcgcacgccaccacacccagctacttttgtagagatggggtttcaccatgttggctaagctggtctcgaactcctgatctcaagtgatggcctcccaaaatgctgggtaacaggtgtgaggcaccacatccggctgtcataggaatttgtcagcaaatcctacagactagaggatgtgtgttgggtggtgtgggggtggggataacggaggagatggggggtgagctcttcaagccccaggggagaattctgttccgttcctgggacatcccaggtgagagggaagaaaggccagccccccaagacagctatcccagactgggacagaggcaaaccctgaccacagagccctgtcactcacccaagaacaggtgccaatgacagaatagccaggccgaggggggagagaggtgcttcggtgatggatttccctggtgacttgccaagacagggctttactgcctccgccctggactggctgagtcagactgtgcaggggtggacactttgactggtatttgggaggcatttgctgtgggttacagagagggaggggcctcctttgcggccagagaaggaggaaagaggccctgggccctgggacttgggacttgggtggaggctcgggtttcggtctcacctgctgctccagaccatggcctggagggccgcctgcgccacccccaaagcaatgagatagcccctcctccctcagacccaggagtccaggcccccagcccctcctccctcagacccaagagtccagaccccagcccctcctccctcagacccaaaggcctcggacccataccaaatgcttctatgagatagttttctccccttgttcatgaagaaatgagcccaggcccagtcagatctgcatctgtgtcacagcccagggccactgtaaccttaggctactgacttccctctctgagcctctgttttctcctgtcaatggggcaaggggtctgctccttccctcaaaccccaactcaggtacagtcaagcacagaaaatacttgtggcatgaatgtgatgagaacacagaattgcagaagccaaagaaagagaagcgtaagggccctccttccacccctacctcccccacccgctgctacacgcaccaggaccacctgctgggtagccaggagctcacagtctagccccgctggccacccctgcagcccccatccttcactcaggcagttgcagggcccagaacacccctatcttctaggattgacactggctgtcaaactcatccttcaaggtgattcctrgcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccaggtactgtattgacaactctctataacctgactttatcctcccaataagctgggtgtggtgggtggctcatgcctgtcatcccagcacttcgggaggataaggcaggagtatcacatgagcccaggagttggagaccagcctgggcaacataaggagactctactatatatatgtgtatatatatttatatatagtctgagatgggaggatcaccccagtaggtcgagactgcagtgagctgtgattatgacactgcattctagcctgggccacagaactagaccttgtctcaattaagaaaaaaaatggggataataggacccattccataggatgtggtgaggattatgcatmcacacacacacacacacacacacacatttatgatgtactgagaagatataagcacacaataagtatctccaaaattatcaagtggcaaagccaggattcagacccacacctgcccgaggctctctgccatcagaccacactatatctctttctctctgttccttcatccccatcaatcgaaggcaaaaatgtgccttctctgatttccagsctcactcagcatagaccgtggaggcaacatatcttgaatgaagcaacaaagcagtaatgcacatgaatgcaccaaatgccaaaagctcgtttactcaacaagtatctctccaacactttctatgtgctagacccaattctgtgtgctgcagattaagtggaggactgatcacacaaaaatctttgcccttgtgaagcttgcattttttttttttttttttttgagatggagtcttgctctgtcacccaggctggagtgcagtggagcaatcttggctcactgcaatctccacctcccgggttcacgccattctcctgcctcagcctccggagtaggtgggactacaggcacccaccaccaagcctggttaattgttttgtatttttagtagagacggggtttcaccatgttagccaggatggtctcaatctcctgacctcgtgatccacacgcctcggcctcccaaagtgctgggattacaggcgtgagccaccacacccggccgctttttttttttttaagatggagtctcgctctgtcacccaggctggagtgcagtggcacgatcatctcggttcactgcaacctccacctcccaggttcaagtgactctcttgccttggtctcccaagaagctgggattacaggtgtgcaccaccaactctggctaatttttttttttttagtagaaatggggttttatcatgttggtgacatggtgtgatctcggctgactgcaacctccacctccggggttcaagcaattttcttgtctcagcctcccaagaagctgggattacaggtgtacaccaccacccccggctaattttcatattttcagtagagacgtgctttcaccatgttggccaggttggtctcgaactcccaacctcaagtgatcaatccgcctcagcctcccaaagtgctgggattacaggcatgtgccaccgtgcccagcctgtgaagcttgcattctaacggaggagacacagacaaaatgaaccaggaacacagtgggtaagaaggtgaaaagttctccacacaaaaatgaagtagggagagaggaaagagactacaaagaagttgggttgccgggggcggtggctcacacccataatcccagcactttgggaggccgaggcgggcagatcacgaggtcaagagatcgagaccatcctggccaacatggtgaaatgctgtctctactaaaagtacaaaattagccgggcgtggtggcgcgcgcctgtagtcccagctactcaggaggctgaggcaggagaatcacttgaacctgggggggcggaggttgcggtgagccaagattgcgccactgcactccagcctgggcaacaagagtgaaactctgtctcaaaaaaaacaaaagaagtcgagtaagggatgccgccatttgaaacagggtggtcagccagtcctctgagaaggtgacattcaggcaaagaccaaaggaggcaagaaagtgaggcatgagggtatctggtagaagagcattccaggcagaggaaacagcaagtgcaaaggccctgaggcaggaccgggtctggatgttccaagagcagcaaggaggccagtgtgctgacacacagaaggaagagatgagatcagaatcacgtcccttaaggccttgcaagatgtcagctttttttttttcttcttttttgagacagagtctcgctctgtcgcccaggctggagtgcaatggcgcaatctcggctcactgcaagctccgccttccaggttcacgccattctcctgcctcagcctcccgagtagctgggactacaggtgcccaccaccacgcccggctaattktttgtatttttagtagagacggggtttcaccgtgttagccaggatggtctcgatctcctgacctcgtgwtccacccgcctcggcctcccaaagtgctgggattacaggtgtgagccactgcgcccggcctgttttctgttttttgagrtggagcctcgctctcttgcctaggctggagtgcagtggtgcaattatcggctcgccgcaacctctgcctcccgggttcaagtgattttcctgcctcagcctcctgagtagctgggattacaggcacccgccaccacacctgkataatttttgtgtttttagtacagatggggtttcaccatgttggctgggctggtctcgaactcctgtcctcaggtgatctgcctgcctcggcctcccaaagtgctgggattagagatgtgagccactgtacccatgcaagtttcttaacccttctcttcctcattttctcatctgtgagacgaagacagcctcccacccagacacactcccctcacggggctctggggagaaatgatgtggaaagctttgctagtaacctctacagcatggagggagttctggaaaagtgatttcagaaaggtgtttatgcctggaaagcctgttcatttttgtgatgtccttggagctgggccaggcattatcgagctaaatcttagcttttgtcagaataggggggtcattgagggaaatttccaaaggaaggtggaacgggatgggtggggaggtaagggcatgagcagaggcagtgatcgtgggcaggaggtgtccatagaagacgggctgccactggccctggagacagaaggtcagccccgggttcaaatccctccttaaccaagtgctgaaatggacaagttgctcaacctctctggccttcagcttcctcatctgtcaagcaggaatcaaacctcgaacttcctcccgctgttagaatttcaagggagttttaaagacagagctttcaactctgacctgtgaacaagtgtgacatcaaatgtactgttcgttgctattattctgttgctacaaggcagacagttagtttcccagctcccctgcagtccccccagcccctcctagatctgtctgccagccccgccccggggtcactccagccaggctgtgccaggtgaatgctcaggtatgcggaggcggaggcaggacggccctgggagggagcaggaggaggggccggcagcctggaagggaaaggacagcggagagcagggcagagcctgagcaggcaggtaaggagatccgggtcaggagagaagggggctggggcttgaccaatgggtctgagggacggggggactggggtctggactccagggtctcatggaggaggggctgggggtctgaactcctgggtctgagggaggaggggctgggggtctgaactcctgggtctgagggaggaggggctgagggcctggattcctgggtctgagggagggactgggggcctggtctcctgagtctaagggaagaaggattgggggcctggactcctgggtctgagggaggaggagctggggcctggactcctgggtctgagggaggagtggactggggtctggactcctgggtctgagggaggaggggactggggtctggactcctgggtctagggaagagggactggggcctggacttctgggtctgagggaggaggggctgggggcctggactcctgggcctgagggaggaggggctggggcctggatgcctgcattgagggaggaggctggggtaggaattagaggctcctactggccaggccttcacatgtttgctggctcccagggcacctccaggtgggcaggagctaccactcagcaccatgagcaccgccacagggtaagcgcccccggaccccaggtcccagccccagcacgcctcccgcctcccctcgcctcctcacccacacccgcttgcggcagcccagactgtttgcggcggcccagactctggcccaagccccgacactcaggaggaagccagagcctctctcctccctgcccagcctggggttasgggcccccactgcagagcagacaggcctgagctccagttcggccctcacactcagtgctgatgtaaccctggtcagaggacatcacctcctggagcctcagcccctcctctgtgacacagggacaatgttgaaaaattggagggatagtgcattacaggacttagctgaccacctcactgacagcaggtgctcaactcataggagtcgctattgcgattgttatgttgttagtaaatattaaccctttgctagaaaatcagggctgtttataatgaagactcaagtcccccagagtaagcagggagaaaaacaatgagagatgagtcaaaatacctgcatggtaggtagtgagctctctggcccagaggtaatcaaattgtggtgacatcagactggcaggagcrggatgaggaacaggagtttgggaaaaagggtttttcagttcccctgacgccacctgatcgctgagcttctgttatgtgcrtgcaagtggggattcaagaattcttaggaaaggtaatcttaggaagaaattgaggacgggaggagacagagaaggatgtggttgggaagcacctggcccatgggagtgggaggggaagcagataattccctgtctacttcagataccactaatgctattrtaaccattcccatttattgagcaacttctgtgtgctaagccctggcagcatcttaagaatgataataacagttaytgaggcttcaaaatacttcacctgcatcatctgactgaatttgcccaacagccctaccagatggttactacgttacagaaagaaaaactgaggcaggagagattaaatcctcttctgaaggtcttatggcaaggaggcagtagacagagggtttgaatcccggactatgccatggtagagatcacactcccctaccacccagcaccaccgcctgacctgacctgtcttttttttttttttttttttttttgagatggrgtctcactctgctgccaggctggagtgcagtggcacgatctggactcactgcaacctccgcctcccaggttcaagtgattctcctgcctcagcctcccacgtagctggsactacaggcgcccrccaccacacccagctaatttttgtatttttagtagagacagggtttcaccatgttggccaagatggtctcaatctcttgactttgtgatccgcccacctctgcctcccaaagtgctgggattacaggcgtgagccaccgcgcccagcctacctgtcttcttaaagtccagctctggctctgagctctcctgctctaataataataataataataataataataataataataacccttccatcgctccccattaccttcgtcatgaagcccttgctgccctgcttggcatttccacaggatctgcccccagtcccacagtctctctcwttcctcttttcttcaccagcccagaagctgccccaaagccaagcgccaagtctatctatggtgagcggggggcaagggagccccaggcccatagaactgggtctaaagaaacaggacctggcatccagggtcttggaggaggaggggctgggggtctggactcctgagtcagagggaagaggtgctgggggtctggactcctgggtcagagggaagaggggctggggggctggactcctaggtttgagggargaggggctgggggyctggactcctgagtcagagggaagaggtgctgggggsctggactcctgggtcagagggaagaggggctggggggctggactcctgggtcagagggaagaggggctggggggctggactcctgggtcagagggaagaggggctggggggctggactcctgggtcagagggaagaggggctggggggctggactcctgggtcagagggaagaggggctggggggctggactcctgggtcagagggaagaggggctgggggtctggactcctgagtcagagggaagaggggctggggggctggactcctgggtcagagggaagaggggctgggggcctggactcctgggtcagagggaagaggggctgggggcctggactcctgggtcagagggaagaggggctgggggyctggactcctgggtcagagggargaggggctgggggsctggactcctgggtcagagggaagaggggctgggggcctggactcctgggtttgagggaggaggggctgggggcctggactcctgggtcagagggaagaggggctggggggctggactcctaggtttgagggaggaggggctgggggcctggactcctgggtctgatggaggaggggctgggcctggactcccaggctcattctctttctcccctggcagagcagaggaagcgttactccacagttgttatggctgatgtatcccagtacccagtcaatgtgagtctggggtctgtgttcccccaggacatcttctggggcaaaggtggcctcaggagatagggcttttgaaagcagctaggcccccaagcaggaagcatgtggaaagtcagtttgcccatccataaaatggacctccgttgcctcacctcagtcatggatatgaagycaggrgcctcgggtccacttaatctgccagcctttcctccaggccagctgttgtgctggacagtgggaccacggagrcaaatcaagacacagccctgcatgaggaaggggtagacaaggtccagaggaatccacagaggcgcctggtgctctaatggaggtggcagggggcatggcrggagacccgaggaggcatttagaaggagagagctatratccagactccttccctgcccgcaaggagcctccagtctgtgagaagccagactcaggtgctagtcactctgatgaaagggaaacaaagggcactgggaggaggagctgatttgtggaacaggtgatcaaggaaggcttcctggaggaggtgtggttagtctcaggctgaaagtctgattattctgggggattctgagcccacctggcatcatcttgggcctcactgctttctccatggtccgtaccagcacctggtgacgttctgcctgggtgaggacgatggcgtgcataccgtggaggatgcctccaggaagttggccgtcatggatagccagggccgagtctgggcacaggagatgctgctgcgagtgtctcccgaccatgtcacgctgctcgacccggcctccaaggtgccggggggcacgtgggtgggaggagtgtctggggcagggacttcagggggtctgggtgtgaatcttggctcctgcacgtccttcctctgggaactctggcgagggaccccagcccccttcttgagccttaatagcctcatctattaaacagggctgttatccctaaccccctaaccgcctgaggttgccctgacctgctggcccacactcccgtcgccatttagtagtaccatcatttcggggcctcagtttaccccgccatcccacccggcaggaggagctggagtcgtacccactgggcgccatcgtgcgctgtgacgcggtgatgccacccggcaggagccgctcgttgctgctgctcgtgtgccaggaacccgagcgcgcgcagcccgacgtgcacttcttccagggcctgcgcctcggggtgagcagatgggctggctctgggggtggagctggaactgggcggagcctggagccggggcggaaatgggtggggcctctaggtggggcggggcctggggctaaggcgggatcagagcaaggaagggcaggggacctgggaaggaagttctggaaggcagtggggtttgagattggacccagggtcaagatagaacatgaaggtgggatgaggacatgaacagaacatggccaagaaggatctgggggagcagccaggacgaggtgggggcgaggaaccacccggactgggtctccatgggcggggtcgtggcttagggcagggacaggtgtagggcgaggggtgagttcggggcgtggacgtgcgtgggttcacaggtgtgaacggtagccgcacgtgggctgggactgagctgaaaaatcgrccaggggcgaggcccgggtaggaagtgggtgcggcgtggggaggcgtggcctgacggtgtgattggcaggcggagctgatccgagaggacatccagggggctctgcacaattaccgctcgggccgcggggagcgcagggcggcggcgctcaggtgagagggaagaagttggcagggtctctgggaagccggtttcccctccttgtgcctcagtctacaacaccagcctggaacagaacaagagttttgcatggagtcaagcacaccctagtcgagtcttgtctgtacctcccagacgagctgaccccttctccagaactctgcttcttttctctgttccctgtccaggccctcagtttcactctagagaggtgctatccctccgtatatcggatttctccctacctcgttgaacttgttcactccctttgagccttttgagcctgtgtgtctcgttctgcgccctggatttccccctccctggacccctcagtggacccagtcttggtgtccccgtcgccctccgcagggccacgcaggaggagttgcagcgcgaccgctcgcccgccgctgagaccccgcccctgcagcgccgcccgtcagtccgcgcagtgatcagcaccgtagagcggggcgcggrccgcggacgaccccaggcgaagcccattcccgaggcagaggaggcgcagaggcctgagccggtggggacctcgagcaacgctgactcggcctccccggacctgggtccccggggtcctgacctggcggttctgcaggcggagcgggaagtggtgagccgctaaggaaggggtctgggggcagggccaggcgactggaggcggggctagggcgtggaagggcggggccggctgcgggacgggcgttctctggtcagacttctgcgttatggaagaggggctgggtcgggggcggggcttggttgtggggcgtggccaggtgtttggggcgtggcctgatctggggaagtgtataggtgctcaggttcagggcttcgacggggatggttttggaactcgggagccctgagcgtccccctcctctgtcccctaggacatcctgaaccacgtgttcgacgacgtagagagctttgtatcgaggctgcagaagtcggcggaggcggccagggtgctggagcacssggaacgcggccgcaggagccggcgccgggcggctgggggtaaggggcaccctggcgtgggatctgaaccccctcccgatctcttccaaatgtccccgctctccccaggctctcccctcccgccacttgccagggctgacctcaccgccatcttaaccgggtgtccacctctctctgcctgcctggtgctggccccgcgtccccatcgccgcscccgtctgctcccctcagagggcttgctgacgctgcgggccaagccgccctcggaggccgagtacaccgacgtgctgcagaagatcaagtacgccttcagcctgctggtgaggacgcgcccgcccctgggccggggcgcgggcacgacgaacctgtcccgtccccgcacccacgccaaccacctccctccccacgccccaggcccggctgcgcggcaacatcgccgacccctcctctcyggagctgttgcacttccttttcgggcctctgcagatggtgagacccgccccaggccctcgggcccccctgcagcgggaggaatcgggttcgacttgtagaaggtgtggcggcacagcctgcccctcctgctcccctgacagattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggtgaggggcggggctgggaggcagggggcatggtgattggaggagcataaggcgctgggaggtgggtggcatgatgattggaaaataggactaggagagtagggagggrttagaggcgtggcttagttgtgttggggcggggcttaggacagatgccaagattcaattggaggaaaggccaggaattaacgtgaaggaaagatttaagaccaccagaccaatcggattgaaagaaaaggggggcttaaaggaatagaggggctaggggctacggggcaggggcggggctacgcgaaggggcggggcttctggaaggtttggtctataactttggtgatgggacagagtctgtgcactgcgggctggcagttccgcagggaaagggtcagaacctgaaaccgaccttacggaaaacctgatttggaatcaggtgagatttagaggctggataaggcaatttttttccagagagagagatggatggggtctcaatattttgcccaggctggtctggaactcctggcctcaagcgatcctcccatcttggcctcccaaaatgctgggattacaggcgtgagccaccgtgcccggtctagaaatataaattgctgttgagttgggcttagagctaccggcaggacttggtgaaaagtggcggggctagaatcgttggaatacagcgagctttaggggaaaacttagtgaagttaatgcaggaacgaagttgggggctgtatcaggatccctgagctcttggccctgtccctggccgcaggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccsggggcgcggccggtccgcctggccccgcctgacccgactgtcttacttcctacagcaaagcgcccccsaggtcgctgtcaatgggtgagtgtccgccccagggcagggcaagggggtcaaggaggggtgcgtcccgggggctcccgatgctgactccgccccctttttttctgtgtttttccttctgtcttcctggctcttctcaggtgggtgagatggtgatggggcgggccggggctgggagagagggaggagcagggtgggagggggcgggacccagacttctggggctaagggagttgggaatggagacccggattcctgggcctaagggaggaagggggctgggagtgggtaaagtctgagaggttggatycctggatccccaaaaggctggaagaagccagtttgttttcccagggcctgggaagcaccatgcctgggctccctaggaggacagagccctggatattggaggggagaggctggggaattggacctttgggttttgaagaagagcccaagtctggtgcttgggatcctggagacccagaggagcaggcttgggacttcaagggcttgggggcaagtttctgggaaagttaggaagtggtagtatctctgggcccccgagaggggtaaaggctggacgattaaactcttggttttccagaggctctaatgcaattgtctaagtcgctgctgggtgtcggactgggttaaaaggtttgagggttaaaaggataagattgaagcttgagacctggactcctaggtccctgggggaggaaagaacattccaagtcatggttctaccaagcagtgggggctcagactctgggtcctgggggagggaaggaggtagatggactagaactctagggtccttgagcaaatagagggcagactggagggaagcaacgtgggaggagacgaaaacaaagcagtgaggctggaggagacaaaggggggtctgggtgagggcccgagcagagggtctcagcagggacagcgtgctgggagctgccggccccacacagggggtgccgcggccctgaagaccccccctctcccctgcacaggtaggcctgatccaggctgaggtccctcttattgggggtcagagctgaaatcccacccctgcccccagctgcctgatatcgcaaccctggtccctgttcacagcttcaagtcactttctccgagcctcaagttcttttttgcagggaaactgggaataatgattatccgttcccggaacagtgagaagtctgtggtgttgtaggaactagcagttaagggcttaaggctgtgaccaggttcaagttcaagtccagctgcctgcaaactaaggcagcattattcagacctgggctaccctggtcccgggctggcgatgccactctcttactctgtgacctttacatccctgtgcctcagcttcctcctctgtgaaaatggaggagatcatagggtctctgggggaggaagaaactgggggagagaggggagtccaaattcatggttctaccaaccgttgtcataaagatcaaattaactaatatacgtaacagaacagtgcccagcacacagtaagtggtacagaagtggtagctattgttttttgagacagtctcactctgtcatcaggctggagtgcagtggtgagatctcagctcactgcaacttctgcctgccaggttcaagcaattctcctgcctcagcctccagaatagctgggactacaggcgcgtgccaccacgcccagctaatttgggtattttttagtagagacagggtttcaccatgttggccaggatggtcttgatctcttgacctcatgatctgcccgcctcagcctcccaaagcgctgggattacaggcgtgagccaccgcgcccggcctagctagtgtttttattatgcttatgagttatgatatataaagcccagtgcctattagatgctcaataaatgacagctgtttctagctgtgtgatgtgggcaagtcattttctcgctctgagcctcattctcctctgtaaaatggaatcgatggtgggatagtacccactacatatgcctacagcacaatgccaagcaacggagggagcaaatatattcagtctgttattcttgtttcaaatttctattaacagtattaacccggcccctgctgtgcccccagcttggctctaaccccagctcacaccagcaccctgcagcccagagcaatggggctggctgcctccttatctccaaccctcccgcttctcctcagtcaccgagacttggagccagaatctgagcctcagctggagtcagagacagcaggaaaatgggtcctgtgtaattatgacttccaggcccgcaacagcagtgagctgtcggtcaagcagcgggacgtactggaggttagaggagcgggaggctgaggggcasgaattagccagccctagctgcagacaggctctgaaccctctgttctttaccacacccaggtcctggatgacagtcgtaagtggtggaaggttcgggacccagcggggcaggagggatatgtgccctacaacatcctgacaccctaccccggaccccggctgcaccacagccaaagccctgcccgcagcctggtgagccagcgcagacgctgggatcttgagggtggagaggctgggaccagatcctgggaacaaggggcgtggggatcagctgtcaagagtgctggagcaggtggtgactgggggttcaraaatgcatctccagaaaggggagaggctgggactctgagtcctctccctaacccaggtactctcctctccttcctttcagaacagcactcctcctccaccaccagccccagccccggccccacctccagctctggctcggccccgctgggacaggccccgctgggacagctgcgatagcctcaacggcttggaccccagcgagaagggtgagtggtggggacgccggctgcggggagcggtccttatccttgctttccaggcagagaaacgggggctcagaaagagcaaagggactcccgtcccattctggggacgctggagcgcccccccgccccgccctctggccccaggacccctcgccctgagcccgcactccctacctcccggtttcccgcctgcagagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggtgagtggggccrgggccctctcggcgcgggttgatacggacgctgggagcggagcgttccgatcggccgggagtcggggggcggcagtcgtggagaccacagggagccgggattagcccgaagtgagggtctgtctggtagcaacacccaatggcaggctgtgattgccatgttttttcagactccgactggattccttagggaaatcccgtaccctttgaaagcaggatgcggccacgccccccgggtggcaacattgtgattggtgggtggggttcaggaggtgtcgggcctgcccccgctagagctagaatgctgttctgattggaccatcgccgggtgggcgtgacatgattgtccgggctggggcatccgccgaccggcctgaccgcgcccgggctgccctcgctcaggaccgtggacgcgctgggtgtgctgaccggggcgcagcttttctcgctgcagarggaggagctgcgggcggtgagccccgaggagggggcacgtgtgtacagccaggtcaccgtgcagcgctcgctgctggaggtgagccggaccgctggtccctgggtctgggtagggttgggatgacgagggctcggacgccaggacaaagcgatttccaccccgccctccaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagcagatggtgtgccaactgctgtcctctacccggctaccagggggctcagaaacctgcccctcgacccagtcacagcctcatggaacctggaaaatgttccaccctctttggtttctctctgaaccctcctttccatccccagggtcccaaaccaggctccctcctgacctcctagccagcctagtccagcttgccccaccttcacgtttccctggctcgcggctgctgggcatgaggctttgtgtctcccttcccgcctcaccaacgttctcacttcattccttcctgcgtcctggccctgcccctctccaaacgctcccaagcgttcaacctctgaggtttgcacctgctgtctctgctggctgaaacggccattccctgcctggcgaactcctgttcagcctccctggcccagctcaaacactcactgtggggaagcctgccctcatccccgaagctagtttcccagcatccacttctccattttgtcccccacctcctgccacggccctaccaggtagaactggctgcctcccaagcatgccacagctttctggccactctttgttctgggagatggcagccaactgaaaacttcctaatccctcaagaactagctccttctccctctggcaagccctgtaactttcttttccccattatccaggtggctggtaaggtctgcttttctctggatcccactgttttccagactggatattctctgcctttgggaagaatggccctttctctttctcccctggctctgccttccccagattactgagggcctctgggcctctgggcctcaagcctctcccggagttgttccaacctgggccaccagatggcgccctccaagatgggaaaggatcagagagacgcccccccacccccaccccgccccccgcccttggggcaggcaggagttctcagtccccactttgccacctcctgcctggttccttctggttccttccttcctctttggatctccaagagtccttctcctatctgccccgtccctagatcctattcacatacttcccttggctccctatggctcaccggataaaaccaggccccagcttggcagtcacaggttgcccactcggctcaccagcttctccgaccacggggctcagcttccctcctcctgctgccaagcttggttcatgtggttgcttctgcccagaatactctcagcccctctaccacttgcccggggccccacccctcattcttagtaggggaataggaaaggtaggcaattcccccaaacctctttgctccattcccgcacccccccccgccccccaataagcccccgtggctctcgccacctaggctgcaaactgaaatgcctgcaggaacccgacaagagacccaagtgagccagccgggcctcagccctacccccgtcacaggccagcttgtttgaacattctggcagctgtatcttccaatattctcagaacctgaccatctctcaccatcttcactcccatcaccccagccagagccaccctctctcttgcttggatttcaccagtagacccttagctggtccccccaatcctcaccaccaacccccagcctgttctccatgccagagggacctgttaaaacctaagtcaggccatggccatgctccaaaagacacccagagctccaatctcacagctcaagcccttcccagggccaagtctccacacagccaccgtgacctctctagcttcattccctgctttctccagctcctcagcttcctgcagcacaccaggtgccctaccccagggcctccacacacacagctcccatcatccctcaaatacctacacagctccctccccagggtctccacacacagagctcccatcatccagagcacccttccctcaaatacctacacagctccctctccaccaccttcaaccatctgcctgcaccagcttttccgtgaggcctgcctagaccactctattcaaaacacatgtgcacacacgtgcacccaccttcccaacccctttcttttctccagagcgccgccaccttgaaatacatttattttaacatcggatgcccccctcctaaaagtattggatctttgttttgttcagtaatgatcagtcacactgtactcactcagtcctgttcttcctgttggtgttatactaattgttgaatgaatgcctcatctcagaagatggctcctactcagctctagtcaacggtggctatgcaggactgaaaagttcatattgtcacagattcctgttctttcaaaagaaggcaaaattctttttgtttttttttttgtttgtttttgagatggagtctcgctctgctgcccaggctggagtgcagtgactcgatcttggctcactgcaacctctgcctcccaggttcaagcgattctcctgcctcagcctcccaagtagagtagatgcgattacaggcacctaccaccacgcctgctaatttttgcatttttagtagagaaggggtttcaccatgttggccaggctggtctcgaactcctgacctcaaatgatctgcccgcctcggcctcccaaagtgctgggattacaggcgtgagccaccacacccggccaaaattccagatttttacacacaaatttctccaaatgttaaatgttggcaattgactaaatttgtttcaaagacactgatggcaaaacccaaactccccagctccacatccttggccccagaggtcttgcccgctgatccctcctgccccatcagcttcccctcagccccccgcctgcgatcacgcgggctccgtcttggagccttcgctcccgctgggggctcatcctgaagctccttcaccacacaggtgagtaagcaccagcccatcccccggcacccacccaagtggcccagtggtttggtcatggacacgcacggccccccagcaggagcaggaaacagtgccctccctctggctgggaacacagagcttgagtggcaacttcacgacttttatttgtggtgcctgtgctttatctcgaaaataccttctccccctgccccagacagtgggcggggagggggcagcaaaaaatagaagacgtccctccctattgcacatggaccctatatacaggcccacctggctgaggctggcgggactcttggcacattcttggatccctgctcaggaggggaggggtgacggggtggcatcacacgtgagatggggacctccaggcggccactctggtcctggctactgatccttgcacttcttggtcctcagttccttcctggtcccgtctctggccctggtcccctctggcaacgtccccctgcttggctcggcctcccacctccatcctggcctcgggtggccccctcggctcctggggactctgctcccctcccagtccggaggtcccaggggggctatggcttctctgagacttcccccggagccctgtcactcgtgttcacacgggggaaggggtgcgtgtggcagaagcagctgtataaatacgggtgcgggaaagtccctccgggtcacttggagagtttgctgatgacgcggatcaacgctgcattctcatccttgaggcgctggttgtcagcgcggaggtcagacagggcctgggggacggcaagggtcagctgggcagccctggcgggttgcacccccacccaccctcggccctctgcccacagcccccacagcccccaccttcagctcctcctccagctctgcggccttgcgttccagggccctgcgctcctggaatgaacagggaaagtgcagaaactgagtgaggctgaggagggcaggggaaggccaggggccagctgggaagggcaatgtggctcccttggtccaaacttagggatgtgaggctggggacgcctctggcccccatccccactgcccctactcacgaatctctccagttccaggagggctggcctctcagcgaagcgttcttgcctctggtgaggacacagaaagcacaggggtcagcagaagaagccagcactgctctgaagggtcctaggctcctgctgggcacccgcccgcccactaggcagcccacaagcccttcccccacgggccaggccccgccaccggcaggcccacagccccatcccctcgctcagactccgcctccgagatctcggccccgcccctcaagtgaagcccagccccgccggcacccccaggccaggctctacctcccagcagtctaagccccacccaggcggccctgccagttcccgtgaccctggcctcggcgcccttacctgcgtggcccgctccagctccaccttgagctgcgccagccgcagcgtggtctcggtcagggcctcgcgaagccgctcgttctccctgcgcagctctgcatacagctgggggtcaggtagaggagggtcaggtggaggatggggcgatgctgggggggcggggaagccaggaagctgggcacccagcaggcaaagccccgacggaggggtgggatcgcaccgtcctaaagcctccgtctggctcttccgattctggctcaggttctgggttgaggtcccgctgccaccgctgcctgcgggccgaggggccgccctccagggtgctggggcaggggaggagcgcgcgtcaggggccggcccggcccgcacgcagaccccacctctcccaccccgcccctacctggactcctggctgcggtcagccggctccgcctcctccccctgtgggcaggtagacgggggttcaatgggtatgggagggactttagcgggtatgggaagggctttgcccgccccccggcccaccctctgcaccagctcggccccacctgagcccctcacctccgcaggccccctccactcctttccgaccttgcggtgctccctggccgcctgcggtcccggaccctgcccgtcgggcgcctctgctgggggaggggcaggaatcagcccaggcacctccagagccccctctcggtgcctgggtccccgggtcaagcccccaggaaagcaagaagactatgggagaaactggatgattccctgggaatgacctccccgagagcagacctcacctctctgggcagggctgtcagagttctccactccagggacgcggggccttcgggaagggtcctgtcgggagggggaggcgagtcagggaagcaggacatcccgcaccaccccactcgccctcgctgacccctctcaccaggctctgcgccggcttctctgactctggggccttccctgcagccttctctgcctccttcaggtctgtaagagtcacaccctggcagggaaaggggacagtcaggggacgctggggtcagggcccagcccctcctccctcagacccaggagcccaggccccagcccctcctccctcagacccaggagtccaggccccagcccctcctccctcagacccaggagtccagacctccagcccttactcctccctcagacccaggagtccaggccccagccactcctccctcagacccaggaatccaggcccccagcccctcctccctcagacccaggagtccagaccccagcccaccccacacctgtgtggacctccgagactggcgcatgagacgggagcgagcttttctctgggattccgactcctcatcccgcacaggcatctggtaggacctgagggaagggtcccaacctcagacagggaacctggggaccctgtcccattccgtggctgacaccctccgcgggaagcaagttctgtgggaggggactccaactcccagcagacctgaggccagctctccctcaggagcccacccaaagccccgggactcctgcttcacatcgtctctccctgctgggggcgggggcggcagcttcctgccctggcctcttcacctccgtcggtcccgggagtccgctgggggcgccgtggaggctgtggggacgtttggcttcgctggggattcaggctccggaatcctggagggaggcgaggagt

SEQ ID NO: 17912 - DNA, 46732 bp, Homo sapiens
  misc_feature (1)...(46732): n = A,T,C or G, or insertion/deletion polymorphism (see Tables 1-2)
gctaatttttgtatttttaatagagacggggtttcaccatgttggccaggctggtctcaaactcctgaccttgtgatccacccgccttggcctcccaaagtgctgggattacaggcgtgagccaccgtgcccggcctccttgttttttttctaaaacaagtactgagtataaaacaatataaaacaatatgagacggtttctctcttccctcaccagcactttgggaggctgaggcaggtggatcacaaggtcagagtggatagcactttgggaggttgaggtgggaggatcccttgagcccaggagctcaagtccagcctgggcaacatagcaagacccccatttccaattttagtgtatgtgctgccaaagcaaatactctgagaccctgtttctacaaaaaataaaaaaattaaaattagtgcttggaaaaaaaaattagtgcttgaccaggaggcaagcacacctcctcatcctctcatggatgtctgtctgtagaaagtaaatggagacagcttcattttacccaactgctccgttttaggtccgctcctgagcttctgttgttcccagccatgcaaccctgggagccgactcccggctgcagagccttgtcagaagcaggcaatgtacacagagacccaaggcctggtgtagacaggctttcacagacctgggcattttgttgaattgtttttgaattgtggtttcttatcagttcatccgatactctgttctaaccacgtagttcctcttttggatctccaaacccctttgcaggttccatctacccgaaccaaactcacttattccaacagaagtctggtgtttcttgttttttttgtttgtttgtttctttcgttttgttttttgagatgttgtctccctctatcacccaggctggagtgcagtggcgagatctcagctcactgcaacctctgcttcccgggttcaagcaattctcctccctcagcctcctgggtagctgggattacaggtgcctgccgccacacccagctaacttttgtatttttagtagagacgggatttcaccatgttggccaggctagtctcgagctcctgacctcaagtgatccacccatctcagcctcccaaagtgctgggattacagccttaagccaccgcgctcaaccagaagtctgtttaaatccatccttctccccagccacccatgagttatgtgaccttggggttgctacttaacatttcagtctcaatttcctcaatagaacaaaagttagaagaataacaaaagatagttttatttttatttttatttttattttttgagatggagtcttgctctgtcacctaggctggagtgcagtggtgtgatggtggctcactgcaagctccgcctcccggattcacgccattctcctgcctcagcctcccaagtagctgggactacaggcacccgccaccgtgcccagctaatttttttaatttttagtagagacggggtttcaccgtgttagccaggatggtctcgatctcctgacctcgtgatccgcttgcctcggcctcccaaagtgctgggattacaggcgtgagccaccatgcccagcacaaaagataatttcttaatcccatgcatttgagtcttaaaaaaatattctatataattccaaggtcaaagaagaaataacaaagggcatttttaaaaatgctagaactgagtggtggtgaaattgctgttgaaatgtgtttgttgcactgatggaaatttataaatgtaaatatttatattaaaatataaaataatgggccaggcatagtggctcacacctgtaatctcagtactttgggaggccaaggcgggagggccatggagcccaggagttcaagaccggcccggtgtacaaagtgagacccagtctctagttaaaaaagagggggagtgggccaggcacagtgtctcacgcctgtaattccagcactttgggaggccaaagcaggtggatcacccgaggtcaggagtccaagaccagcccggccaaggtggtgaaaccccgtgtctactaaaaatacaaaattagcttggtatggtggcgggagcctataatcccagctagggcaggagaatcacttgaacccgggaggcagaggttgcagtgagccaagatcatgccactgcactccagcctgggcaacaacagagagacttcatctctaaataaataaataaataaataaaagaaaatacaaattttttaaaaaaggtactgtggctgggcgtggtggttcacacctgtaatcccagcactttgggaagccgaggcaggtggatctcagatcaggagttcaagaagagcctggccagcatggtgaaaacctatctgtactaaaaattagcctggcatggtggcaggtgcctgtaggaggctgaggcaagagaattgcttgagccccggaggcagaggttgcagtgagccgagaccacaccactgcactccagcctgggcaacagagcgagagtctgtctcaaaaaggaaacaaaaaaaaaagtacctccaaattatggtagggtgtccatattaagaaggtagaaaaaggtcgggggaagtggatgcctgtaatcccagaactttgggaggctgaggcgggtggatcacctgaggtcaggagttcaagaacagcctggccaaaagggtatggtgaaaccccatctctactagaactacaaaattagccgggcgtggtggtacatgcctgtaatcccagctacacaggagtctgaggcaggagaatcacaggaaaccggcaggcagaggttgcagtgagctgagatcgcgccattgcactccagcctgggcgacaagagcaaaactccatctcaaaaaaaaaaaaaagaaaaaatgaaaaagaatttattgaaatgtgcagtctgaaaactgctcctgcacattttcattcatccttcctattccctccatccctcaattttttttttttttttgagacagagtttcgctcttgttgcccaggctggagtgcaatggcacgatctcagctcactgcaacctctgcctcccaggttccagccattttcctgcctcagcctccagaatagctggaattacaggcatctgccactacgcctggctaattttttgtgtatttttagtagagatggggtttcaccatgttggtcaggctgatctcgaactcctgacctcaggtgatccacccgcctcggcctcccaaagtgctgggattacaggcgtgaatcaccacgcccggcccctcattttcttttttttctttctttcttttttgtttgtttgtttttgagacagagtctcgctctgtcgcccaggctggagtgcagtggcgcgatctcagctcactgcaagctccgcttcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgccttggcctcccaaagtgctgggattacaggcgtgaggcaccacactgggccccctcactttcttattctttctaggataggcaactgagcgcggcagtgaagagctgggcttccggaagctgacagctgtttgtgatcttcaagacctcagacaggttttctaaatatgccttgccttcattttctcaaggaaagtgaaaaatgggtaggatcatggcaatcactactgtgtagcaatgtttagaggacttaataagtaaacacagggtcaagcatggtggctcacgccggaaatcccagcactttgggaggccgtggtgggaagattgcttaagcccatggggttgagaccagcctgggcaacatagtgagacctccatctctataaaaaatacaaaaatctagtcaggcgtgatggcgtatgcctgtagccttcagtaagctatgattgtgccactgcacaccagcctaggcgacagagtgagaccctgtctcaaaaagaaaaaacgaaaagaaatatagatgtacatatacatatgttggttctaaaacatgaaaaaggctgggcgcggtggttcgtgcctgcaacccaagcactttgggaggccgaggcgggcggatcacgaggtcaagagtttgagaccagcctggccaacatagtgaaaccccatctctactaaaaatacaaaaaaaaggctaggcgcagtggctcatgcctgtaatcctagcactttgggaggccgaggtgagcagattacctgaggttgggagttcaagaccaccctgtccaacatggtgaaaccccatctctactaaaaataagaaaattagccgggtacagtggcacgcgcctgtaatcccagctattcaggaggctgaggcaggagaatcgcttgaactctggaggcggaggttgcagtgagccaagattgcgccactgcactccagcccgggcgacagtgccagactcagtctcagaaaaaaaaaaagcaaaacaaacaaagaaacatgaaaaaaagctataaaacccaacttttttctttttttttttgagacggagtctcactctgtcgcccagggtggagtgcagtggtgcggtctcggctcactgcaacctccgcctcctgggttcaagcaattctctgcttcagcctcccaagtagctgggattacaggcacccgccaccacgcccgactaattttttgtatttttagttgagacggggtttcatcatcttggccaggctggtcttgaagtcctgacctcgtgatccacccgccttggcctcccaaagtgctggaattacaggcgtgagccaccgcgcccggccaaaacccaactttttagtcttatttatatggtgtttttttttttttttttttttgagatggagccttgctctgtcgcccaggctggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccacctgcctcggcctcccaaagtgctgggattacaggcgtgagccactgtgcccggctatatgtttacaaaattaatactgccagccaggcacggtggctcacgcctgtaatcccagcactttaggaggctgaggctggcagatcacctgaggtcgggagtttgagaccagcctggccagcatggcaaaaccccgtctctattgaaaaaaatacaaaaattaaccaggcgttgtggcgcatgcttgtaatctcagctactcgggaggctgaggcaggggaatcacttgaagccggcaggcggaggctgcggggagccgagatcgtgccgttgcactccagcctggggaacagagcaagactccattaaaaataaaataataataatactgtgaatgtgaaactgatgaacttggtgcttttcatgcgtctcatagttgacgtgtcattgatatttcacttgaaatacggttggatttttattaataatatacctggggtgatgggagaaggtagccaatcacagctgaggcttctaagcggtgattctcagcctcggccgcaatcacagttatctgggactctcgaaagaactccagggtctgggcagtcccagtgtaaccaatcaagcagaatctctaggcgttcgtgctttgaaatgaggctccacataggtaagtttaacaggcagtcaagatggaggaccacaggtggagatccggaagctcaggtgaaggaccgccccccaacaccccccgcccccaaaagacctctcagtaattccggtggatacaggaagtgctcagcaacgattacgccccgagggccaatcacagggctgcggccgagaragaagccttawtagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcggtggcgcgatctcggctcactgcaagctccgcctcccgggttcaggccattctcctgcctcagcctcccgagtagctgagactacaggcacctgccactatgcccagctaatttttttgtatttttagtagagacggggtttcaccatgttggccaggctggtctcagtccgcctcggcctcccaaggtgccgggattacaggcgtgagccaccgcgcccagcctttttttttttttcttctcttttttgagggtcttactctgtttcccaggctggagcgctgtggcaggatctcggctcactgaacccttgacctctcaggttcaagcagtcctcacgcctcagcctttgaagtagctgggaccgtgggagggtgccaccacatctgttctggctaataatattattattaccactgtttgcagagactcactagatgtagggtcttaatatgttgccgaagctggtctctaactcctgggctcaagcgatcttcctgcctcagactcccaaaattctgggattataggcaggtgccaccgcgcccggcctaaatcttttcttctgttagaaattaagtggttctgcctgtctcagtggctcacgcctgtaatcgcagcgctttgggaggccgaggcgggaggatcacctgaggtcgggagttcgagaccagcctgaccaacatgtagaaaccccatctctactaaaaatataaaattaggtgggcgtggtagcgcatacttgtaatcctagctactcaggaggctgaggcaggagaatcacttgaacccgggarggcggaggttgcggggagcctagatcataccattgctctccagcctgcgcagcaagagagaaactgtctcaaaaaataaaataaaataaaattcagtggttctgactggggaaagagtagcagatgcttagatctagagagactctagttaaggttggctcataagaggatagttgtgtgtgcttttatttctgttctcttgggggatttaggatagagctatagagagctccaaaaaaaaaaatatattggaacaggtcagatgctgtggttgctgtgtgtggagtcctgggcagtgctaaggttttgtgtctaatgagtcctcttaacaagaaggtattgttttttattcactgaggtgagggagcctcttagcatcattctagtccagcttccggacctgagtcttatgcaaatacctatgccagttgccattctcacgctattcacagctatcatataaagaggtgttataccctttctgtaaagtttttgttgctactgctatttttttttttttttttttgagacaaagtctagctctgtttcccaggctggagtacagtggcgctatctcagctcactgcaacttccacctcccaggttcaagcaaytctcgtgcctcagccttctaagtagctgggactacagccgcctgtcaccaacctggctaattttcgtatttttagtygatatagggtttcactatgttggccaggctggtctcaagctccagacctcaggtgatcctcccaccttggactcccaaagtgctgtgattacaggcgtgagccaccgcacccggccctgttgttgtttttaaaatagagacagggtcttaagttgccaggctggtctggaacttctggactggagtgatcacccacctgagcttcccaaagtgcggggattgcaagcgtcagccaccacccccagtgttgtgtttttgtttgttttaccaggctggagtgcagtggtgcgatcacagctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagtgtttggggttccaggtgtgagccatggccccccggccagcttcagtaaagtaaaagccacacacctgtgtcctgagaccaggctccaccactaagttatctttaagcctttttttttttttgagacagtttcactcttgtcgccccaggctggagtgcagtggcgccatgtcagctcaccacaacctctgcctcccactcccaggttcaagcgattctcctgcctcagcctcccaagtagctggaactacaggcacctgccaccacgcccggctaattttttgtatttttagtagagacggggtttcactgtgttagccaggatggtctcgatctcctgacctcacgatccgcccgcctcggcctcccaaagtgctgggattgcaggcgtgagccaccgcgcccggctgtgtgtttgcattatcatattcagcccagttttcacgaagtttcttgtctcctgggtgatccacgtagctccccasttccttatctgatctatgcttgtcctttcatkgttgtgttactactttgctataatgagagagtgttttcgctttataggttaacttttagaacctgagcagcccctcagggaaaaccctgacagtagctggttattttgcaattagaaaaactagctgggcactgaggcaggtgaatcacgaggtcaggagttcgagaccagcctggccaacttggtgaaaccccccatctctactaaaaatacaaaaaaattagctgggcacagtggtgaatgcctgtaatcccagctacttgggaggctgaggcaggagaattgcttgaatccgggaggcagaggttgtagtgagccgagattrcagcactgcactccagccagggtgacaaagtgagactccgtctcaaaaaaaaaaaaaaaaaawatacaaaaagtagctgagcgtggtggtgggtgcccataatcccagctagtcrggaggctgaggcaggagaactgtttgaacctgggaggcagaggttgcagtgagctgagatcgtactactgtactccagcctgggctgcagagtgaaactatctcaaaaataagtaaataaaagtaaaatgagttgaggtcttgctctgttgcccagatgggagtgcagtggcacaatcaaggctcactgcagtttcagtctcccaggctcaagcaatcctcccactgcagcctcctgagtagctgggactacaggcatgtaccaccacccactgctaacttatttttcatggagatgggggtctcactatgttgcccaggctgggagtttgttcttgaagaagcagggtagatggtgagtgtccttgttcgtggcacagcaggaactggcatttgagacaggastgctaatcacyatccctctccactcctcccttgattgtcatcacagctcccacgtgggacaagatggtgtcttcggcrcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagaggtgagyggaaatcggtccacactgtgtcctaggaggaagcaggcgtcctctccaggactttagaaattcagaaggccaggcgcgctggctcacgcctgtcgtcccagccctttgggaggctgaggcggttggaccacctgagggtcaggagtttgagaccagcctgaccaacatggtgatgaaacagcatctctactaaaaatacaaaaatttgctggacgtggtggcagacacctgtaatcccagctactccrggaggctgaggcaggagaatcacttaaatctaggaggcgggggttgctatgagccgagatcacgccattgcaccccagcctgggcaacaagagcaaaattctgtctcaaaaaaaaaaagaaatggcattgaggcttggagagggactgcttgttctgaatgcaggtgctggatcttcataaaccctggtgtctgtcctggtccttattttctacctacttctttttttttttttttttgtccttttatttttttattttttattttattattattattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgtgatagtttactgagaatgatggtttccaatttcatccatgtccctacaaaggacatgaactcatcattttttatggctgcattgtattccatggtatatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatccccacaccgacttccacaatggttgaactagtttacagtcccaccaacagtgtgaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtcsttcgcccactttttgatggggttgtttgtttttttcttgtaaattattttctacctatttctatcgctttcaggtatcgtacagttggcctaacatatctgtggatttaaccaatcctagatcaaaaataatgggggcaaagacaattaaaaataacaatacaataaaatgcacatgaactatggttatttaactcttcttgagagaggatctcactctgtcacccaggctggaatttagcagcacgatctcggctcactgcaacctccgcctcccgggttcaagcgattctcctgcctcagcctcccgagtagccgggattacaagcatgtcccaccatgcctggctgatttttttttttttttttttgtattctaaatagagatggggtttcaccatgttagccaggatagtctcgatgtcrtgacctcatgatctgcccgcctcggcctcccaaagtgttgggattacaggcgtgagccaccgcacccagccagcaagtgcatttagaactactctactttctaccccataacttttttttttgtttgtttgagacaagtctcactctgycacccaggatggagtgcagcagcacaatctcagcttattgcaactcccgccccctgggttcaagtgtttctcctgcatcagcctcttgaatagctaggattatacaggcacctgccactgtgcctggctaaattttgtattttaatagagatggggtttcactatgttggccaggctggtcttgaactcctgaccacgtgatcaacccgcctcagcctcccaatgtgctggrattacaggtgtgagccgccatgcccagctacacttttttttgaaacggggtctcgttttcttgctcaggctggagtacaatggggcaatcacagctcactgcagccttgacctcccagacttgagcaatcctaccactatggcctcccaccacacctcgctcattcttgtatatatatatatttttgtagagatagggtttcaccatgttgcccaggctggtctcgaacttctgtgggctcaaccgatcctcctgccttggcttcccacagtcctgggatcagaaacatgagccacagtgcctggccagtgcagctttatttacagtaaccaagatatagagtcagtctaagtgaccatcagtggatgaataaaaaatgtgcccgttgggtaccctgcctactgcctgggttatgagattgttgggaccccaagccttaaaaaggaaacatggtaggccgggcacagtggctcacgcctgtaatcacagcactttgggaggccaaggcgggtggatcacttgaggccaggagtttgagaccagtcaggccaatgtggtgaaaccctgtctctactaaaaatataaaaaaatcagccgggcgtggtggcacactcctgtagtccyagctacttgggaggctgaggcaggaggattgcttgaaccagagagtcagaggttgcagtgagccaagatcgtgccactgcgctccagcctgggtgacagcaagactccatctcaaraaaaaaaaacaaacaaacatggtattaattacacaatggaatactcctcaaccttaaggaactcctatctttttatttaaaaattgccagttttatttcagctagagatcactttttagcataatgtttcctgtctttaacaatgggtgagggtttttttttttttttttttttggtttggtttggattttggttttgcttttgagtcgaagtttcactcttgtctcccaggctagagtgcaatggcgcgatctcggctcactgtgacctcctcctcccaggtttaagtgattctcctgcctcagcctccagagtagctgggattacaggcgcctaccaccatgcccgctaatttttgtattttagtagagacagggttttaccatgttgaccagactggtctcgaactcccgacctcaggtgatctgcccacctcagcctcccagagtgctgggattacaggtgtgagcaaccatgcccggccaagggtttttaactttagctgacctccggaggttacaagtttgaaaacggcaggaggaaacccagagagttgtaaacttacgaaggtctgggctctgaaaaagatacaaattttctttccatgccaatagcrctcacacagacatggtgaatgttcctgaaacccgccggactttctgtaagaagtgtggcaagcaccacccccacaaagtgacacaaggcaaggattcttggtatgcccaggggaagtagtgttatgacaggaagcagagtggctatggtgggcagactaagccgattttccggaaaaaggctaaaactacaaagaagattgtgctaaggcttgagtgccttgagcccaactgcagatctaagaatgctggctattaaaagatacaagcagccaagcgcggtggctcacgcctgtaatcccaacactttgggaggccgaggtgggcggatcacaaggtcaggagtctgagaccagcctggccaaaatggtgaaaccccatctctactaaaaatacaaaacttagctgggcatggtggtgtatgcctatagtcccagctactcaggaagctgaggcaggagaatcgcttgaacctgggaggcagaggttgcagtgagccaagattgtgccactccagcctgggcaacagagtgacactctgtctcaaaaaaaaaagatgcaagcattttgaactggaaggagataagagaaaggaacaagtgatcsagttctaartgtcatcttttcttttatgaaggcaataaaatcttgagcttatggtaaaatgcaaaattttccccccttctcctttttcagaagcagctttgaaatcctttaataaaaggaarcctctatcattaggtaagttacctcatttataacttttattcttcatgtgagatctggggactcsggcctttgttttaaggagaatgtgctgagcactaagaatgcaaagaaatgccggacttagcatccctgctcccagggcggagctggtctcscaggtgcgtagcagtaagacctgggaagctgaaacacgatcgcgtttgttggaaatctataaatacatacaaagcggggaagggtaagcttggcctttgaatctggataagstagagacttttcttttttgagatggaggcttgctctgtcacctaggctgaagtgcagtggtacgacctcggctgactgcaacctctacctcctgggttcaagcagttctcctgcctcagcctctagaatagctgggattacaggtacctgccaccaggcccggctaattttttgtggtgtttgtagagatggggtttcaccatgatggccaggctggtcttgaactcctgacctcaagtgatctgcccacctcagcgtcccaaaatgctgggattatgggcatgagccaccaccacacccggttttgtttttttttttttttttttttttttgaaacagggcttcactctgtcacttaggctggagtggtgcaatcatggttcactgcagccttgacctcccaagctctggtgatcctcctgcctcagcctcctgagtagctgggaccacaggcacttgccaccatgcctggctaatttttttcactttttgtagagacagggtcttgctatgttgcccaggctggcctcraattactaaactcaatcagtcctcctgcctcaccctcccaaactgctggggtacaggtgtgagccatgacacctggcccttaccagctacttatatcctgaagattattattatttttttwttttttgagatagagtctctctctgttgcccaggctggagtgcagtggcgtgatctcggctcactgcaagctccgcctcccgggttcatgccattctcctgcctcagcctcccgagtagctgggactacaggcgcccaccaccacgcctggctaatttttttgtgtttttagtagagackgggtttcaccgtgttagccaggatggtctcratctcctgaccttgtgatccgcccgcctcggcctcccaaagtgctgggattacaggcgtgagccaccgcgcccggcccctgaagattgtgttttgagatggggtcttgctgtgttgctccggcttgattgcagtggcacagtcatagctcattgcagcctcaaccttccaggctccagagatcctcttacctcagcctcctgagtagctgggactacaggtgtgcactgccacacctgactaatatttgtatttttggtagggacagtttcactatgttgccagatatggtgtcaaactcctggtctcaagtgatcctcccaccttggcctcccaaagtgctgggattacagacatgattcaccacacctggccatgaagactttttttttttggacaaagtctcactctgttgcccaggatggaatgcagtggcatgatctcagctcactgcaacctctgacctccgcctcccggttcaagtgattctcttgcctcagcctcccgagtagctgggattataggtgtctgccaccaagcccagctaatttttgtaattttagtagagatggggtttcaccatgttggccaggctggtcttgaactcctgacctcgtgatccacgtgcctcagcctcccaaagtgttgggattacaggtgtgagtcactgcgcctggtctcatgaagaccttttttgagacagagtcttgctctgtcacccaggctggagtgcagtggtacaatctcactgcagcctccgcctcccaggttcaagtgattctcctgccttagcctcccaagtagctgggattacaggcgcctaccaccacgtctggctaatttttgtatttttagtagagacagggtttcaccatgttggccaggctggtytcaaactgctgacctcaaatgaactgtctgcctcagcctcacaaagtactgggattacaggcatgagccacctcacctggtggtgaagactctaaaggctcttctcagatcagcctttgtcctgaatttcacatgcccgtgtccagttccctccccagcatcttttcaggagttccatggactcacctcttcattatccagggttaagctgcagatattgttattaggattccaccttgttctctctytttytttttttttttttttttgatacggagtctcgcttgctcttttgccaggctgaagtgcagtggagcgatcttggctcactgcaatctccgcctcctgggttcaagcaattcccttgcctcagcctcgcaagtagctgggacttacaggtaacacaccaccatgcccggctaattttttgttttagtagagacggggcttcaccatgttggccgggatggtctcgatctcctgacctcatgatccgcctgccttggcctcccaaagtgttgggttacaggcatgagccaccatgcccggctgattccaccttgttcttacattctttcccagttcattttaaatttatctacctcatcagaaactagggggttaggcctggcaggcagatcacctgaggttgggagttcgagaccagcctgaccaacgtagagaaaccctgtctgtactaaaaatacaaaattagccaggtatggtgrcacattcctgtaatcccagctactccggaggccgaggcaggagaatcacttgaacccaggaggcggaggttgcagtgagccgacatcacaccattgcattccagcctgggcaacaagagcaaaactacatctcaaaaaaaaagaaaaactaggcagttaatcctcaaagcctttccagtggccttatgcgtgagtagtttgtgtgtgtgtgtgtgtgtgtgtgtgtgtgtgtgtgtctttcacaccatgtgttctgaactacttaggaattctcaccagaaaggcacataaacctgggatcatggcctaatgtactttcacttttacatccagtaccttatcaacgtcctttttagtacctaatctaggcttcactactgagactcaggggtccaacttgagccatcttggagtcccactgccagcacagcaacaggcctgtaatgccgccctttttctccagggataacacggaaagaacgaccacctctagacgtggacgaaatgctggagcgcttcaaaacagaagcacaaggtgggtgtcaggacctccaatgttggagtcagctgaggaagccccccgttcttgctgctatctcctgttcctttgaagaaccccatctctctccaatcttttcctccactattcttaatgtgcccactgtctcctggagaatgccaacctcccttccrtaagaatagagggaagaacgaacgttgcagagaattagaactcagtttgtagaaagttaggagcacagcgcagagagtttttgtttttgtttttgttttgagacagtttctctgttggccaggttggaatgcaatggcgcgatctcggctcactgtaacctccacctcccaggttcaagcgattctcctgattctcctgactcagcctcctgagtagctgggattataggcacctgccaccacacccagctaatttttttttttttttttgagacgaagtcttgttcttgtcacccaggctggagtatagtggcaccatccctgttcactgcaacctccgcctcccagattcaagtgattgtcctgtctcagcctcctgagtagctgggactacaggtgcatgccaccacgcccagctaatttttttttgtacttttagtagagacaggtttcaccatctcattcagggtggtctcaaactcctgacctcaagagatctgctccacccacccccaagtctcccgaagtgctgggattacaggcgagagccaccgtacccggccttctttaaattatttaaaagttgacaggtggccaggtgtggtggctctcacctataatctcccagcactttgggaggctgaggcgggtggatcaagagatcgagaccatcctggccaacatggtgaaacccaactctactaaaaacacaaaaattagccgggtgtggtggcacccgcctgtagtcccagctactcaggaggctgaggcaggagaatcgcttgaacccgggaggtggaggttgcagtgagccaagattgtgccactgcactccagcctggcaacagtgcgagactccatcttaaaaaaaaaaaaaaaaaattgacaggcataaatgtatttatggtacattgctcagacaactttaatataaacaacttacagagaaaattgagtcttttgggtaggtgacttgcctgagctgactttgtgataggttttttctgttttttttgtttttgaaatagagtctcactctgtcatgcaggctggagtgcagtggccccatcttggctcactgcaatctctgcctcctgggttcaaggggtcttcctgccacagcctccccaggtgctgggactataggtgcccaccactatgcctggctaacttttgtgtttttagtacagatggggtttcaacagggtagccaggttggtctagaactcctgacctcaagtgatccacctacctcggtctcctaaagtgctgggattacagctgtgaaccaccgcacctagcctgtgatcagtttcagatcagccttgcttactccacattccctcttatcttcctggtagcatttttgtyttttcttgagaaagagttttgcccttgtcgcccaggctagagtgcaatggtgtgatctcggctcgccacaacctccacctcccaggttcaagtgattctgcctcagcctcccgagtagctgggatcataggcgcccaccaccacatctggctaatttttgcatttgttagttttatttttagtagacagggtttcaccatgttgggcaggctggtcttgaactcctgacctcaggtgatccacccacttcrgcctcccaaagtgctgggattacaggcatgagccaccgtacctagcccacattgacttttgatacagcaagtatttcttgctatggctctgtataatagaggtgagtaacttggttgaaggaattgtttgccctgttcatctctctagacacggccaatgtcattcctggcacacaatctttttttttcttgagatggagtctcactctgttgcccagactggagtgcagtggtgcaatcttggcccactgcaacctctgctacccaggttcaagcgattctcctgcctcagcctcccaaatagctgggagtacaggtgtgtgccaccacgcccagctaattttttgtattttagtagagacagggtttcaccgtgttagtcaggatggtctggatctcctaacctcgtgatccgtcygcctcagcctcccaaagtgctgggatgacaggcgtgagccactgtgcccagcctagcacacaatcttgacaaagaatttcggtgcgacttggggtactgtggtgcctgctctatcatcatgcttcagcaggaaatgtgggtgaatagtgcctggtggcatggcaggtaaagaaatgttttgttttgtttttttttttgagacagtcttgctctgtcacccaagctggagtgcagtggcgcaatctcggctcactgcaagctccatctcccgggttcacgccattctgcctcagcctccccagtagytgggactacaggcgcccgccacacgcccggctaattttttgtatttgtagtagagacagggtttcaccgtgttagccaggatggtctcgatctcctgaccttatgatccacccgccttggcctcccaaagtgctgggattacaggcgtgagccaccgcgcccagccgcgggtaaagaaatttatgaagacaatcgtaggtaaaggaaggcagatttattggagaaagtaggaaaagacattggcagagagaccccagcgggcaggttgtcatgagtagctcactgccaggagaccaaagcttcctgcagattttatagaatagggcttgggctgattgataatgtcaacagggggtttaacttgcggtcttctttcagcagaagtgtttgataaactgaggcgtttcatggcaaacagggagtttgtgagctctgtgtgtgatctggccaggaaggccaaacatcttgggccgtatctcctggaccataaaagcagacctggcccagtgcagtggttcatgcctgcaatcccagcactttgggaggctgaggtgggtggatcatctgaggtcagcagttttagactggcctggccaacatggcgaaaccccatctctactaaaaatacaaaaattagcctagacgcagtggcacatgcctgtaattccagttacttgggaagctgaggcaggagaatcgcttgaacccgggaggcggaggttgcagtgagctgagattgcgccactgcactccagcctgggcaacagagtgagactgtctcaaacagacctatagctgacctgtttcctcttgtttgtatgccctgaaccatggaggaaagcttatttatttattttattgagatggagtcttgctctgttgcccagggtggagtgcagtagtgcgatctcttactacaacctccatctcccaggttcaagcaattctcgagcctcttggcctcccaagtagctgagattacaggcatgcgccaccacgcctggctaatttttgcatttttagtagagatggggtttctgtgttggccaggctggtctcgaactcctgagctcaagtgatccaccccacctcagcctcccaaagttctgggattataggcatgagccaccacacctggccggaaaacacatttgtagcttatttgctttatctgatcccgtgccccccctcccccccgccccatcagcctgcctccttttctctaattgggactccacaggaaatacacctgattttgtgtcaatctcacatgagtttgtattttgtagcgtttacagaaacgaaaggaaatgtcatctgcctgggtaaagaagtctttaaaggaaaaaagccaggtctgtaccatatcttcctgcagggagcttgggatcagatttctctttataaacttgaagtcctcttaactttcctatgtaacacaaagcatttatttatgtatgtatgtatcgagacggagttttgctcttgttgcccaggctggagtgccgtggcgtgatctcgactcactgcaacctccgcctcccaggttcaagcaattctcctgcctcagcctcccgagtagctgggattacaggcatgcgccaccatgactggctaattttttatttttagtagagacaaggtttcttcatgttggtcaggctggtgttgaactcccaatgtcaggtgatctgcctgcctcgacctcccaaagggctgggattacaggcatgagccactgtgcccggccaacacaaggcattttgttattttggttttccctatgggtaactgattgcatcctctctcccttccctcctcaccaatgataaagacaaagacaataggtgcaggtatatattgaagacgaagttccgggagatgtggaagagctggcctggagatagcaaagaggtccaggttatggctgagagatacaagatgctgatcccattyagcaaccccagggtgcttcccgggcccttctcatacacggtggtgctgtatggtcctgcaggccttgggaaaaccaygctggcccagaaactaatgctagactgggcagaggacaacctcatccacaaattcaaatatgcgttctacctcagctgcagggagctcagccgcctgggcccgtgcagttttgcagagytggtcttcagggactggcctgaattgcaggatgacattccacacatcctagcccaagcacggaaaatcttgttcgtgattgacggctttgatgagctgggagccgcacctggggcgctgatcsaggacatctgcggggactgggagaagaagaagccrgtgcccgtcctcctggggagtttgctgaacagggtgatgttacccaaggccgccctgctggtcaccacgcggcccagggccctgagggacctccggatcctggcggaggagccgatctacrtaagggtggagggcttcctggaggaggacargagggcctatttcctgagacactttggagaygaggaccaagccatgcgtgcctttgagctaatgaggagcaacgcggccctgttccagctgggctcggcccccgcggtgtgctggatcgtgtgcacgactctgaagctgcagatggagaagggggaggacccrgtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgctycaccgagaggayctggaaaggctcggggtgcaggagtccgacctccgtctgttcctggacggagacatcctccgmcaggacagagtctccaaaggctgctactccttcatccacctcagcttccagcagtttctcactgccctgttctacrccctggagaaggaggaggrrgaggayagggacggccacrcctgggacattggggacgtacagaagctgctttccggagtagaaagactcaggaaccccgacctgatccaagcaggctactactccttyggcctyrctaacgagaagagagccaaggagttggaggccacttttggctgccggatgtcaccggacatcaaacaggaattgctgcgatgcgacataagttgtaagggtggacattcaacggtgacagacctgcaggagctsctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcktctgaatcagacgccgaggttgagaggtgagaaccrtttcactctaccagtcgttccatctttagcctcatcccatgcccccttaggaagaggccagagcctcctatgcactgtggcttagggtcaggaattccctcttgttggrctctttgtttgtttttgttttgagatggagtcttgctctgtcgctcaggctggagcgcagtggcgcgatcttggctcmctgcaacctccgcctcccgggttcaagtgattcttctgcctcagcctcctgagtagctgggactacaggcgcctgccaccttgcccrgctaatttttatattttcattagagacgggatctcagcatgttggccagtctggtcttgaactccgcctgacctcaggtgatccacctgcctcagcctccaaagtgggattacaggcatgattcaccatgcccggcccaaatatatttttttaagacagggtcttgctgtgttgctcaggctggagtacagtggtgaaatcagctcactgcakcctcaaacttctgggttcaagtgatgttcctgagtacctgggatgacaggtattaagtgtgcaccatcatgyccagctaacttaagtgggggtttttttttgtgtttttttttttttttttttttttggaaagacaaaatctcactatgttgtccaggctggtcttgaactcccaaagcactgagattacaggcatgagttaccacacgccctgcctgaatatttcttattgatatgtatagatatgtatattcccaatctttttttttttttttgagacggagtttcactctttttcccaggtcggagtgaagtggctcgatctcggctcactgcaacctccgccccaccaggttcaatgattctcctgcctcagcctcatgagtagctgggattacagccacccacgaccatgcccagctaatttttgtacttttagtagagacggggtttcaccatgttggccaggcaggtctcgaactcccgacctcaggtgatccacccgcctcagcctcacaaagtgctaggattataggcgtgagtcaccgtgcccggtctatattctctatcttttatcaatgatgtgcttagcattttaacttatttttaccctctattggatttttgtctaagaagaataggttctttctcctgtgatgcttcttgggtgttgagttgtctgatggtggtgctaataagtgattacatggtccagctttcaattgtactcatttgtcaggggtatatgcccagagaaaccctaaatacttcagcygtgatggacacacatttggtgtaaccctttyttctcttccctrtagatcccaggatgatcagcacatgcttcctttctggacggacctttgttccatatttggatcaaataaggatctgatgggtytagcaatcaatgatagctttctcagtgcctccctagtaaggatcctgtgtgaacaaatagcctctgacacctgtcatctccagagagtggtgtaagtagaaactaattcatgaactcaaatccttagggtatgaaaatggtacaatgttaacatcggagcaatattcagattcctgtactagactcttaagtgctcgagacacagggaattgagagagtcctgtccttaaatttattttgtgggataatcgtataaagtaatttctaggggctgggcatggtggttcacacttgtaattccaacacttcgggaggccgaggcagacagatcacttgaggtcaggagttcgagaccagcctggccaacgtgacaaaaccctgcctctactaaaaatacaaaaattatccaggcgtggtggcaggcacctgtaatatcagctacttgggaggctgaggcaggagaattacttgaacccaggaggcggaggttgcagtgaaccragatcctgccactggactccagtctgagtgacagagcgaractgcgtctcaaaaaaaaaaaaaaaaaaaaagaaaaagaaaaaaagggccgggcacaatggctcacgcctgtagtcccagcactttgggggcccaaggtggggggatcacttgaggtcaggagttcaagaccagcctggccaagatggtgcaagaccctgtctctacgaaaaatacaaaaatttgccaggtgtcgtggcaggtgcctataatcccagctactccggatgctgagggtaggagtcgcttgaatccgggaggcagagtttgctttgcagtgagccgagatcgcgccactgcactccagcctgggcaacagagtgagactccatctcaaagaaaaaaaaaatctgtaaagatggacaaaaatttaaacatggaaaaaatagttcctaaagtttaaatatatcgagcccctggtttccatttaagtacgatacaggtgtacacactaaagatttcactttcgttytcttttccctaggttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggtatatctcttaatcattaaaatccttcatcatacaaacataagctaccacaagcttatgtggcaattttgtgtaaataagaaaaagttcgttattctgactagaaacagtactaagggcagatgacccaggatgcagcatgrgctgaacttgagtttcnacttgccttgaacagtaaacaccctggacaaccatacgtgaggaccctgaatccaaagaaactcccagaatctttatcatctttttttttttttttatgragtcttgctctgttgcccaggccaaagtgcaatggcacgatcttggctcactgcaacctctgtctcctgggttcaagtaattctgctgcctcagcctcccaagttgctgggattacaggcacccgccaccacgcccggctaatttttgtgcatttagtggagctggtttygccacattgccaggcyggtctcgaactcatgacctcaggtgacctgccctcctcaggctcccaaagtgctgggattataggcatgagccaccatgcccagccagagtccttatgttttggttttggttttggttttttctttttcttttttctttttgagatggagtctcgctctgtcacccaggctggagtgcgttggtatgatctcaggtcactgcagcctccacctcccaggttcaagtgattctcctgcctcagcctcctgagtagctgggattacaggtgcacaccaccacacctggttaatttttgtattattagtagagatggagttttaccacattggccaggctggtctcgaactcatgacctcaggtgatctacccccccacccccaccccaccccgccgtcggcctcccaaagtgaggcatgagccaccgtgcccagcccagaatctttatcttctatcagagatcattcactcatggttcatgcttctcctgtatgatgattcagaataccagctattgacatttttcaagcaagaacccttcargaacatcaagttgccccttttctgttagtcctctggtttgagagctctccccttgggaagctgtccagtggctgcccaggcgatgagaacctacatgcatcatggggttccatgaagcctcacttggccacactggtgtagtaggtggtcattggcctcaaattattgccctgggccaggcgcagtggctcacgcctgggaggccgaggtgggtggatcacttgaggtcaggagttcaagaccggcctggtcaacatggtgaaactctgtctctactaataatacaaaaattagctgggcatgttggcgcacgcctgtagtcccagctactcaggaggctgaggcaggagcatcatttgaacctgagaggcggaggttgcagtgagctgagatcacaccaccgcactccagtctgggcaacagtgtgagactgtctcaaaaaaaaaaaaaaaaatcttggctgggtgcggtagctcatgcctgtaatcccagcactttgggaggccaaggcaggtggatcacaaggtcaggagttcaagaccagcctggccaacatggtgaaaccccacgtctactaaaaatacaaaaacattagctgggcatggtggcgcgtgcctgtaatcccagctactcatggaggctgatgcaagagaattgcttgaacctaggaggcagaggtagcagtgagccaagatcacgccattgcactccagcctgggcaacagagcaaaactccatctcgaggacagaaaaaaaattgattgctctggctctactgatacaatcttaggctgcttaatgggatcttagttgaataggatgctgtacatcttacaggtattggaaggttgaatgaaaccaagcccatgcattcaatagtggctgctatcattactaaccgttgcaattaccctcttttctttttgcctgagaataatgggatgcagggtgagggggaatattgggtgaattaaagatttgggtcactaatttctttctttttttctcaagatatagtcttgctctgtctyctaggctggagtgcagtgccacaatcttggttcactgcaacctctgcctcccgggttcaagtgattcttctccgtcaacctcccaagtagctgggattacaggcacccacctgtatttttgtatttctagtattttgtatttctagtagagacagggttacgccatgctggtggccagggtggtctcaaactcctgacctcgggcaatccaccacacccagctaatttttggtatatttagtagagccggggtttcaccgtgttggctgggctggtctcgaactcctgacctcaagtgacatccatcttccaaaatgctgggattacagccatrtgccaccacgcccagctaattcttgtatttttaggagaaatggggtttcatcatgttgttccggctggtcttaaactcctggcctcatgatccacctgccttggcctgccaaagtcctgggattacaggcatgagccactgtgcccagccactcatttcttatgaatttattctaacacrttttccggatgaacagggcaccttgaaacataggttagtgggctgggtatggtggcttctgcctgtaatcccagtactttgggaggcctaggctggtgtatcgcttgaagtcaggagttttttgttttgagacggagtcttgctctgtcgcccaggctagagtgcagtggagtgatctcggcttactgcaacctccgcctcctgggttcaagtgattctcttgcctcagcctcctgagtagctgggactacaggcacgtgtcgccacgcccatctaacttttgtatgtttagtagagccggggtttcaccatgttggccaggatggtctcaaactcctgacctcctgatctgcccacctcggcctcccaaagtgctgggattacaggcatgagccattgccccggccaaagttaggagtttgagaccagcctggccaacatggtaaaaccccatctctactaaaaaatacaaaaattagccaggcaagatggcatttgcctgtaatcccagctactcaggaggctgaggcgggagaatctcttgaatctaggaggcagaggttgctgtgagctgagatcgcgccactacactccagccagggcgacagagcataaataactccctttcaaaaaaccaaacaatgaaacataggttagcggagtctgcatccaacattagagtcagattgactaagttctgtatttccagctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccrggcgcggtggctcacgcctgtcatcccagcmctctgggaggccgaggtgggcagatcacctgagattgggagtttgagaccagcctgaccaacatggagagacccccacctctactgaaaatacaaaattagctgggcatgktggtgcatggtgcatgmctgcagtcccagctactcgggaggctgaggcaggagaatcacttgaacccaggaggcggaggttgctgtgagccgagattgcrccacctgggcaacaagagtgagactcagtctcaaaaaaaaaaaaaaaaatgacgtggtcctatttctcccacaggttggtgtcttgttccgctaccactcagcagtgggctgatctctccttggcccttgargtcaaccagtccctgacgtgcgtaaacctctccgacaatgagcttctggatgagggtgctaagttgctgtacacaactttgagacaccccaagtgctttctgcagaggttgtcgtaagtctctcctctcttmcagagcagctgtgctttcgatctggggccacagacgagcaatggtcatgcctgacttggctgtatggaacctctygctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacmtgtcaaccgtgttgccatttgtgattcttttstaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgtaagtccgtgctggctgcctgtgtgcgtgggtgtatatgcacacgccccccacctccgggtttgagtagggtggttatgagaacacttaattcctctaaaagttccaagcatgatgctaatgacaactggtaagacctgggtagatgatggtaggaaaaaagtataagtagtagtagagtagtagtaatattctatagggatttggggaatgtagctggttttcgggtttttttttttcctctttatgtatgtatgtattttagagatgggatctcgccgtgttgcctaggctggtctcaaactcctgagctcaagagatctgcctgccttggcctcccaaagtgctagaattacaggcatgagccatgtcaccccatgctgtgttttctcttaatctgtgttcttagaactataactgtaacataaattgcaygcaattggttgtaaatggaatcatttacttattttttaatgaatgatttgcaaatcaggtagtcttctgggccagtgtacgctcagactcccaatggaagctattggaagctacatgctcaatgtgatcctcctkttaatactaaaatcacaggacacgtggcctggcatagtggctcacgcctataatcccatcaccttgggaggccgaagcaaggcagatcccttgagggcaggagttcaagaccagcctgcccaacatggtgaaacattgtctctctactaaaaatacaaaaattagtcacgcatggtgggacatgcctgtaatcccagttactcaggaggctaaggcaggagaatcacttgaacttsggaggtggaggttgcagtgagctgagatggcaccactgaagtccagtctggccaatagagcaagactctctcaaamaaaaaaaattataggacaaatctttagaaaggaattggggcctggcatggtggctcatgcctgtaatctcagcactttaggaggcgggcagaacacctgaggtcaggagtttgagaccagcctggctgatgcagtgaaaccctgtctctactaaaaatacaaaaattagctaggcgtggtggtatggtcctgtaatcccagctacttgggaggctgaggcaggagaatcgcttgaagtcgggaggttgcagtgagccgagatcgtgccagcctgggtgacagaacgagattgtctcaaaaaaaaaaaaaaattgtatctgcactgatggtttctgttcagagattcgattttatgttaacatctctggtattttttttttttttttttaagatggagttttactcttgcccaygctggcaatggcatgatctaggctcactgcaacctccggcttcaaggaggttgattctcctgcctcagcctcctgagtagctgggattacaggcactcaccaccacgccgggctaatttttatatttttagtagagatgggatttcaccatgttggccaggttggtctcgaactgacctcatgatccgcccgcctcagccttccaaagtgctaggatttacaggcatgagccactgcgtccagccatacatatctctggtattctttgtctctaacatcacctccaacagttaggaactgtcctcttcctatgaagtaactaatctaggatatgtacctggcatctgaaaactacccacttaaatttaatgacatattcagttcatggctggagacgatgagtagaaggaaaggattcttcccacacccactatatctaggccctgaaacaytaaaaaagaagtcccacaagcagtgagatgtcaccgactcactaactgtatcttcaaatgaatgtctagtttttttggttgtgtgtgtgtgtggtgtgtggtgtgtgtggtatttttttgggggggggggggttttcttttttttttttttttggttttttttttttgatagtcttgctctgtcgcccaggctggaatgcagtggctccatctcagctcactgcaacctccacctcctgagttcaggtgtgattctcctgcctcagcctcccagggattaaggtgcatgccaccacgcccagctaacttctgtatttttagtagagacgagttttcaccatgttggtcaagctggtctcgaattcctgacctcaggtgatccacccacctcagcctcccaaagtgctgggattacaggtgtgagccaccgtgccggccccctcaattcaactttttgatccatgcccctattttgctaagttgtcaacttccctttagtcttatgtgggttttcctccattacagtcatggaagtttctagaaggccgggtagggtctttgagaggccgaggcaggtggatcatgaggtcaggagttcaagaccagcctggccaacatggtgaaaccctgtctttactaaaaatacaaaaattagccaggcgtggtgtcggagcctgtaatcccagcttacttgggagggtgaggcagagaattgcttgaacctgggaggcggaagttgcagtgagctgagattgtgccactgtactccagcctgggtgtcagagcgagactgtctcaaaaaaaaaaaaaaaaaagtttctatacattcataaagtttcaagatttgggggtgtgttttcacttctccatcgtcatggactccaatctgccatctatttccaaggcccttccaggtcctgtgtccctcagctagtggtatgcttcacttgggacccagagatacatgggcattatagttcaaattataattaagtttagaactctattgagacagaagaaagaaaacagagctaaggtgaaatatctctgataatctgtgttggttaatatctaggatcctagtaccagatatgttggagtgtgagctggtgtcttctgcctgtaagacactacctctctagcaactgaatttagcaaatacaatcgtaatcccagcatgttagggaggccagggtgggcagatcatctgaggtcgggagttcaagaccagcctggccaacatggggaaaccctgtctctactaaaaatacaaaacttagctgggtgtggtggcacgcgcatgtgtgtacacacacacacmcccctgtaatcccagctactcggaaggctggggcacaagaatcgcgtgaanccaggaggcggaggttgaagtgagccaccgtgccagctgagaatccttyttacttctccaacttctgttggccacctgcattccttggcttgtggcccttcctccaacttcrgcagagcatcttcaaacgttgccctggctcccttatcacgtcacctcctgctggctttgactctcagctccctcttatgaggatccctgtgattgctggacctacccaaataaaccaggatataaaccatcttaagatgctcagtcacctctacgaggtcccttttgctcgcaggtgccaggagttgggacttggacatctttaggggaggccattcttctgtccaccacaccaccccatgattccatttccatgtcaccactgtctctaagtgtgtctaacccayggctcaagagtcaaaggtgcatcacagcagtgagaactcacaggttcgggtttgctttcttcctgtggttgatttctaggctttggaactgcgacataactagcgatggctgctgcgatctcacaaagcttctccaagaaaaatcaagcctgttgtgtttggatctggggctraatcacataggagttaagggaatgaagttcctgtgtgaggctttgaggaaaccactgtgcaacttgagatgtctgtggtgagttaacttataagttcaacttcctatacttacaccttactgaatctgtggctagtgtaaaataatcagtgaagccgacttcccaagttatataattgagaggacctttatagagtcgatcgagcatttactaggatggttaaaggaataagttctagtctatgtctaagtttttgtttttttttttcttgaagttttgctcttgtcacataggctggagtgcagtggcgtgatcttggctcactgcaacctccgcctcccaggttcaagcaattctcttgcttcagcttcccgagtagctgggattacaggcgcccgccaccatgcccagctaattcttgtatttttagtagagacagggtttcgccatgttgaaggttcatctcaaactcctgacctcaggtgatccgcccatctcggcctcccaaagtgctgggattacaggcgtgagccactgcgccaggccctatgtctaagttctagtctgtgtyatgcaaagaacacctgtgaaattttaaggatacagtgcctcaagccattcagccaaaagccactgcccagcaccccacattcagagaggtgggaattgggccaggcacagtggctcatacctgtaatcccagcacttygggaggccgaagcgggcggatcacttaaggtcaggagctcaagaccagcctggccaacttgaaactccatctctactaaaatataaaaattagccgagcrtagtagtgggtgcctctttttttttttttttttttttgagatagtttcactcttgttgcccaggctgtagtgtaatggcgcgatctcagctcactgcaacctccacctcctgggttcaagtgattctcctgccttagcctcccacatagctgcaaataaacaggcatgtgccaccatgcctggctaattttgtatttttagtatagacggggtttctccatgttggtcaggctggtctcgacctccggacctcaggtgagagccaccgtgcccagccagtaggtgcctttaatcccagctacttgggaggctgaggcaggagaatcacttgaaccctggaggcagaggttgcagtgagctgagatcctgtcactacactccatcctgggctacaagagcaagactccatctcaggaaaaaataaaaaagaggtaggaattagatatcgtgccagaaaatgctggctctatcagcaggtgagtggtctcaacttggctatcttacaaatmccttgtgagttagctacaatcagatgcacttgaacctggaatcctatctgggaggcaatcttaaaagaatttgactcgggatgggcaaggtggctcatrcctgtaatcctggcattttgggagtccaaggcaggtagattgcttgaggccaagaatttaaaaacagcctggccaacacaatgaagccctgtctctactgaaagtacaaaaatccgctgagcatggctgtgtacctctgctcccagttactcaggaggctgaggtgggaggatcacttgagcctgggaggaagaagttacagcgaattgagatcacgtcacctcactccagcctgggtgacagtgagatcctgtctcaaaaaaaaaaaaaaaamaaaaaaaacaaaggcgcctttttaatcactcactgacacgtgtagaggmgcaaaaagtttgagttgctggttggcccaggaggtcaaggctgcagtgagccaagatggcgttaccacactccagcctgggcaaccgagtgagaccgtgtttcaaaaaataaagtggcagggtgcagtggctcatgcctgtaattccagcactttgggaggccgaggcaggtggatcacctaaggtcaggagttcgtagaccagcctgtctctactaaagagacaggtgaaaccctgtctctctaaaaccacaaaaatcaggcrggcatggtggcacatagctataatctcatctacttggaggcacgagaactgcttgaatccaggaggcagaggctacagtgagccgagatcatgccacagcactccagccctggcgagagagcaagactgtctcaaagaataacttcaaagatggaagttatttaacctctctgctcaaaagcctcagtgcttccctatgtcaatccaggtaaaatcctatattgacgatggcttcagggtcttctgtgagctggccactgcttacctatgacctcatcttgacaatcctccctgtctcactcatgcccgctgcctggatgttctattttacgtgtcagtcacatgtatcttcagggcctctgcacaagctatttctctgcctggagaactcccccccgagctctatgactcggtctcttcaccccctcacctccaaccattgtagccagaacccccagttattccctgtaccccttgcccttcagaacccctcatcgcctccatattttcctgttagcagatgagccctgagggcggagacgttttgtttgttttttgagaccggagtctcactctgtcacccaggctggagtgcaatggcgcgatctcggctcactgcaacctccgcctcctgggttcaagcgattctcctgccccagcctcctgagtagctgggattacaggtgcctgtcaccacgccyagctaacttctgtatatttagtagagacacggttttaccrtgttaggttggtcttgaactccttgacctcaggtgatccatccacctcggcctcccaaagtgctgggattacaggcrtgaaccaccgtgcccggcctgagacttctgttggtcatgcagatccccaacacacgagggtgggcttggcttgccggagggcatcgatcagcactggctgcattaacgtgttgatttctgtgtttccccaggttgtggggatgttccatccctccgttcagttgtgaagacstctgctctgccctcagctgcaaccagagcctcgtcactctggacctgggtcagaatcccttggggtctagtggagtgaagatgctgtttgaaaccttgacatgttccagtggcaccctccggacactcaggtatgatccatttacttccccatcaggctttctccagagtggtaggtttaggggaagcataatgacatggacctgctgtaggagactgatctggtagctggattacaggttcccgccatcacacccagccaatttctgtatttcacttggagaaacggggtttcaccatgttggtcaggctggtctcaaactcctgacctcaggtgatccgcccgcctcggcctcccaaagtgctgggattacaggcgtgagcaaccgcacccggcyaccttttttttttttttcctttgaggcaagaactcactatgttccccaggctggagtccagcagcacaatgatggctcgctgcaggctcgctccagctcctgggctcaagcaatcctgcctcagttcctgagtaggtaggtttataagcatgaaccattgcacccagccacggctgccgtctacctgctcatgatagccatttgtcactgggctgtgttttgtttgttgcattttgtcagggttttggggttttgttttgttttttctttctttttttttttttttttctgagatggagtctcactctgttgcccaggctggggtgcagtggttgctaactgcaacctccacctcccaggttccagctattctcatgcttcagcctcccaagtagctgggattacaggcatgcaccaccacacctaggtaatttttgtatttttagtagagacagggttttgccatgttggccagggtggtctcaaactcctgacctccgtgatttgcccacctcagcatcccaaagtgctgggattacaggcatgagccaccgcacccggcctgagttgtattttgataccatggcatcaaagaaccaagaagccccttcctaggaatgtgggaacttcagaaattctcacaagcaatatactctactgctggcttaaaataatctttatgtagaagaaacatagattacttgtttatttaacatgaaactcagcctaagatactttgtaagtcaaaagacatatggacactaagggtttttttaagctttaagtttgtttgtttgtttatttattatttattttggagacagttttactcttttttttggggtgcatcttttttctttttttttttttttttcctttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaacgagcgtgctgccttcaggatctgtttaacaaagcatatcttgcaccgcccttaatccgtttaactctgagtggacacagcacatgtttcagagagcacggggttgggggtaaggtcacagatcaacaggatcccaaggcagaagaatttttcttagtacagaacaaaatggggggctgacccccccacctccctcccggacagggcggctggccggttagaggggctcctcacttcccattaggggcggccgggcagaggcgcccctcacctcccggacagggcggctggctgggcggggggctgacccccccacctccccgcccggccagagttttactcttgttgtccagcctggagcgcaatggcgctatctcggcttactgcaacctccgcctcccgggttcaagaggttctcctccctcagcctcccaagtagctgggactacaggcatgtgccaccacacctggctaatcttgtatttttaatagagacagggtttctccatattggtcaggctggtctcgaactcctgacttcaggtgacccgcctgcctcagcctcccaaagtgctaagattacaggcgtgagccaccatgcctggcctgcatctcctctgtttaactggtactccggggtccactgagtagaagttgccaaagtgggtgatagagcgggtaagcaggtattagagctatagcccagctgtactcagcaattccattttctgtgtatgataatcaacaagcatctcaaactgcacaatggctatataccattacaaggttaacctgatgttatgtttttctctatcagatcaacatggttgagaataagaggaatgaaaaaaaggattaaaaagagaaatgaaagtctttaatattacattttattatttacttcatttattttttagacaaaaatctcactctattgctcaggctggagtgcaggggcccgatctcagctcactgtaacctccgcctcccaggttcaagtgattctcctgtgtcagcttcctgagtagctgggattatagggatgcaccatcacacccaactaacttttatatttttagtagagatggactttcaccatcttgcctaggctggtctcaaactcctgacctcaagtgatctgcccacctcactctcccaaagtgctggcattacaggcatgacccaccacatctggcctcattttatatttaaaaataaaaaataagcaaatcaagccaggtacagtttaggcaacatggtaaaaccccaactctactaaaaatacaaaaattagctgagcatggtggcaggtgcctgtagtcccagctactcgggaggcagaggataggatggcttgaacccaagaggcacaggttgcagtgagctgagatggtaccactgcactccagcttgggcaacagagagactgtctttttttttttttttttttttttttttttttttttttttgagatcgcccaggctggagtacagtggcacgatctcggctcactgcaagctccgcctcccgggttcacaccattctcctgcctcagcctcctgagtagctgggactacaggcgtccgccaccacgcccggctaattttttgtatttttttagtagagacagggtttcaccgtgttagccaggatggtcttgatctsctgacctcgtgatccaccygcctcagcctcctaaagtgctggsaattacaggcatgagccatcacgccccacctgagactgtcttttaaaaaaaaaaaaaaaaaatcaatgtggaacactcctttgccacctagaataatcaggaaaggtgacccatgccctgtgcctccttaacagactttcaggtacttgggaatttgaaacaaatctccttgatgcacaaagtaaccttttcttcccccattgtaccccaggttgaaaatmgatgactttaatgatgaactcaataagctgctggwagaartagaagaaaaaaacccacaactgattattgatactgagaaacatcatccctgggmagaaaggccttcttctcatgacttcatgatctgaatccccccgagtcattcattctccatgaagtcatcgattttccaggtgtkggtgaactgcctgtgactcctctcctccccsgcccctacccctcagggataatgagttcattgctgggctagatgttttagccatgattctgcctctgttttatacctgcacacrtccttatctttgttacatatgaaatatctgtatcacgggtatattgagagaaataaaggtgagagcattcacaaatgaagctgttacttaataatgggctttgacaagttagagaaaagatatcttactgggtagaacctggggggtgggggaagtgacagtgtttaattgcattgatttctattgccttgtcaatctttgccttgccttggtatttcctttcttttttcttttcttttttttttttttttttttagactgagtttcactctgttgcccacgctggagtacactggcacgatctcagcttactacaacctggcaggttcaagcgattctcctgtctcagcctcctgagtagctgggattacaagcatcccccaccacacccggctaaatttttttgtatttttaatagagatgaggtttcaccatgttggccagtctggtctcaaactcctgacctcaagtgatccacccacctcagcctcccagagtgctgggattacaggcatgagccactgtacccggcttttttttttttctttttctttttcctcaagcatgagtgttgctctgttgcccaggctggaatacagcagcatgatgatagctcactgcagcctcaagctcccaggttcaagcgatcctccagcctcagcctcctcagtagctgggactacaggtgcacaccaccaaaccaggccaatttttgtgggatttttttgaagacagggtctcactatgttgcccaggctgatctcaaactcccaggcgcaagtaatattcctgcctcagcctcccaaagtgctaggattacaggtgtgaaccactgtgcctagcctgtcttgttacttgttgacctgcgtggatcactgcctgctgagtattacttgccagaggatttctcctaccaatctacaatattttaggtgcttcggtgtagctcatatatgaccatgtcattgctctgattttgctttttaaaaattctaacttaaaatagaatctcggccaggcacggtggctcacacctgtaatcccagcacttcgggaggctgaggtgggtggatcacgaagtcaggagttggagaccaacctggccaacgtggtgaaaccccgtctctactaaaaatataaaaaattagccaggcatggtggcacatgcctgtaatcccagctacttgggaggctgaggcaggagaattgcttaaacccaggaggtggatgttgcactgtgctgaagactgcactactgcattccagcttgggcaacagagtgactccttctccaaaaaaaaacaaaatctcatggtatgcatagtttttcactatagagtctccattatttccttgtgatacagaattccaaattcaacaaagcagcagtgcaagctctacgctgtaaaaccacaaacaaaacgaactgtactataaagacaacactagttggcaaagttgcttctcatggggagactttgttgctgtctgtgtttactggatgagcaaacaaatggacggtaagggggaaaaagaacagtacaaatttttattaaacactaatcatgtttttttttgtttgttttgagacagtttcttcttgttgcccaggctggagtgcaatggcacgattttggctcactgcaacctccgcctccccgggttcaagcgattctcttgcctcgacctactgagtagctgggattataggcatgtgccaccaagcctggctaattttgaatttttagcagagacggggtttttccatgttggtcaggctggtctcgaactcccgacctcaggtgatccaccagccttggtctcccaaagtgctgggattacaggtataagtcaccgcacctggcaacatttttttcttttttttttttttttttttttttttttttggtggcagaatcttgctctttcacccaggctggaatgcaatggcacgatctcgggtcactgcagcctccacctccccagtttaagcagttctcccatctcagcctcccatgtagctgggaccacaggtgtgcaccactgcacccaggtaatttttgcatttttggtagagatagggttttgccacgttgtccagactggtcttgaactcctgagctcaggtgatctgcccaccttggcctccccaaatgctgggattataggcatgagccaccacacctggtcaaaagtagttttaatatttaaatttaaaactaaaaaagttaatctctcttcctactttcatttcttcatcaggggctattggtttattcccaccgactagatccaagttctctgatactacctttaaaccactccatcactttccagttccactgcatacagtgtgggcttctgaggtttcctggttcaaggtgtccttgttcaatgcggcatgggtcattccctgagcattttttttttttttgacagtctcgctccattgcccggtttggagtgcagtggtgtgacctcggcttactgcagcctctgcctcccaagttcaagcaattctgcctcaggctcccggataatttttgcatttttagtagagacagggtttcaccgcgctggccaggctggtctcgaacccctaacctcaagcgatctgcctgcctcggtctcccaaagtgctgggattacagacataagctaccgtgcccggcctccagagcatctttattctcagtttcagcgggaagaagggggaaggttggtaaaaagagaggcacaaagtttaaaaaggacattgcgtgaagaaactaaaggtttctccttctccacactattgacatttgggatcggatcactactcgttgggaaacgtcctgtacatttccagggtgttcggcaccatccctagcctctaccccctagataccagctcacatcctcacagttaacagtgatcaaaaatgtctctgggcagtagaaaatatttcctgaaatgcaaagttttcttaggttgagaaccattgtaatctagccccatctttagagaagaaattgagtaacggatctacatccattgaggaactatcgacaccccaggggcccatgaaatgtaaactcgcactcacaattaaccatctttctccaacgtgtgtatttcatgtagccacactctcagatgcccacccccatgacctacaagtcctaaacagggaaacctgtggcacatgggttcatgtgtgtctgaatctatacgttcagagatgaacaagtactgctctccctatacctgtgaccactcgcctccgcccatcactgaattctgaaaatgtggcctcaggctcacagcagcattagcacttgcttgctctggatctcatcacattgatgatcaagaacaaagtattcactgggttctctgctaaggatacaaaaaaaaccattccacaattccacggccatgtttgcacccaggaaccacgagggctgggttagcccagatggtgggcttgggaaatgttcctggagcaaaaaaaagagccagaagtcatgagagcctgaccccctcccccaacgcgcacacacacacaccactctctacctccaagcctcattttcaggcttctcaaagctaaggtcactcccatgagctaagccgcgcttttctcaatcctcagctcttccacaagaataggaagaactctctcctgttcaagatcctgtggctcagctgcagctctggaagaaagaccccggtgagggtcttgcttttcacaatccccaatcccagaccacatcctgtgccccaaaacaacttccatggtaaccacatccttcaggaagtgaagtcaggcaggaagtcaagtcagaagacggaatgggctgggcatggtggatcgcacctgtaatcccagcactttgggaggcagaggcaggtggatcacatgaggtcaggagtttgagaccagcctggccaacatggtgaaaccctgtctctactaaaaataccaaaagtagccaggcttggtggtgcatgcctgtaatcccagctactctggaggctgaggcaggagaatcgcttaaacccggaaggcggaggttgcaatgagccgagatcgcaccattgcactccagcccgggggacagaaaaaaaaaatgtagctgagcatggtagtgcacgtctgtgatctcagctacttgggagtctgaggcaggagaatcacttgaacccaggcggtggaggttgcagtgagccaagattgtaatagtccaatgtgttcaccttgcccactgcctagacagagctgattcgtcaagacagggaatcgcaatagagaataattcatgcagagctggctctacgagagaccagagttttattattattcaaatcagtgtctcccagcattcaggaagagtttttaaggataacttggtgggtgggtgggaagccagtgagccaggagtgctgtttggtcagggatgaaatcgtgggagccaaagctatcttcttgcactcagttcctgagtggaggccaaaagataagatgggccagtttattgatctgggtggtgccagctgacccatcaagtgcagcatctgcaaattaagcgctggtcttagaagcagtttagggagggtcacaatcttgtagcctccagctgcatgactcctaagtcataatttctaatctcgtggctaatgttcgtcctacagggccaatctagtccccaggcaacaaagaggtgtgctttggaaaagggctatcatctttgtttaaactataagtttctcccaaagttcagcctatgcccaggaatgaaaaaggacagcttggaggttagaagcaaaatggagtcagttaaatctctttcactgtctcagtcataattttggaaaggtggtttcaagctggcacaactgcactccaccctaggagacagagcgagaccctgtcaaaaaaaaaaaaaaaaaacaagaagtgaagtcaagataggaggtaaattcggaagacaggaagtggtggtagaagacaagaagtgaagtcatacaggaagtaaagtcagaagacaggaagtgaagtaagaagacaggaagtggttgtagaagacaggaagtgaggtcatacaggaagtaaaatcagaagacaggaagtgacgtcaaaccaggatttgcagtcggaggcaggcaagaagtgaaatcagaagacgggaagtggctgaggggaacgtcttttctctctcctgctcagcccgaagtgaacaggtagcatcaggtgtgccatttcagtgactgggcacagcccaggcacccacatctctctgcagcgcctattcttggaacaccagagacctctacactattttctgttgcttttttccttcattttcagagatgagatcctggattgaatgacttgaattactatggaaagtgattgaccaaggtaagtcacaactatcttgttctttaattttggtgttgtttgttatgacttgttagccgtctagcactcatagctttgcatttccactctgcattacttgtatttttattattttgtgatattcgtaataatttattataaaactgtgttatttttggatatttttaagttaaaatgcgattttttaactaagtggcagtatgcaaagcaagtggttcagaactctcccccattaataagtcttctctcctgaaagaaacaattttgagacttcctgttcttaattctgtttaacagcatacttctaaaagaaaaagtgtatactgttattatttattgtgttacaaaaatatacacgcacctttcatgcacgtccgtgtgaagagaccaccaaacaggctttgtgtgagcaataaagcttttaatcacctgggtgcaggtgggctgagtctgacaagagagtcagcgaagggggataggggtggggccgttttataggatgtgggtaggtaaaggaaaattacagtcaaaggggggttgttctctggcgggcagagtcggggtcataaggtgctcagtaggggagcttttgagccaggatgagccaggagaaggaatttcacaagacaatgtcatcagttaaggcaggaacaggccattttcgcttcttttgtg

SEQ ID NO: 17913 - DNA, 13928 bp, Homo sapiens
gcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccatcgcacccagccaggttttcttaatatatcaaatttatgtgctggtcactttagatatttgattttttaacaaaataacactcactggagtttacttaaaacttttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagacttttgtgatggtcacagccctgcggtgactattacatttgtttgcccgtcggagcggagagaggtaagtgactcgtctcctgatcactaatgtggcgcacagtagcctgggttgcccatgcgaacgcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtgttttgttctagtctctgtgagattattttaagtagttcacggacagatttttttttggtagttgggttgttttagtgaatagtggaaaaacgaagtagaatttcaagcctgtgatttcttatgagaagcctttccctccctctctcttcccagtctgcccctaaacccccatccatgccttctcccctctttctcatcacaggccagtttattgctgtgccctctgctgttgatgaaatctccagcgcagctgtaaactcttcgagtgtggctgctgagacttacttgtccttgagtgcccagcgcctgcaagtgttttaaccaggggcaggtgctgatggaaaggaggcgtcccccagggagggaggggtagggcagggctttcctttagtttctttctgccttcttagtaatagggtgaagtagggaggggctgaattcttttgccagagaaccacactccccttcccccaagcaaatgtggaatttgctctgacgtcaggctggcagctggcctggtgtgtgtgggatatggagacagtgcagggctcagctttccactttctgtccccagacttccacatcaagtgctgtcagctgaatgaaggccggagtgtctgatgtttgttctgaatgtgaatggggaggaatatttattcacacttttcatttgtacctacagatgtgagttgaaatcttttaagcccagtgagatgttctcaggcggtagtggttttagtgttttccctttttatttgttctacatttggtaagaatcattttacactgtgagaaccaagagaattgggagttttcctcctttttcttcgaaggggtatgaggcatttcttggtgttagaagaagaggctgatttgttattagtggagcaagaagttccctctgttttttttttttttttttaaagacagtgtcttgctctgtcgccccggccggagtgcagtgccacgatctcacttcactacaatctccgcctccctagttcaagcaatcctcccacttcaagcaatcctcccacttcagccttctgagtagctgggactacaggcatgtgccaccacgcctggctaatttttgtatttttagtagagacagggctttgctatgttgcccaggctggtcttgaactcccaggctcaagtgatctgtccacctcggcctcccacagtgctgggattacaggtgtgagccaccgcaccggccaggtttcttttcaagcttaactgttcactgggcagaccttgtgtgacatgtgcttggacactgtaatacttgggaggtttgtttaagcatttacatttgctcattgaatgattttaggagctggtatttagtaaacactcaccttgtcatatagatcattttaaaaatgctttatttaatttatttattgggtttacatactgtaaagttcagttttttttaagtacaattcagtggttattagtatttttttttagaactgtgcaaccatcatcacaatctaattttgcatttccatcaccccaaaaagaaacctcctgcccattagcagtctcttcccattcataccccaagccctggcaactgtccaccttcttcctgtctctgtggattggccttttttggatgttttatgtcaggagaatcctacactgtgtggctttctgtgcctggtttctcttacggagccctggggtctgcatcaccatgtgtcagactgcactgagccacgtgggcagaagcatcgattatgagtcaaacagaagagggttgggcctgcagctctgcaacttactaattgtgtgcgacctgtttgtaaacctggcacctagtgcctggcgtgtagcaggtgctcagtgagtatttacggaatgaatggtgctgggaagcagcacggctatgcccggtgctaagcccagtaagtcgtgtctcctaagggtgattaaaaagctggcagtgacattcctggtgagcagggaccccatcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttataagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgcttctttcacattgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggtaagcaggtgctttctgcctcctggcgctgcttaggaagaaggggatcgagagagggaacgggacagtaggggccaagtcagtccatgcatgcttctgggttggagagagctgtagtttgggctggtgtttcagaaataggattcaggtttgactaagtaagactgtaatcttctaatacctattcatataaaacaagcctcttcttgttaatttccctgtttttaggttcatcctatatttcagatggaaaagaatatttgttttatttgaatgtctgtggagaaactgaaatacagttctgtaataaaaaacaagctgcagtttgccaagtgaaaaagagcgatacctctcaagtcaaagcagcaggaagataccacaatcagaccctccggtacgtcaacaacctctgtgcgattttcctttttctttgtatttcttgagatagggttgcactctggcgcccaggctagactgcagtggtgcaatctcggtgcattgcagccttgacttccctgcctcaagtaattctcccacctcagcctcccgagtagctgggactacaggcaggcaccaccatgcctagctggtttctgtagtttttgtagacatggagttttgccatgttgcccacgctgatcttgaagtccttgcctcggtgatcctcccacattggcctcccaaagtgcgtggattagaggcgtgtgccttgggactggcctgcataattttcaagtgcgttgtgtgtattcttgtgaaacataactccctctccttttcttcctctttccattttccgtaaggtacgggagaatcagttactccagcattccttcctagtagacttcggcaagttgccgtttgtcactaaacaatcaaatgtttttcctggctttagagtaagaatgcttctgttagaactgttcactttataaacttgctgtttgtacggaacctactgtaggaaaagtatttaatgagtttacagttgatagggttttttattttaaaattcgtttttaaggagttttgatttttctctggcagtttgagaatctgaagcaccatcaacataacagaaaattttaaacaactaaaaaaatgcattcagcacatttcttttgacccttaacttggtagttgaccttcataaaagcaggatgaaaatgcagttttctgaaaatgtgttaggggcagttacgattcaaaaattaggaacagaaaactgcaaaaaccccagaactggtctttgagctttttaaaagcatggaatatctgccgagaagctgcattttaaacattttatttttgcttctttcaaattgttcaggatcagtatagtccaaggcccctcaggcacggctgtgttcatggcggctgttaagaaggctgtctaattcttgggcgttatttattttgtacgaaatctaaaagtgagaacaagagaagtcttcatgctcacagcaaaaccttcggcactttcttccagccagttactactttgaagcgagaggatgtcaagtccatacatttggaactcatttcctgtagatatttttccctagctggctagagagcttgctgttttagatccgtagtgatttgttgatgctacgcaaaaggcttaatgtagacatttaaaaagattcaagtttttttcttggttctcccaaacacatttgtctgtgtattcacaaaaatctagatattcggatggagacctcaccttgatatattttggaggtgatgaatgcagctcagggtttcagcggatgagcgtcataaactttgagtgcaataaaaccgcaggtaagtgtgcgctggagttcagcccctcctctttgcattcatgggcatgtgcttgtgtgtgtgcacaggcgtgttcttggaagtgaacactgaatggaggagtcagatgccctcctttggactggccagctctagcccccagactgggttttttctgttggagtaacactttccccacccccactgccccagtggacacacacacatcctgtttgtgttttcctcggttttctctgtttgttttgggaatgggcccagcaatgagcttgttgggaaagttttcatcttgaattttggtgcacactaaactacagcaaggacagattcggcaggggcgggatggcttgtcaattttgattgagtgacctcttcttttatgtaatgagtatcaagataatcctttttgcaaagtggtgaccctrtggtagagtttggatctggggattgcagaatgtcactgggtgcrttgaagctgaaggcgtgcatttctctgagtaatgagaagcacccttgagtcaccaaggcactggcatatcaaaaagcggtgccgctgtccatatcttgacgattgtagacacagttgtagctgtagagagatgatgggattcygtcatcatcagagacctgccccatctgttgacccccaggctgtgactccaggcaccctgcagggcatcccaccactgctcagagcaattctagggcccattctggtttccagcctaagtgctgccccacccagagggtctttctggcccttgcttccgtgtgttctgtgtgtttttctacagcagagctttgggtggcttggttacaggatgggttgctacaggattcactgtgggatgagggagaggcagctggacatgatgtgaaccatgctctcgaagcctccggagatcaggtctgcgttgggagagacaggcacccctgccctggtagcaccgcacccctgcgaacgtcctagcaagcaggcaaagaaccagcccagggtcttgccactgggaaggctttcaagcccaaaatgccccagtaactgctgttgtggcacctgcccctgggatgcccttgttcacaggtctgccattgctgtccttgttctctacatggccccttttgttactttcacaatacacacattttttaagtacctatttgcttaggccctatgaggctggagggtgttgtgaggatagatggctctctaggtgttcacagactagcagcagagagagataaggagcatgatgatggaggttcagggcagtgctgctagagtagagcgagtgcttagtgttgtcgctccgctgctttaccaggagggaggcaccgaggtcagctggctggggtctgggctgggtgcaggggtcaggcagttcagagaggaggaagtgctgcctgagccacactacattgaggagcatgccagtcccgtgttggggtggctttagggcctgggcctccagacattcaaaggcatggaccaggggaactgcgagcaggttagaggcgtgtatggggaatgtggctgaagatgaccctggaacggtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctctggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcaggctgctctgctgtggtctgaatctccctgcaactttgtgatgacctcctttggcctgttctgttcagggctttttattaatgacttggccgagatctttgagagtgtgctgatctcatttggggatgctgggaagacagaatcatyatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctagtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgccagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctggctctcaggcaggagttggattaaaaaatacttacatttccttccagctctgtaattcagcactccaaactctgagagcaaattgtgtactgtaaaattagttcattattattttgctcgaatttaaacttagagtttttggagaatatcccttggtagactctgtttattagatagatgtatttttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaatttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaattatttgtaaacttacacgtttttcttcacgtttgcagaatacaaatctttgtcagtagtgaaatgtgaatctagtaggattaaactgtgtgtaaaccttgtgggcgggatgaagagaggcagaggcgcgtcactgttgctgttagttgaccggcaagctcaggggcccagctatggtagctgcctctgggttgtcagctgcgcccaggaggtgaaggtggaaggcattccttaaagacagtggcttagtgtacttattaaaaaccaaaccaaaccagccaaccaaacaaacaaaaaacacaggagagaaaaccaaagaaaaaaagaaaaatagaaaaaaccccacagtagagtggggcaatcttgccttgtggttatgagcacggatgagggcagaccctcagggtctgattcccagctgccctagtttttagttatgaaaccataagcaaattatttagccaccctaaatctgcaaaatggtgctaaaattgtacctttgccatggggttttgaggatcaaatacattaatatagtcatgtgttgcttaacaataggaatatgttctgagaaatgtgtcattaggcgattttgtcattgtgtgaacatcatagagtgtacttaacacacacctagatggtatagcctgctgcacacctaagctatatggtgtagcctattggctcctgggctacaagtgtgtatagcatgtgagtgtactgaatactgcatgcacttgtaacacaacggtaagtatttgagtatctaaatatatctaaacatagaaaaggtccactaaaaatacgatactataatcttttgaggctaccgttttatatgcagtctgttgttgaccaaatgttgttatgcagcacgtaactgtataaagaaagtacttaaacagagcctgttcttctgcagcttgcctttatgtagccgaggtgctgagctcagtgcctggctgagattgtgctcactacaggtttgccgctgtggctggtattataattatagtgatgataatattaaagattggatagaaattacaattgaaatatcatttgctcttggtacagaatcttacttcctgttttcttagatcattacctagcttatgataccaaacctcaagaaggcagatcacatggtgggaggctcagacaaggattatgaaaccatcaggggtgggaaaaggagtgttgtgcccacggacccctagcctggaaaggtgcagggataggatttccagcaaggagcaagtcagcaaagcctctgaatctcagcgtccatgggatggggacgtggcctgtgaagagctggttttcagacttaggcctgaactattcctgctgatggatgggaaatctgggtggctcactcttggtggaagaagaggcttgatttgaggagggtgttacagacaggtgcactgacggaaccacagaatttcagcactgtttggagttgtgctgctaacattgtggggctggcataggaccttggcgtgcttcactgggagcgactgactatagatggcttccactcttgttttactttagggatgagtcccagagaacttgtcttgttcacagtcgcatcactaagtcagcagtgcacagggaactagagctccatttctgtcctcctttctgtgagtccccagtgtcacccagagatgttcaggagcctctgggagctgaccacagcccgggagcagaggatcccactcactgctcttgcgttcctcctgcctgcccttttaatcttatctttggagatgctgtacacagccttctgtcaatgtctcccaaggtgaaaggcatgctggcctgccatcgaggacttagggttaagcatctgaagcttaatagaagcctgtgtcaactcagatccccatggtctctaaaaaaacctggacctgaattttttaacggagcagttggcattggtcctgttcagtttcttccttgctccttagctgttcctcaattttggtcacgtatggagtttaaatttctcctcttgaattgtgcaggtaacgatgggaaaggaactcctgtattcacaggggaggttgactgcacctacttcttcacatgggacacggaatacgcctgtgttaaggagaaggaagacctcctctgcggtgccaccgacgggaagaagcgctatgacctgtccgcgctggtccgccatgcaggtactgccctccttgccatgcgggtcttagtccacatgctcatggaacattttcccatgagtacttttggaaatgcggttactattttctttgtcagtgggttgcgtcacagccctcccccagttttttcatgtggctgtgtgaattattagaaggagcattggactgggaggtgaaataactgaatttgagaccagcatttttgaccttgtgttttcacccttttacacactgcctctcttccatctctgaggtgggatctgcagcctctgccccctggggttcttctgtttggatcctctaggcagatggatgtgcaccttgggctgctgttcaccgctgcctcagcgtgcagtgggcttgtactcgaggctgagcttgctgttgcacggcaggcaccggatgaggtgccaaggaggcagcagcgccccccacagcacaacccctgtccttgggggcctggaatttagcaggaaacagagcaggtggaataataagaatgggagtctcaagcagggataatctgatgggggggatttctggttttaccctcttggcagctcaaattaggtgtacagaagccagttgcctctgtaagggggagatgacccgaagcagagagaatgacttgcctcatgtaattaccacccagaacagtcacagaactgctggcggtatgttctcgctcgtaagtgggagttgaacattgagaacacatgggcacagaggggaacagcacacaccatggcctgtttagggttgggggtgaggggagggaacttagaggatggatcagtaggtgcagcaaaccaccatggcacatgtatacctatgtaacaaacctgcacgttctccacatgtatcttgtttttttttaaagaaaaataaaactgccagggtgacagcactgctgctcctgtcttctgagtcccacctggtttgctaaataccaggttagaaagaggaatccctcttgtggagtgtttgagaacctgcctcactgtgaaccgcctgggcagggagtgctggcagtgctgttgtggttaaacaccctgtgtgctgctgggaacggtgccatagttaattctggcacatgtgtgctagtgaagacattggttttctgtgaagtggaaagagttctagctgcagagttggagacctggctgaggactggtgttgccgcatccaaccacatttgcttgagcgagctgctctccaggcccgggtttcttacggtgaactgggtggtgctgttagattccttaagttaacttttttttttttaaacattactgtgtataagagacaacctaggatctatgagataaggagagatacatttttcaatctacagacttcctgacatagctctggtttcttggaatctgcagtatttcgtggtatttgtgcgtagatagccctaagtaaattatgaagggagagctaaaaccattccttactgcttgaagaagtcccttaagactttacagcccacctggctccaccccagacttccagtgtttagggcaggtccttgttcacatgcacagtcttgtatggtttcttttaggctgttgacattggaaagtacttctccaaatgtactgtatcaccactgatgagtcatggggttttgccttccaaaccccagtacccaacctgcaaagggagcattttcaaatgagaacgtgtatttttatatctttacctcctccttgacacactttgtaagttactccttcagcgactgttcgccgtgtggtttgctttttgtggatgccctcgcccttgcttgctgtgctggtgacactcagctggtgccccctcacgtcctgcaggtgcctaatcagtgtctgatcacactgaccagctcaccagtcttgtgagttcagcggccacctgtggtaccttgcttgtcttctgtggtagcatgcattgcatcctgcactcagtctgcagatgtgtaagaggttgctggtttcttttagcttcacaggccttcacaggggccgagcggggtg

SEQ ID NO: 17914 - DNA, 12309 bp, Homo sapiens
aggcattagcctctatgctccgccagaaatcttatcttgtgtggttgaagctcattgagattggatggatcggcatttccattgtgcaaaccacactcagtcttccagagtggaagaataaataaatggaatcatgaaaagttaattggcaaagcttacagaaagctttaaccttccctggcctaaggctcttccatttgcttaacttacattctaccctgcttggaaaacatcagctttctccttttgaaataagaatggaaagatccatgcacctggatgaaggagactacgaaccagctctcctgaaaagttgtaaactaaaaataaaatccaaagccctcgaccaactgagtggacccactctctgccaaggagaccccagagaaacctcaaaaactgagctctcagtcaaaataggaagagaggtcaaacgcacttaattctactccctcccttttggagttgaggcgtaacaattgaccagcattaatgttacaatagaaataagaccgcgaaaacgtctctgtggcaataagacaccaagttataaacaagaccttaagggtatgcaaggggagggttaagtcatgtctgcacacccatcaattttgctacatagcatcatgcttaacttacaacatcccttttttttttttgagacagagtcttgctctgtcacctaggctggagtgtaatggtgcaatctcggctcactgcaacctccgcctcccaggttcaagcgattctcctgcctcagcctcccaagtggttggcactacaggcatgtactaccatgccctgctaattttttttgtatttttacaaaaaaagaggtttcaccctttttttgaaggggtttcaccatgttggtcattctggtcttgaactcctgacctcaaatgatcccacctgcctcagcctcccaaagtgctgggattacaggcatgagccatcacacacagccacaacagccctttctgttgattccaagttttagacagagccttactcctttaatcaattgcaaattaaagaatctccgaatcaccgggcaaagtggctcacgcctataatcatagcactttgggaggctgaggtgggtgaaattcctgagctcaggagttcaagaccagcctgggcaacaaagtgaaaccctgtctctactaaaatacaaaaaaattagccaggagtggtggtgtgtgcctgtaatcccagctacttgggaggctgagacagaagaatcgcttgaacccaggagcgggaggttgcagtgggccgagattgtgctattgcactctagcctgggcaacagagcaagactgtctcaaaaaaaaaatctctgaatatgctgaataaataacctgtaagcccttgctttaagatatcccaccttttcatatggaatcaatgtatacctttcatgtactgatttatgtctttgccagtaactcctgcctccctgaaatatataaaaacacacagtaatccaactgcctcaggtgcacattctcaggactccttgagaaagtgtttccccgagccacagtcactcatcttggctcaggataaagctctttaaaatattttacagagtttggtttttccattaacaaggtgatactcttcactattgtcaaggccttataagtttctcactgaaaattctaaattaattaaggattcttttaacagcaagctcttaggagacaaaaacatcaaagatcatggtctccaacctggaagattttgtttaatagaaaataccatcaaataaaggactcctagccacgttagaagggccaatatcaggctaccctgcctaagtggacatcttcctcagtggagatcttcaacactttgttctttagaccaggacaagaagtggattaaaatattcatttggttaccttcaggaataggaacacttttcatatttgtatttcaagttgttttgttgataattgtccttatttgtgtcatccttttgattcttaaattgattatgctttgtatttctagatgtctaaagtctaccacaaaattctataacaaaaaactcatcataatagctagatgcttagaaatgacccaacatacctcaactccagtgtaagtgaatgacctgaaatcccgctgctctgtccccttatttttcaatccaatccctgaattgttgcctaccaattcagccttggaacctcactaagtttttaagtgatagtacttctgcccatctcattccctctgacatgggacaagactatccggaaatgagccttcccagcaatgtgggacaaacttacatccaaaacgttgatcatcagtattttaagaagagaaagatttttattaaaaggaggaaatgagaaagaaaaattgctcagagcagtctgagatatgcgaactatgcaaaatttatcaggcccagagggacatgagcatgggacttcagtcacatcactgcacccattcccaggggcaattctttaaaagcattttgttcctgacagctgcctcacccactatcttcatgttcctggaatgtgtgatacaaagaacaatgtatagccaaccaatagctcgttattgtaacatgaatgcttgataaacaacttaggaactgcctcttcctttttcctttaaaaacccatttgtaactgctgctaataggagcatctactcagggcaacttgaatctatgctcctgggttgcagtcctcaaacttgagccaaacggactctctacatatatatagatatagatatagatatagatatagatatagatatagatatagatatagatatatagatatagatatagatatatgtttttttaaagaactctttcactgaaacatgaaagtagtcttcagtgaccaccacccatacgcaagccctttacacatacacagatacacagatatatgtattcataagtatagcagaaggtcacaaacaacacaaaaaaaatgcttttgaggagctaactggagaaatgtattgcaatgtagttgagaattacatgactgtaaaatcacaccaagaaacaagaaggatatttaaatacatctccaagtcaacacatctcggtggaagtctacacttcagttcaaaacttcatttacaaccaaggaaaggcatctaatatttaacatacctactgacacatgtagagaataatacttgtttttccctcttgctgttttcctcagtttggctcagtacctaggcacaagcattccagggcccagggccaaaagcctctaaagcacagcttggtggccctctcctaagatcaaccaccacaatggggagaagccagggtaggacagaatcctcactccttcatccactctcacacatctacatcattttagtttatctgagaaaactgcagagtaatgtaaaaattacattgccactgcaacatgattgcctctgaaaggcaaggcaacgcaactcttctatttatcctgctaaattaaaacagtgtagctgaggatcatagtgctgggcctctcctaatcccaaccccaggttgcaattagttcaatctgtttctgcagctttatgaaaagtgtgctgaggtttaatctgaaaacaaaaggaattctataattgcagctcctttctagaagacatatcccagagctctttgacgacaattgtcaggatgcttttggggccttttccatttggaagcccattatttggggaagtttttggggggggggcggggttgggggaaaaaggtattgaagtagggaagggaaagaagaatacgagtttgcactttcagttcagtagctaaatagcaatttcaacaataaagggtctcaccgtgtcacccaagctgaagtgcagtggcacaatcacagttcactgcagccttaactttccctggctcagctgaacctcccatgtcagcctcccaagtagctgggacatagacgcatgctaccatacccagctaatttttgtatcttttgtagagatgggtttcatcatgttgcccaggctggtctcaaactcctgggctcaagcaatggaaccgcctcaacttcccaaagtgctgagataataggtatgagtcaccgcaccaggtctatttggtaacatttgtatgttaatgtctcacagtgttccatcaaaagatatgaagtaagaattctttccaattcaatagatgcaaaagaccccaattaatggataaaaaaggtccataatagtcctacttgtggaagtaagtcctaggacacttccatgtcaaatgcccagagtagcatcatcacacagaatgctgtttgaccagttgactgcaggtctcaaagactggacagcttattccaaaactagacctttgctgatatctgttgtggatgtataagtaaatgagcaagaaaaatttaaaacctgaattttgcaattggaaaacctgtaaaggtttataggcatgtagaaatggttttacacaagagttacacactgattccatatacaattatcgactacctcatcgtgtgtgaaacacctcaaggtattaatactaaacaatttaagtgatcaggttgtaaaagctaaggtcttccattaacaaaatttttaaaaggtgactcaagagactaagttctcatcaatattgtgttattatagactcaaaacagtgttacaagatgcaaaattttatcttgagatgcaaacatcatgtggcttggggtacttattctgtgaaactaaggcttctttttaagtactaagcatacggcaccatctcttaagtctaggaagattgattcctcaaagtattatagcatctccatgatgtcccaaatatagtgaaaatggaaatgcatacaaaatgaaaggagacttgaaaaattagaaatttttctacaaagcattattcaatcatatgtaaggggatatattttagggtacactatacatagaaatctgtgatttccatataatacaataaaaatgattctatttccttgctgttttcaatttacttccctacctacattcttcagcttgattttcacaataatcccatgcaatgcacaagggagttgatgttgtcccattttcacacattagaaattgaggtttagggacagttacgcaaggcctcagcaaataataacagccaggaatccaggccttctctcaatcagcacttcccaccatgaattcagaataaaaaccaacccccacatttcatgaagttgactgtgggtcctgcaaatgtcatagcaaaatagcagaggagtaataggtagcttttgttagcaacacaaaccgtgtagcctctggttagaagagtgggcaaagaatcataaaggtttcttcagtcacataatgtgaacatccatggaatttctgagcacctgcaaggaaattccaaaacggagcgaaagggaaaaagtgttccgtagagttcctaataaaacttaaagagctccgctaactcttcaactgcaatcagttaacccaagtgaagtcatgtatactgcgcccagagccccctaaaagaagcaacacattgatgcaccttcttaagaccaacaactttcgcgtttgacatttttctcctctaaaaacccgtactctcctggggcagggggtcgagtatttctaaggatgaccgttttgaacagcctgctttcacaggcatccataattcaagtgagagtgaaccatcctgccctggcaaggtacctggcaggggcggctgtgtagggcacttgcaaaggctgcggaggagagcgcgcgggcgaagaagcactcccggaccatgcctctctccggtgcccggtgctgactgcgctgagagcgcaggagctcggcgccgccctccccgtactcccagccctcccgggcgccggggcctggccgcggacctaccagcgagagtactttataggtgttggggtccttggcagtgcgggcgcgcgccgccttctccagcggctcctcccccacgtccataggggccagcaaggacgcggccgcctgcgggtccccgggcgcctcggcagcgtggctgcggccccgatcgcggccgttccccgccgggccctcccggggagcgcgcccgccctcgccgccgcggctcccgccccccgcgcagccgtcgcgctccatcgtggccccggccgctccggcccsgctgcccggccgcgcctttaataggccccgcgccgcccgccccgccccgcccctccccgccgcgcccgcccctcgcggtcagatccttggctccccgccctacacccggctctcgcagtcagggcaaagcgactcaacgccccggattatttggcttcctgtctgatttcgggcactctgtgtgtcggttattttgggtcccttacgtgggcgtgtcttaaacttccccccaagccgtcccctccccgcgccccggccaccctcccgacacttgcaggaatcgccctgcgtggcctcgcggcgcgggctgggctggaattgcagcgtgtggtctgcagagggcatgagatcatggggccccaaaatagagcggggaggaggagaaggatgcagccgccgatgccggtccggcttctcaaaggcgggagagagtggagtcttggggtcgacctgtgagtttctggatggaaatgcaaatgaaccatggaggaaggcgactttctgtttctccccctctgcgccccgtcccccactacctacggtactctgagagagaaatcgtccacttaaaatacgtgggttcacatgtactgaacacacgtaagggatatttcgattcccacggttttatgtggtttctggagtcttctcgctattgtttgtatgtatatttgcttatttttctagactttctgtattgaaggtttcaggagttggcgttgccctctcctgaggttgacactgatacctagctatatcaaaagtgttaatgcaatctgaaatactttgataagccttatttttcaactaggacgctaacagtgagctgattcttggtgggttttgttttacctttgattctggaacttgtacattttctggctcatcacttagcaaaatcaccagtgtgtagtgaagtgagacagagggaaaccagtgacttcgaactactttgcaatacccaggactgacttcaggtaccaaggaaaacaattaattttcaatacattttgaatacatgaatatatacaagtgtttacaaatgagaatgaatgtttaacaaatataaaatgcatgttatccctttaaaatagtcaacttgggatgctcttcatttatactgactcatccatccacccatccatttattcatcaagtaatgaatccttcaactcaatcttttggcctccaactatgcataccatataaaaaatgaattaaaatgtatctttccttaagtgtggtggaagcgggggtgggggggtaggaccaactcgtaaacaaaataattaaaacctaagtcatatatgcagaatagagtcacacataggatattgatacaggagatagaaattatttaggcagatagtatgagcaaaagagccctcggcagaacttaccttctaacaaaaagcagcccaagaaatcacttcctttctaacaaagagcaacctggaagattgggctgcaaacataggtaaggaaactggaagcttgcacgggagatgccggcagcggcacagacagaaggggctactggggccaggcatgtccaccatgggggttccacctcccctcttttttaccacatgcacagtaagaaggaaataagcaacacggagtagctacctgcctatatagtagaagattggggccggggctgccagacacttaagccctatgcagatgacacacctggtcctaaccgggttttcatgccatatgcacgaaaccgggttttccctccttatgtagatcagacaccgcctccccactagctcatctataaaaacccctgcatttcaccacgtattgcaacccattttttgggacccctctctgtagcagagctattctcctccttttgcctattaaaaattctgctccaaacctcaccctttgtgtgtgtccacatatttgatctttgtggccgtgagaccaagaacctcggatgtcaccatagacaacaaagctacttcaatattatgagagcttagtagaaaggacagttgacatctggaagaagtaaaagccttccctcaaagcattattgaacttttttaaaaagttacctttgagtcagctcacaaaccacccaagagaaacaggttttcactgtttcataatcacacatatttttctgccccaaacttggctccaaattttcctttgactctttccaaaaatcagattcaaggacaaagatttgctccactgagactggtcaaatgagtgtcaaaacctctaaaagcaactcaacagagacattatccaaagtgcctttaaacctgacaaaacaaatggaagaagtgtattgtctgcatctcaaggcaacgaaccactttaaagacttaacatttggaaaacacagtgtgcagtctccagggtcacaaacatcttaaggcctagggaaagcatttttctgtggcattaatttatttttaagattttgtatgacatcctggtttttctttcttttttttgaaagcacaatatgccatgaaccatatttgactgaggcagccctatacacactgcaaaaggcaaaccatgtgccatgttaaaggttgcagcatctattcaacaggattgtgtgcccagtgtgggcagatggtcagatttttcaagagaagcaggaaatttaaatgtttgtgtgaattctccggttgcaaaatgttgtctacaaaattcagagaaacagtttcttcaaacaaacaaaatgtagcacgtttaaaagccaaacaaaatgtagcacatctgcaggacagacctggcacacacgtcaccaggatgtggcctctgcctaatgctcatgcctcatctgtgccaggtgggacttaatatgggtaattataaaaacccaattggaagtctaaaatcggaagaataaaaatgagccaaggccgggcacggtggctcacgcctgtaatctcagcattttgggaggctgacgcgggtggttcacttgaggtcaggtgtctgagaccaacctggccaacatgatgaaaaccagtctccactaaaaatacaaaaattagcagggcatggtggcacatgcctgtagtcccagctactctggaggctgaggcaggagaattgcttgaacctgggaggcggaggttgcagtgagccaagatcatgccactgcactccagcatgggcaacagagaaagactctgtctcaaaaaaaaaaaaaaaaaaatgagtcagatatgccattttcaggtttagctatagacattgcaaagcctatagtgaaatattgcctcagtcttctttattctaaatgatctgagggacagcttcaccatcacattccaaagtacaataaggtcatgagatataaaaccacaacacaatttttgggttaatgcaaaggtgaacaatgaatgtttcatccttaatcctaaatcactctgttttagtgattgcatactctaatctggaatagcagtaaagatgataatttaagattttgtgtaagttttctattaagttttattgtaacataaatatttagacatttctgtcttggtgcttgaagctttggttgtagataaggccaaaacaccaaacaaaaacaatttatcaatgtttaattattactttgaaatattactttgaaacaacttttcttagtgattaaaaaatgaaatatgctgtagggtaattattttagcagctgtttcagagcttttccagctttcttctaattcgccagtaaaacaagaaagacatctagccaaatctaaacagaaaaaaaacccacaagcctctttaatctttgtgaggcctagggaaaacatttttctgtggcattaatttatttttaagaatgtgtatgacatcctgatttttctttctttttttgaaagcacaaaaatatgtcccctggagcaagaagcttggataactatgtgaccttgaacagattaccagaagcctctgagccttagtttccttatttgtaaaatgctctttcagataatatctctaaatgccaacaaaatgtttgacatttcaactttacacaaacatttaaatctatcatttgcatttgtaaatcaaccactcactacccctaagggagagaataaaaagatttaattttctcctatattatgcatggtttatatataatctctgggaaggtttgagacctgttattgggcctgcatctacaaagagggtaaggaaaggattcttgctgctctgggatgaaggagagatgcctacagggatcagttaggtaacaaaacgaatagagagaattcagaagtgtaagatccaaaggagagtaatagaacctgggaaaatggaaaacgcatgtaccatccaaagagagtgtggggttctaattagggaaaaggagtcaggatggcgggaccgagggaaagcaaaaatataaagcagataagctgtaagtctgccttgctttgtggtccagaacatgtagccctcttgcacaaataactcacaatcttcctgcactcagctatcatcagaccctcgggtgattaaaaaaaaatgcaagctaattcactgcaacctcggtgttatcagtactgcacaaagccctcttcagcacacagcacaagcaccattctagaacatccccagcaagccttcgtctccttgcagtcagctcctctcttgctggcctgcccattgttcccttgcaacacattttcatacgtgctctaataaatatgactttctttacctacaagtatcttcataaattctttttacccccacaccactggccccagattgtcgctgattacctgctacaggaagttggtttctagtccttcactttttgttaaccacggtatctgccactccttcattatctcttacacttctatttcaaacaaaatgtagggttgccaggtaacctgaattttaagtttgattaaagtacaatttacctattatcatatctacccattatatgcatacagttcagtgatttttaataatttatacagttgtgcaactattaatatgatccagttttggaacaatttcatcacttcaaaaagtttgtttctgcacatgtataatcaaaaactcccattccagtcccaaccaaagacttctctgctttctgtctgtagctttgccttttctagaaaattcatttaaatggtattatactaagttgtcttttgtgtctgtcttctttcacttagcataatgttttgaagttcatccatgctgatgcaaatatcagtagtccctttttatacatagtagtaatttattgtatggatatatcatattttatcttttcaccagttgctggacattcgtattatttccagcttgagctattataaataatgcttctatgaacattcatgtacatgtctttgtgtgaatctgcattttcatttcccttgggtagataactgggagtttcattgttaagtcatatgcaaagcgtatatttaaatttttgagaaacagagaaactgtttcccaatgtggctgtaccattgtacattcctgccagcaacatgtaaggagtccatatgcccctcctacacttactattcacagtatatcagtgggtaaggagtccacatactttgcaatacttcctattctcagtcttttataatagccatttgaataggtgtttggtggtacctcaaagtggcttttatttgcatttccctaatgacgaattatgttgaacaccttttcatgtgcttatctgtcatctatatgtcttctttgatgaaatgcctactcaaatctcttgcccatttttatcagatttgtttctcatctgattattgagttataaacttttttatatattttggacacaagtcttttatcatatttatgatttgcaaatattttatccaatttctttttcttaatgttgtcttttaaaaaacaagtttttaaaattatttttataaaatccaatttatcaatattttctcctatggaacctgattttggtatcatatataggaaatctctgactcacccaaagccacagaagtttctcctatgttttcttctaaagtgttgtaattttagcccttatatttgggtctaggaccattctgagttaatttttgtgtaatgtgtgagataagggtctaaatt
